US009328346B2

(12) United States Patent
Lee et al.

(10) Patent No.: US 9,328,346 B2
(45) Date of Patent: *May 3, 2016

(54) POLYCOMB-ASSOCIATED NON-CODING RNAS

(75) Inventors: Jeannie T. Lee, Boston, MA (US); Jing Zhao, San Diego, CA (US); Kavitha Sarma, Waltham, MA (US); Mark Borowsky, Needham, MA (US); Toshiro Kendrick Ohsumi, Cambridge, MA (US)

(73) Assignee: The General Hospital Corporation, Boston, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 13/884,670

(22) PCT Filed: Nov. 12, 2011

(86) PCT No.: PCT/US2011/060493
§ 371 (c)(1),
(2), (4) Date: Feb. 3, 2014

(87) PCT Pub. No.: WO2012/065143
PCT Pub. Date: May 18, 2012

(65) Prior Publication Data
US 2014/0142160 A1 May 22, 2014

Related U.S. Application Data

(60) Provisional application No. 61/412,862, filed on Nov. 12, 2010, provisional application No. 61/425,174, filed on Dec. 20, 2010, provisional application No. 61/512,754, filed on Jul. 28, 2011.

(51) Int. Cl.
*C12N 15/11* (2006.01)
*C12N 15/113* (2010.01)

(52) U.S. Cl.
CPC .......... *C12N 15/113* (2013.01); *C12N 2310/14* (2013.01); *C12N 2310/141* (2013.01)

(58) Field of Classification Search
CPC ................... C12Q 2600/178; C12Q 2522/101; C12Q 1/6876; C12N 15/113; C12N 2310/14; A61K 31/713
See application file for complete search history.

(56) References Cited

U.S. PATENT DOCUMENTS

| | | | |
|---|---|---|---|
| 5,491,133 A | 2/1996 | Walder et al. |
| 5,576,208 A | 11/1996 | Monia et al. |
| 5,623,065 A | 4/1997 | Cook et al. |
| 5,652,355 A | 7/1997 | Metelev et al. |
| 5,661,134 A | 8/1997 | Cook et al. |
| 5,914,396 A | 6/1999 | Cook et al. |
| 5,919,619 A | 7/1999 | Tullis |
| 5,965,722 A | 10/1999 | Ecker et al. |
| 5,976,879 A | 11/1999 | Kole et al. |
| 6,015,710 A | 1/2000 | Shay et al. |
| 6,040,142 A | 3/2000 | Melki et al. |
| 6,046,307 A | 4/2000 | Shay et al. |
| 6,080,577 A | 6/2000 | Melki et al. |
| 6,107,094 A | 8/2000 | Crooke |
| 6,143,881 A | 11/2000 | Metelev et al. |
| 6,146,829 A | 11/2000 | Cook et al. |
| 6,197,944 B1 | 3/2001 | Walder et al. |
| 6,210,892 B1 | 4/2001 | Bennett et al. |
| 6,294,650 B1 | 9/2001 | Shay et al. |
| 6,326,199 B1 | 12/2001 | Cook et al. |
| 6,346,614 B1 | 2/2002 | Metelev et al. |
| 6,359,124 B1 | 3/2002 | Ecker et al. |
| 6,451,991 B1 | 9/2002 | Martin et al. |
| 6,531,584 B1 | 3/2003 | Cook et al. |
| 6,608,035 B1 | 8/2003 | Agrawal et al. |
| 6,653,466 B2 | 11/2003 | Matsuo |
| 6,653,467 B1 | 11/2003 | Matsuo et al. |
| 6,677,445 B1 | 1/2004 | Innis et al. |
| 6,727,355 B2 | 4/2004 | Matsuo et al. |
| 6,753,423 B1 | 6/2004 | Cook et al. |
| 6,831,166 B2 | 12/2004 | Manoharan et al. |
| 6,919,439 B2 | 7/2005 | Manoharan et al. |
| 7,015,315 B1 | 3/2006 | Cook et al. |
| 7,033,752 B1 | 4/2006 | Melki et al. |
| 7,041,816 B2 | 5/2006 | Ravikumar et al. |
| 7,045,609 B2 | 5/2006 | Metelev et al. |
| 7,683,036 B2 | 3/2010 | Esau et al. |
| 7,687,617 B2 | 3/2010 | Thrue et al. |
| 7,709,456 B2 | 5/2010 | Corey et al. |
| 7,838,657 B2 | 11/2010 | Singh et al. |
| 7,858,592 B2 | 12/2010 | Shames et al. |

(Continued)

FOREIGN PATENT DOCUMENTS

CA 2805791 1/2012
EP 0 999 270 5/2000

(Continued)

OTHER PUBLICATIONS

Gupta et al, Long non-coding RNA HOTAIR reprograms chromatin state to promote cancer metastasis, Nature, 464: 1071-1078.*
International Search Report and Written Opinion for Application No. PCT/US2011/060493 mailed Apr. 18, 2012, 17 pages.
International Search Report and Written Opinion for Application No. PCT/US2013/041440 mailed Jul. 29, 2013, 17 pages.
International Search Report and Written Opinion for Application No. PCT/US2013/041452 mailed Jul. 29, 2013, 15 pages.
International Search Report and Written Opinion for Application No. PCT/US2013/041381 mailed Jul. 29, 2013, 18 pages.
International Search Report and Written Opinion for Application No. PCT/US2013/041455 mailed Aug. 29, 2013, 14 pages.

(Continued)

*Primary Examiner* — Tracy Vivlemore
*Assistant Examiner* — Kate Poliakova-Georgantas
(74) *Attorney, Agent, or Firm* — Fish & Richardson P.C.

(57) ABSTRACT

This invention relates to long non-coding RNAs (lncRNAs), libraries of those ncRNAs that bind chromatin modifiers, such as Polycomb Repressive Complex 2, inhibitory nucleic acids and methods and compositions for targeting lncRNAs.

27 Claims, 47 Drawing Sheets

(56) References Cited

U.S. PATENT DOCUMENTS

| | | |
|---|---|---|
| 7,879,992 B2 | 2/2011 | Vickers et al. |
| 7,888,012 B2 | 2/2011 | Iversen et al. |
| 7,960,541 B2 | 6/2011 | Wilton et al. |
| 8,067,569 B2 | 11/2011 | Iversen et al. |
| 8,092,992 B2 | 1/2012 | Kuwabara et al. |
| 8,110,560 B2 | 2/2012 | Singh et al. |
| 8,129,515 B2 | 3/2012 | Esau et al. |
| 8,153,365 B2 | 4/2012 | Wengel et al. |
| 8,153,602 B1 | 4/2012 | Bennett et al. |
| 8,153,606 B2 | 4/2012 | Collard et al. |
| 8,222,221 B2 | 7/2012 | Corey et al. |
| 8,232,384 B2 | 7/2012 | Wilton et al. |
| 8,288,354 B2 | 10/2012 | Wahlestedt |
| 8,288,356 B2 | 10/2012 | Obad et al. |
| 8,318,690 B2 | 11/2012 | Collard et al. |
| 8,361,977 B2 | 1/2013 | Baker et al. |
| 8,361,980 B2 | 1/2013 | Kauppinen et al. |
| 8,404,659 B2 | 3/2013 | Kauppinen et al. |
| 8,415,313 B2 | 4/2013 | Mourich et al. |
| 2002/0160379 A1 | 10/2002 | Cook et al. |
| 2004/0002153 A1 | 1/2004 | Monia et al. |
| 2004/0005666 A1 | 1/2004 | Hayden et al. |
| 2004/0038274 A1 | 2/2004 | Cook et al. |
| 2005/0226848 A1 | 10/2005 | Kuwabara et al. |
| 2005/0246794 A1 | 11/2005 | Khvorova et al. |
| 2005/0261218 A1 | 11/2005 | Esau et al. |
| 2006/0089490 A1 | 4/2006 | Melki et al. |
| 2006/0128646 A1 | 6/2006 | Christensen et al. |
| 2006/0270624 A1 | 11/2006 | Cook et al. |
| 2007/0032446 A1 | 2/2007 | Cook et al. |
| 2007/0111963 A1 | 5/2007 | Corey et al. |
| 2007/0166737 A1 | 7/2007 | Melki et al. |
| 2007/0292408 A1 | 12/2007 | Singh et al. |
| 2008/0015162 A1 | 1/2008 | Bhanot et al. |
| 2008/0139472 A1 | 6/2008 | Lauterborn et al. |
| 2008/0176793 A1 | 7/2008 | Simons et al. |
| 2008/0242629 A1* | 10/2008 | Crooke et al. .................. 514/44 |
| 2009/0082297 A1 | 3/2009 | Lioy et al. |
| 2009/0092988 A1 | 4/2009 | Schwartz et al. |
| 2009/0099109 A1 | 4/2009 | Shames et al. |
| 2009/0143326 A1 | 6/2009 | Obad et al. |
| 2009/0221685 A1 | 9/2009 | Esau et al. |
| 2009/0258925 A1 | 10/2009 | Wahlestedt |
| 2009/0326051 A1 | 12/2009 | Corey et al. |
| 2010/0021914 A1 | 1/2010 | Moeller |
| 2010/0087511 A1 | 4/2010 | Singh et al. |
| 2010/0105760 A1 | 4/2010 | Collard et al. |
| 2010/0124547 A1 | 5/2010 | Bramlage et al. |
| 2010/0197762 A1 | 8/2010 | Swayze et al. |
| 2010/0210707 A1 | 8/2010 | Li et al. |
| 2010/0210712 A1 | 8/2010 | Hansen et al. |
| 2010/0216238 A1 | 8/2010 | Baker et al. |
| 2010/0256223 A1 | 10/2010 | Moeller et al. |
| 2010/0273863 A1 | 10/2010 | Corey et al. |
| 2010/0280100 A1 | 11/2010 | Collard et al. |
| 2010/0286141 A1 | 11/2010 | Durden et al. |
| 2010/0317606 A1 | 12/2010 | Chan et al. |
| 2011/0039910 A1 | 2/2011 | Crooke et al. |
| 2011/0077286 A1 | 3/2011 | Damha et al. |
| 2011/0086833 A1 | 4/2011 | Paushkin et al. |
| 2011/0150868 A1 | 6/2011 | Yu et al. |
| 2011/0159587 A1 | 6/2011 | Krainer et al. |
| 2011/0172292 A1 | 7/2011 | Hansen et al. |
| 2011/0207217 A1 | 8/2011 | Corey et al. |
| 2011/0237606 A1 | 9/2011 | Chai et al. |
| 2011/0237649 A1 | 9/2011 | Collard et al. |
| 2011/0237650 A1 | 9/2011 | Collard et al. |
| 2011/0237651 A1 | 9/2011 | Collard et al. |
| 2011/0251261 A1 | 10/2011 | Burnett et al. |
| 2011/0263687 A1 | 10/2011 | Mattick et al. |
| 2011/0269820 A1 | 11/2011 | Singh et al. |
| 2011/0294226 A1 | 12/2011 | Melki et al. |
| 2011/0294870 A1 | 12/2011 | Collard et al. |
| 2011/0319317 A1 | 12/2011 | Collard et al. |
| 2011/0319475 A1 | 12/2011 | Collard et al. |
| 2011/0319476 A1 | 12/2011 | Collard et al. |
| 2012/0004184 A1 | 1/2012 | Collard et al. |
| 2012/0004278 A1 | 1/2012 | Chang et al. |
| 2012/0010156 A1 | 1/2012 | Collard et al. |
| 2012/0046236 A1 | 2/2012 | Collard et al. |
| 2012/0046344 A1 | 2/2012 | Collard et al. |
| 2012/0046345 A1 | 2/2012 | Collard et al. |
| 2012/0064048 A1 | 3/2012 | Collard et al. |
| 2012/0083596 A1 | 4/2012 | Elmen et al. |
| 2012/0088817 A1 | 4/2012 | Collard et al. |
| 2012/0094934 A1 | 4/2012 | Collard et al. |
| 2012/0095079 A1 | 4/2012 | Collard et al. |
| 2012/0095081 A1 | 4/2012 | Collard et al. |
| 2012/0129917 A1 | 5/2012 | Collard et al. |
| 2012/0135941 A1 | 5/2012 | Collard et al. |
| 2012/0142610 A1 | 6/2012 | Collard et al. |
| 2012/0142758 A1 | 6/2012 | Collard et al. |
| 2012/0149756 A1 | 6/2012 | Schumperli et al. |
| 2012/0149757 A1 | 6/2012 | Krainer et al. |
| 2012/0149759 A1 | 6/2012 | Collard et al. |
| 2012/0157333 A1 | 6/2012 | Kauppinen et al. |
| 2012/0165394 A1 | 6/2012 | Singh et al. |
| 2012/0171170 A1 | 7/2012 | Collard et al. |
| 2012/0190728 A1 | 7/2012 | Bennett et al. |
| 2012/0252869 A1 | 10/2012 | Collard et al. |
| 2012/0264812 A1 | 10/2012 | Collard et al. |
| 2012/0277290 A1 | 11/2012 | Collard et al. |
| 2012/0288869 A1 | 11/2012 | Schwartz et al. |
| 2012/0289581 A1 | 11/2012 | Chang et al. |
| 2012/0289583 A1 | 11/2012 | Collard et al. |
| 2012/0295952 A1 | 11/2012 | Collard et al. |
| 2012/0295953 A1 | 11/2012 | Collard et al. |
| 2012/0295954 A1 | 11/2012 | Collard et al. |
| 2012/0295959 A1 | 11/2012 | Collard et al. |
| 2012/0309814 A1 | 12/2012 | Collard et al. |
| 2012/0322851 A1 | 12/2012 | Hardee et al. |
| 2012/0322853 A1 | 12/2012 | Collard et al. |
| 2012/0329727 A1 | 12/2012 | Collard et al. |
| 2012/0329855 A1 | 12/2012 | Collar et al. |
| 2013/0035372 A1 | 2/2013 | Collard et al. |
| 2013/0035373 A1 | 2/2013 | Collard et al. |
| 2013/0053428 A1 | 2/2013 | Wahlestedt |
| 2013/0065947 A1 | 3/2013 | Collard et al. |
| 2013/0072421 A1 | 3/2013 | Collard et al. |
| 2013/0072546 A1 | 3/2013 | Collard et al. |
| 2013/0079505 A1 | 3/2013 | Moeller et al. |
| 2013/0085112 A1 | 4/2013 | Collard et al. |
| 2013/0096183 A1 | 4/2013 | Collard et al. |
| 2013/0116300 A1 | 5/2013 | Collard et al. |
| 2013/0137751 A1 | 5/2013 | Collard et al. |
| 2013/0143946 A1 | 6/2013 | Collard et al. |
| 2013/0164846 A1 | 6/2013 | Saetrom |
| 2013/0184325 A9 | 7/2013 | Collard et al. |
| 2013/0210893 A1 | 8/2013 | Collard et al. |
| 2013/0245095 A1 | 9/2013 | Collard et al. |
| 2013/0245099 A1 | 9/2013 | Collard et al. |
| 2013/0253036 A1 | 9/2013 | Collard et al. |
| 2013/0261065 A1 | 10/2013 | Collard et al. |

FOREIGN PATENT DOCUMENTS

| | | |
|---|---|---|
| EP | 1 044 987 | 10/2000 |
| EP | 1 752 536 | 5/2005 |
| EP | 1 695 979 | 8/2006 |
| EP | 2 021 472 | 6/2011 |
| EP | 2 023 940 | 6/2011 |
| EP | 2 431 467 | 3/2012 |
| EP | 2 548 560 | 1/2013 |
| KR | 10-2011-0050134 | 5/2011 |
| WO | WO 89/05358 | 6/1989 |
| WO | WO 92/00386 | 1/1992 |
| WO | WO 93/13121 | 7/1993 |
| WO | WO 94/02499 | 2/1994 |
| WO | WO 94/17093 | 8/1994 |
| WO | WO 95/33852 | 12/1995 |
| WO | WO 01/36627 | 5/2001 |
| WO | WO 01/66129 | 9/2001 |
| WO | WO 02/38738 | 5/2002 |
| WO | WO 02/103015 | 12/2002 |

(56) References Cited

FOREIGN PATENT DOCUMENTS

| | | |
|---|---|---|
| WO | WO 2004/113867 | 12/2004 |
| WO | WO 2005/042018 | 5/2005 |
| WO | WO 2005/044981 | 5/2005 |
| WO | WO 2005/089169 | 9/2005 |
| WO | WO 2006/063356 | 6/2006 |
| WO | WO 2006/130201 | 12/2006 |
| WO | WO 2007/002390 | 1/2007 |
| WO | WO 2007/047913 | 4/2007 |
| WO | WO 2007/076328 | 7/2007 |
| WO | WO 2007/086990 | 8/2007 |
| WO | WO 2007/112754 | 10/2007 |
| WO | WO 2007/115578 | 10/2007 |
| WO | WO 2007/133812 | 11/2007 |
| WO | WO 2008/025069 | 3/2008 |
| WO | WO 2008/029619 | 3/2008 |
| WO | WO 2008/061537 | 5/2008 |
| WO | WO 2008/103761 | 8/2008 |
| WO | WO 2008/103763 | 8/2008 |
| WO | WO 2008/113832 | 9/2008 |
| WO | WO 2008/151639 | 12/2008 |
| WO | WO 2009/043353 | 4/2009 |
| WO | WO 2009/046397 | 4/2009 |
| WO | 2009/061851 | 5/2009 |
| WO | WO 2009/064920 | 5/2009 |
| WO | WO 2009/124341 | 10/2009 |
| WO | WO 2009/134710 | 11/2009 |
| WO | WO 2009/149182 | 12/2009 |
| WO | WO 2009/151546 | 12/2009 |
| WO | WO 2010/000665 | 1/2010 |
| WO | WO 2010/014592 | 2/2010 |
| WO | WO 2010/093860 | 8/2010 |
| WO | WO 2010/115993 | 10/2010 |
| WO | WO 2010/120820 | 10/2010 |
| WO | WO 2010/129746 | 11/2010 |
| WO | WO 2010/129861 | 11/2010 |
| WO | WO 2010/135329 | 11/2010 |
| WO | WO 2010/135695 | 11/2010 |
| WO | WO 2010/138806 | 12/2010 |
| WO | WO 2010/148050 | 12/2010 |
| WO | WO 2010/148065 | 12/2010 |
| WO | WO 2010/148249 | 12/2010 |
| WO | WO 2010/151671 | 12/2010 |
| WO | WO 2010/151674 | 12/2010 |
| WO | WO 2011/017516 | 2/2011 |
| WO | WO 2011/019815 | 2/2011 |
| WO | WO 2011/022606 | 2/2011 |
| WO | WO 2011/025862 | 3/2011 |
| WO | WO 2011/031482 | 3/2011 |
| WO | WO 2011/032109 | 3/2011 |
| WO | WO 2011/038205 | 3/2011 |
| WO | WO 2011/038210 | 3/2011 |
| WO | WO 2011/048125 | 4/2011 |
| WO | WO 2011/055880 | 5/2011 |
| WO | WO 2011/079261 | 6/2011 |
| WO | WO 2011/079263 | 6/2011 |
| WO | WO 2011/082409 | 7/2011 |
| WO | WO 2011/084455 | 7/2011 |
| WO | WO 2011/085066 | 7/2011 |
| WO | WO 2011/097388 | 8/2011 |
| WO | WO 2011/097582 | 8/2011 |
| WO | WO 2011/097641 | 8/2011 |
| WO | WO 2011/123745 | 10/2011 |
| WO | WO 2011/139387 | 11/2011 |
| WO | WO 2011/146674 | 11/2011 |
| WO | WO 2011/146675 | 11/2011 |
| WO | WO 2011/150005 | 12/2011 |
| WO | WO 2011/159836 | 12/2011 |
| WO | WO 2011/163499 | 12/2011 |
| WO | WO 2012/009347 | 1/2012 |
| WO | WO 2012/009402 | 1/2012 |
| WO | WO 2012/012467 | 1/2012 |
| WO | WO 2012/018881 | 2/2012 |
| WO | WO 2012/024478 | 2/2012 |
| WO | WO 2012/027033 | 3/2012 |
| WO | WO 2012/036433 | 3/2012 |
| WO | WO 2012/047956 | 4/2012 |
| WO | WO 2012/054723 | 4/2012 |
| WO | WO 2012/058268 | 5/2012 |
| WO | WO 2012/065143 | 5/2012 |
| WO | WO 2012/068340 | 5/2012 |
| WO | WO 2012/069059 | 5/2012 |
| WO | WO 2012/071238 | 5/2012 |
| WO | WO 2012/087983 | 6/2012 |
| WO | WO 2012/109476 | 8/2012 |
| WO | WO 2012/138487 | 10/2012 |
| WO | WO 2012/144220 | 10/2012 |
| WO | WO 2012/170771 | 12/2012 |
| WO | WO 2012/178122 | 12/2012 |
| WO | WO 2013/006619 | 1/2013 |
| WO | WO 2013/036403 | 3/2013 |
| WO | WO 2013/138374 | 9/2013 |
| WO | WO 2013/041385 | 11/2013 |
| WO | WO 2013/173598 | 11/2013 |
| WO | WO 2013/173599 | 11/2013 |
| WO | WO 2013/173601 | 11/2013 |
| WO | WO 2013/173605 | 11/2013 |
| WO | WO 2013/173608 | 11/2013 |
| WO | WO 2013/173635 | 11/2013 |
| WO | WO 2013/173637 | 11/2013 |
| WO | WO 2013/173638 | 11/2013 |
| WO | WO 2013/173645 | 11/2013 |
| WO | WO 2013/173647 | 11/2013 |
| WO | WO 2013/173652 | 11/2013 |

OTHER PUBLICATIONS

International Search Report and Written Opinion for Application No. PCT/US2013/041389 mailed Jul. 29, 2013, 14 pages.
International Search Report and Written Opinion for Application No. PCT/US2013/041385 mailed Aug. 21, 2013, 12 pages.
International Search Report and Written Opinion for Application No. PCT/US2013/041394 mailed Aug. 21, 2013, 13 pages.
International Search Report and Written Opinion for Application No. PCT/US2011/065939 mailed Apr. 20, 2012, 16 pages.
International Preliminary Report on Patentability in International Application No. PCT/US2011/060493, issued May 14, 2013, 10 pages.
International Preliminary Report on Patentability in International Application No. PCT/US2011/065939, issued Jun. 25, 2013, 11 pages.
Ahn and Lee, "Retinoic acid accelerates downregulation of the Xist repressor, Oct4, and increases the likelihood of Xist activation when Tsix is deficient," BMC Develop Biol., 2010, 10:90, 14 pages.
Axelson, "The Notch signaling cascade in neuroblastoma: role of the basic helix-loop-helix proteins HASH-1 and HES-1," Cancer Lett., 2004, 204:171-178.
Bauman et al., "Therapeutic potential of splice-switching oligonucleotides," Oligonucleotides, Mar. 2009, 19(1):1-13.
Beletskii et al., "PNA interference mapping demonstrates functional domains in the noncoding RNA Xist," Proc Natl Acad Sci U S A, 2001, 98(16):9215-9220.
Bernardi and Pandolfi, "Structure, dynamics and functions of promyelocytic leukaemia nuclear bodies," Nat Rev Mol Cell Biol., 2007, 8:1006-1016.
Bernstein and Allis, "RNA meets chromatin," Genes Dev., 2005, 19:1635-1655.
Bernstein et al., "A bivalent chromatin structure marks key developmental genes in embryonic stem cells," Cell, 2006, 125:315-326.
Bernstein et al., "Mouse polycomb proteins bind differentially to methylated histone H3 and RNA 15 and are enriched in facultative heterochromatin," Mol Cell Biol., 2006, 26:2560-2569.
Boyer et al., "Polycomb complexes repress developmental regulators in murine embryonic stem cells," Nature, 2006, 441:349-353.
Brockdorff et al., "The product of the mouse Xist gene is a 15 kb inactive X-specific transcript containing no conserved ORF and located in the nucleus," Cell, 1992, 71(3):515-526.
Brown et al., "The human XIST gene: analysis of a 17 kb inactive X-specific RNA that contains conserved repeats and is highly localized within the nucleus," Cell, 1992, 71(3):527-542.

(56) References Cited

OTHER PUBLICATIONS

Carninci, et al., "The transcriptional landscape of the mammalian genome," Science, Sep. 2, 2005, 309(5740):1559-1563.

Carthew and Sontheimer, "Origins and Mechanisms of miRNAs and siRNAs. Cell," Feb. 20, 2009 136(4):642-55.

Chahrour et al., "MeCP2, a key contributor to neurological disease, activates and represses transcription," Science, May 30, 2008 320(5880):1224-9 (Author Manuscript).

Clark et al., "The Reality of Pervasive Transcription," PLOS Bio., Jul. 2011, 9(7):e1000625. 6 pages.

Clemson et al., "XIST RNA paints the inactive X chromosome at interphase: evidence for a novel RNA involved in nuclear/chromosome structure," J Cell Biol., 1996, 132(3):259-275.

Cloonan et al., "Stem cell transcriptome profiling via massive-scale mRNA sequencing," Nat Methods, 2008, 5:613-619.

Coombes et al., "Epigenetic properties and identification of an imprint mark in the Nesp-Gnasxl domain of the mouse Gnas imprinted locus," Mol Cell Biol., 2003, 23:5475-5488.

Core et al., "Nascent RNA sequencing reveals widespread pausing and divergent initiation at human promoters," Science, 2008, 322:1845-1848 (Author Manuscript).

Davidson et al., "Singles engage the RNA interference pathway," Cell, Aug. 31, 2012, 150(5):873-5.

Denisenko et al., "Point mutations in the WD40 domain of Eed block its interaction with Ezh2," Mol Cell Biol., 1998, 18:5634-5642.

Di Certo et al., "The artificial gene Jazz, a transcriptional regulator of utrophin, corrects the dystrophic pathology in mdx mice," Hum Mol Genet., Mar. 1, 2010, 19(5):752-60.

Dinger et al., "NRED: a database of long noncoding RNA expression," Nucleic Acids Res., 2009, 37(suppl 1):D122-D126.

Dominski and Kole, "Identification and characterization by antisense oligonucleotides of exon and intron sequences required for splicing," Mol Cell Biol., Nov. 1994, 14(11):7445-7454.

Dominski and Kole, "Restoration of correct splicing in thalassemic pre-mRNA by antisense oligonucleotides," Proc Natl Acad Sci U S A, Sep. 15, 1993, 90(18):8673-7.

Du and Gatti, "Progress toward therapy with antisense-mediated splicing modulation," Curr Opin Mol Ther., Apr. 2009, 11(2):116-23 (Author Manuscript).

Duthie et al., "Xist RNA exhibits a banded localization on the inactive X chromosome and is excluded from autosomal material in cis," Hum Mol Genet., 1999, 8(2):195-204.

Edwards and Ferguson-Smith, "Mechanisms regulating imprinted genes in clusters," Curr Opin Cell Biol., 2007, 19:281-289.

Edwards et al., "The evolution of the DLK1-DIO3 imprinted domain in mammals," PLoS Biol., 2008, 6:e135, 14 pages.

Engstrom et al., "Complex Loci in Human and Mouse Genomes," PLoS Genet., 2006, 2:e47, 14 pages.

Francis et al., "Reconstitution of a functional core polycomb repressive complex," Mol Cell, 2001, 8:545-556.

Frieden et al., "Expanding the design horizon of antisense oligonucleotides with alpha-L-LNA," Nucleic Acids Res., Nov. 1, 2003, 31(21):6365-72.

Genbank Submission; NIH/NCBI, Accession No. AA106140. Marra et al., Feb. 4, 1997. 1 page.

Genbank Submission; NIH/NCBI, Accession No. AL137002. Holt, Dec. 13, 2012. 29 pages.

Genbank Submission; NIH/NCBI, Accession No. BX383579. Li et al., Dec. 23, 2010. 1 page.

Genbank Submission; NIH/NCBI, Accession No. NM_001079668. Young et al., Jan. 18, 2014. 4 pages.

Genbank Submission; NIH/NCBI, Accession No. NM_003317. Young et al., Jan. 18, 2014. 4 pages.

Genbank Submission; NIH/NCBI, Accession No. NM_028475. Diez-Roux et al., Feb. 3, 2014. 6 pages.

Gogliotti et al., "The DcpS inhibitor RG3039 improves survival, function and motor unit pathologies in two SMA mouse models," Hum Mol Genet., Jun. 4, 2013, 55 pages.

Guo et al., "High resolution genome wide binding event finding and motif discovery reveals transcription factor spatial binding constraints," PLoS Comput Biol., 2012, 8(8):e1002638.

Gupta et al., "Long non-coding RNA HOTAIR reprograms chromatin state to promote cancer metastasis," Nature, Apr. 15, 2010, 464(7291):1071-6 (Author Manuscript).

Guttman and Rinn, "Modular regulatory principles of large non-coding RNAs," Nature, Feb. 15, 2012, 482(7385):339-46.

Guttman et al., "Chromatin signature reveals over a thousand highly conserved large non-coding RNAs in mammals," Nature, Mar. 12, 2009, 458(7235):223-7 (Author Manuscript).

Hua et al., "Antisense Masking of an hnRNP A1/A2 Intronic Splicing Silencer Corrects SMN2 Splicing in Transgenic Mice," Am J Hum Genet., Apr. 11, 2008, 82(4):834-48.

Hua et al., "Antisense correction of SMN2 splicing in the CNS rescues necrosis in a type III SMA mouse model," Genes Dev., Aug. 1, 2010, 24(15):1634-44.

Hua et al., "Enhancement of SMN2 Exon 7 Inclusion by Antisense Oligonucleotides Targeting the Exon," PLoS Biol., Apr. 2007, 5(4):e73.

Hua et al., "Peripheral SMN restoration is essential for long-term rescue of a severe spinal muscular atrophy mouse model," Nature, Oct. 5, 2011, 478(7367):123-6 (Author Manuscript).

Inesi et al., "Studies of Ca2+ ATPase (SERCA) inhibition," J Bioenerg Biomembr., Dec. 2005, 37(6):365-8.

Inouye, "Antisense RNA: its functions and applications in gene regulation—a review," Gene, Dec. 10, 1988, 72(1-2):25-34.

Jeon and Lee, "YY1 tethers Xist RNA to the inactive X nucleation center," Cell, Jul. 8, 2011, 146(1):119-33.

Jepsen et al., "Locked nucleic acid: a potent nucleic acid analog in therapeutics and biotechnology," Oligonucleotides, 2004, 14, 130-146.

Jia et al., "Genome-wide computational identification and manual annotation of human long noncoding RNA genes," RNA, 2010, 16(8):1478-1487.

Johansson et al., "Target-specific arrest of mRNA translation by antisense 2'-O-alkyloligoribonucleotides," Nucleic Acids Res., Nov. 11, 1994, 22(22):4591-8.

Johnson, "Long non-coding RNAs in Huntington's disease neurodegeneration," Neurobiol Dis., 2012, 46:245-54.

Kanhere et al., "Short RNAs are transcribed from repressed polycomb target genes and interact with polycomb repressive complex-2," Mol Cell., Jun. 11, 2010, 38(5):675-88.

Kapranov et al., "Genome-wide transcription and the implications for genomic organization," Nat Rev Genet., 2007, 8(6):413-423.

Kapranov et al., "RNA maps reveal new RNA classes and a possible function for pervasive transcription," Science, 2007, 316:1484-1488.

Khalil et al., "Many human large intergenic noncoding RNAs associate with chromatin-modifying complexes and affect gene expression," Proc Natl Acad Sci U S A, Jul. 14, 2009, 106(28):11667-72.

Kim et al., "Widespread transcription at neuronal activity-regulated enhancers," Nature, 2010, 465(7295):182-187 (Author Manuscript).

Klein et al., "Homeostatic regulation of MeCP2 expression by a CREB-induced microRNA," Nat Neurosci., Dec. 2007, 10(12):1513-4.

Krutzfeldt et al., "Silencing of microRNAs in vivo with 'antagomirs'," Nature, 2005, 438(7068):685-689.

Ku et al., "Genomewide analysis of PRC1 and PRC2 occupancy identifies two classes of bivalent domains," PLoS Genet., 2008, 4:e1000242, 14 pages.

Lee and Lu, "Targeted mutagenesis of Tsix leads to nonrandom X inactivation," Cell, 1999, 99:47-57.

Lee et al., "Control of developmental regulators by Polycomb in human embryonic stem cells," Cell, 2006, 125:301-313.

Lee, "Epigenetic regulation by long noncoding RNAs," Science, Dec. 14, 2012, 338(6113):1435-9.

Lee, "Lessons from X-chromosome inactivation: long ncRNA as guides and tethers to the epigenome," Genes Dev., 2009, 23:1831-1842.

Lee, "The X as model for RNA's niche in epigenomic regulation," Cold Spring Harb Perspect Biol., 2010, 2:a003749, 12 pages.

Li et al., "Jarid2 and PRC2, partners in regulating gene expression," Genes Dev., 2010, 24:368-380.

(56) References Cited

OTHER PUBLICATIONS

Lim and Hertel, "Modulation of survival motor neuron pre-mRNA splicing by inhibition of alternative 3' splice site pairing," J Biol Chem., Nov. 30, 2001, 276(48):45476-83.
Lima et al., "Single-stranded siRNAs activate RNAi in animals," Cell, Aug. 31, 2012, 150(5):883-94.
Lin et al., "An in-depth map of polyadenylation sites in cancer," Nucleic Acids Res., Sep. 1, 2012, 40(17):8460-71.
Lin et al., "Asymmetric regulation of imprinting on the maternal and paternal chromosomes at the Dlk1-Gtl2 imprinted cluster on mouse chromosome 12," Nat Genet., 2003, 35:97-102.
Lipovich et al., "MacroRNA underdogs in a microRNA world: Evolutionary, regulatory, and biomedical significance of mammalian long non-protein-coding RNA" Biochimica et Biophysica Acta, Sep. 2010, 1799(9):597-615.
Margueron and Reinberg, "The Polycomb complex PRC2 and its mark in life," Nature, Jan. 20, 2011, 469(7330):343-9 (Author Manuscript).
Mercer et al., "Long non-coding RNAs: insights into functions," Nat Rev Genet., Mar. 2009, 10(3):155-9.
Mercer et al., "Structure and function of long noncoding RNAs in epigenetic regulation," Mar. 5, 2013, 20:300-7.
Merienne and Trottier, "SCA8 CAG/CTG expansions, a tale of two TOXICities: a unique or common case?" PLoS Genet., Aug. 2009, 5(8):e1000593.
Mikkelsen et al., "Genome-wide maps of chromatin state in pluripotent and lineage-committed cells," Nature, 2007, 448:553-560 (Author Manuscript).
Miremadi et al., "Cancer genetics of epigenetic genes," Hum Mol Genet., 2007, 16(Spec No. 1):R28-49.
Miura and Jasmin, "Utrophin upregulation for treating Duchenne or Becker muscular dystrophy: how close are we?" Trends Mol Med., Mar. 2006, 12(3):122-9.
Miyajima et al., "Identification of a cis-acting element for the regulation of SMN exon 7 splicing," J Biol Chem., Jun. 28, 2002, 277(26):23271-7.
Miyaso et al., "An intronic splicing enhancer element in survival motor neuron (SMN) pre-mRNA," J Biol Chem., May 2, 2003, 278(18):15825-31.
Montgomery et al., "The murine polycomb group protein Eed is required for global histone H3 lysine-27 methylation," Curr Biol., 2005, 15:942-947.
Morris et al., "Small interfering RNA-induced transcriptional gene silencing in human cells," Science, Aug. 27, 2004, 305(5688):1289-92.
Morris, "RNA-mediated transcriptional gene silencing in human cells," Curr Top Microbiol Immunol., 2008, 320:211-224.
Mortazavi et al. "Mapping and quantifying mammalian transcriptomes by RNA-Seq," Nat Methods, 2008, 5:621-628.
Munroe et al., "Antisense RNA inhibits splicing of pre-mRNA in vitro," EMBO J., Aug. 1988, 7(8):2523-2532.
Nagano et al., "The Air noncoding RNA epigenetically silences transcription by targeting G9a to chromatin," Science, Dec. 12, 2008, 322(5908):1717-20.
Nie et al., "Long non-coding RNAs: versatile master regulators of gene expression and crucial players in cancer," Am J Transl Res., 2012, 4(2):127-50.
Numata et al., "Identification of novel endogenous antisense transcripts by DNA microarray analysis targeting complementary strand of annotated genes," BMC Genomics, 2009, 10:392, 12 pages.
Numata et al., "Comparative analysis of cis-encoded antisense RNAs in eukaryotes," Gene, 2007, 392(1-2): 134-141.
Okada et al., "Comparative expression analysis uncovers novel features of endogenous antisense transcription," Hum Mol Genet., 2008, 17(11):1631-40.
Orom et al., "LNA-modified oligonucleotides mediate specific inhibition of microRNA function," Gene, 2006, 372:137-141.
Ozsolak et al., "Comprehensive polyadenylation site maps in yeast and human reveal pervasive alternative polyadenylation," Cell, Dec. 10, 2010, 143(6):1018-29.

Pandey et al., "Kcnq1ot1 antisense noncoding RNA mediates lineage-specific transcriptional silencing through chromatin level regulation," Mol Cell, Oct. 24, 2008, 32(2):232-46.
Paro and Lee, "Extending the frontiers of epigenetic regulation," Curr Opin Genet Dev., Apr. 2010, 20(2):107-9.
Pasini et al., "Suz12 is essential for mouse development and for EZH2 histone methyltransferase activity," EMBO J., 2004, 23:4061-4071.
Pedersen et al., "Identification and classification of conserved RNA secondary structures in the human genome," PLoS Comput Biol., Apr. 2006, 2(4):e33.
Peng et al., "Jarid2/Jumonji Coordinates Control of PRC2 Enzymatic Activity and Target Gene Occupancy in Pluripotent Cells," Cell, 2009, 139:1290-1302.
Penny et al., "Requirement for Xist in X chromosome inactivation," Nature, 1996, 379(6561):131-137.
Pereira et al., "Ezh2, the histone methyltransferase of PRC2, regulates the balance between self-renewal and differentiation in the cerebral cortex," Proc Natl Acad Sci U S A., Sep. 7, 2010, 107(36):15957-62.
Petersen and Wengel, "LNA: a versatile tool for therapeutics and genomics," Trends Biotechnol., 2003, 21(2):74-81.
Pietersen and van Lohuizen, "Stem cell regulation by polycomb repressors: postponing commitment," Curr Opin Cell Biol., 2008, 20:201-207.
Ponting et al., "Evolution and functions of long noncoding RNAs," Cell, 2009, 136(4):629-641.
Qi et al., "Repurposing CRISPR as an RNA-guided platform for sequence-specific control of gene expression," Cell, Feb. 28, 2013, 152(5):1173-83.
Rajasekhar and Begemann, "Concise review: roles of polycomb group proteins in development and disease: a stem cell perspective," Stem Cells, 2007, 25:2498-2510.
Rigo et al., "Antisense-based therapy for the treatment of spinal muscular atrophy," J Cell Biol., Oct. 1, 2012, 199(1):21-5.
Ringrose and Paro, "Epigenetic regulation of cellular memory by the Polycomb and Trithorax group proteins," Annu Rev Genet., 2004, 38:413-443.
Rinn et al., "Functional demarcation of active and silent chromatin domains in human HOX loci by noncoding RNAs," Cell, 2007, 129:1311-1323.
Rinn and Chang, "Genome Regulation by Long Noncoding RNAs," Annu Rev Biochem., 2012, 81:145-66 (Author Manuscript).
Røsok and Sioud, "Systematic identification of sense-antisense transcripts in mammalian cells," Nat Biotechnol., 2004, 22(1):104-8.
Sarma et al., "Locked nucleic acids (LNAs) reveal sequence requirements and kinetics of Xist RNA localization to the X chromosome," Proc Natl Acad Sci U S A, Dec. 21, 2010, 107(51):22196-22201.
Saxena et al., "Long non-coding RNA modifies chromatin," Bioessays, 2011, 33:830-9.
Schoeftner et al., "Recruitment of PRC1 function at the initiation of X inactivation independent of PRC2 and silencing," Embo J., 2006, 25:3110-3122.
Schuettengruber et al., "Genome regulation by polycomb and trithorax proteins," Cell, 2007, 128:735-745.
Schwartz and Pirrotta, "Polycomb complexes and epigenetic states," Curr Opin Cell Biol., 2008, 20:266-273.
Schwartz et al., "Genome-wide analysis of Polycomb targets in *Drosophila melanogaster*," Nat Genet., 2006, 38:700-705.
Seila et al., "Divergent transcription from active promoters," Science, Dec. 19, 2008, 322(5909):1849-51 (Author Manuscript).
Seong et al., "Huntingtin facilitates polycomb repressive complex 2," Hum Mol Genet., Feb. 15, 2010, 19(4):573-83.
Shaver et al., "Origin of the polycomb repressive complex 2 and gene silencing by an E(z) homolog in the unicellular alga Chlamydomonas," Epigenetics, May 16, 2010, 5(4):301-12.
Shen et al., "EZH1 mediates methylation on histone H3 lysine 27 and complements EZH2 in maintaining stem cell identity and executing pluripotency," Mol Cell, 2008, 32:491-502.
Shen et al., "Jumonji Modulates Polycomb Activity and Self-Renewal versus Differentiation of Stem Cells," Cell, 2009, 139:1303-1314.

(56) References Cited

OTHER PUBLICATIONS

Shore et al., "Pregnancy-induced noncoding RNA (PINC) associates with polycomb repressive complex 2 and regulates mammary epithelial differentiation," PLoS Genet., 2012, 8(7):e1002840.
Simon and Lange, "Roles of the EZH2 histone methyltransferase in cancer epigenetics," Mutat Res., 2008, 647:21-29.
Sing et al., "A vertebrate Polycomb response element governs segmentation of the posterior hindbrain," Cell, 2009, 138:885-897.
Singh et al., "Splicing of a Critical Exon of Human Survival Motor Neuron is Regulated by a Unique Silencer Element Located in the Last Intron," Mol Cell Biol., Feb. 2006, 26(4):1333-46.
Singh et al., "The regulation and regulatory activities of alternative splicing of the SMN gene," Crit Rev Eukaryot Gene Expr., 2004, 14(4):271-85.
Sparmann and van Lohuizen, "Polycomb silencers control cell fate, development and cancer," Nat Rev Cancer, 2006, 6:846-856.
Taft et al., "Tiny RNAs associated with transcription start sites in animals," Nat Genet., 2009, 41:572-578.
Takagi et al., "Role of Sp1 in transcription of human ATP2A2 gene in keratinocytes," J Invest Dermatol., Jan. 2008, 128(1):96-103.
Takahashi et al., "Deletion of Gtl2, imprinted non-coding RNA, with its differentially methylated region induces lethal parent-origin-dependent defects in mice," Hum Mol Genet., 2009, 18:1879-1888.
Thorvaldsen and Bartolomei, "SnapShot: imprinted gene clusters," Cell, 2007, 130:958.
Torarinsson et al., "Thousands of corresponding human and mouse genomic regions unalignable in primary sequence contain common RNA structure," Genome Res., 2006, 16:885-889.
Tsai et al., "Long noncoding RNA as modular scaffold of histone modification complexes," Science, Aug. 6, 2010, 329(5992):689-93(Author Manuscript).
Ule et al., "CLIP: a method for identifying protein-RNA interaction sites in living cells," Methods, 2005, 37:376-386.
Vickers et al., "Fully modified 2' MOE oligonucleotides redirect polyadenylation," Nucleic Acids Res., Mar. 15, 2001, 29(6):1293-9.
Wahlestedt, "Natural antisense and noncoding RNA transcripts as potential drug targets," Drug Discov Today, Jun. 2006, 11(11-12):503-8.
Wahlestedt, "Targeting long non-coding RNA to therapeutically upregulate gene expression," Nature Rev Drug Disc., Jun. 2013, 12:433-46.
Wan and Bartolomei, "Regulation of imprinting in clusters: noncoding RNAs versus insulators," Adv Genet., 2008, 61:207-223.
Wang et al., "Long non-coding RNA UCA1a(CUDR) promotes proliferation and tumorigenesis of bladder cancer," Int J Oncol., Jul. 2012, 41(1):276-84.
Wang and Change, "Molecular mechanisms of long noncoding RNAs," Cell Press, Sep. 16, 2011, 43(6):904-14.
Washietl et al., "Fast and reliable prediction of noncoding RNAs," Proc. Natl. Acad. Sci., 2005, 102:2454-2459.
Williams et al., "Oligonucleotide-mediated survival of motor neuron protein expression in CNS improves phenotype in a mouse model of spinal muscular atrophy," J Neurosci., Jun. 17, 2009, 29(24):7633-8.
Williamson et al., "Identification of an imprinting control region affecting the expression of all transcripts in 10 the Gnas cluster," Nat Genet., 2006, 38:350-355.
Wilusz et al., "A triple helix stabilizes the 3' ends of long noncoding RNAs that lack poly(A) tails," Genes Dev., Nov. 1, 2012, 26(21):2392-407.
Woo et al., "A region of the human HOXD cluster that confers Polycomb-group responsiveness," Cell, 2010, 140:99-110.
Wutz et al., "Chromosomal silencing and localization are mediated by different domains of Xist RNA," Nat Genet., 2002, 30(2):167-174.
Yap et al., "Molecular interplay of the noncoding RNA ANRIL and methylated histone H3 lysine 27 by polycomb CBX7 in transcriptional silencing of INK4a," Mol Cell, 2010, 38:662-674.
Yu et al., "Single-stranded RNAs use RNAi to potently and allele-selectively inhibit mutant huntingtin expression," Cell, Aug. 31, 2012, 150(5):895-908 (Author Manuscript).

Zhang et al., "NATsDB: Natural Antisense Transcripts DataBase," Nucl. Acids Res., 2006, 35(suppl 1): D156-D161.
Zhao et al., "Genome-wide identification of polycomb-associated RNAs by RIP-seq," Mol Cell., Dec. 22, 2010, 40(6):939-53.
Zhao et al., "Polycomb proteins targeted by a short repeat RNA to the mouse X-chromosome," Science, 2008, 322(5902):750-756 (Author Manuscript).
Brown et al., "A gene from the region of the human X inactivation centre is expressed exclusively from the inactive X chromosome," Nature, 349:38-44 (Jan. 3, 1991).
Froberg et al., "Guided by RNAs: X-inactivation as a model for lncRNA function," J Mol Biol., 425(19):3698-706 (Oct. 9, 2013) doi: 10.1016/j.jmb.2013.06.031. Epub Jun. 28, 2013. Review. 15 pages.
Gontan et al., "Long Noncoding RNAs and X Chromosome Inactivation," Prog Mol Subcell Biol., 51:43-64 (2011) doi: 10.1007/978-3-642-16502-3_3.
Lee et al., "Genetic analysis of the mouse X inactivation center defines an 80-kb multifunction domain," Proc Natl Acad Sci U S A, 96(7):3836-41 (Mar. 30, 1999).
Modarresi et al., "Inhibition of natural antisense transcripts in vivo results in gene-specific transcriptional upregulation," Nat Biotechnol, 30(5):453-9 (Mar. 25, 2012) doi: 10.1038/nbt.2158. 21 pages.
Simon et al., "High-resolution Xist binding maps reveal two-step spreading during X-chromosome inactivation," Nature, 504(7480):465-9 (Dec. 19, 2013) doi: 10.1038/nature12719. Epub Oct. 27, 2013.
Tian et al., "The long noncoding RNA, Jpx, is a molecular switch for X chromosome inactivation," Cell, 143(3):390-403 (Oct. 29, 2010) doi: 10.1016/j.cell.2010.09.049. 21 pages.
Tsai et al., "Higher order chromatin structure at the X-inactivation center via looping DNA," Dev Biol, 319(2):416-25 (Jul. 15, 2008) doi: 10.1016/j.ydbio.2008.04.010. Epub Apr. 18, 2008. 22 pages.
Yang et al., "Long noncoding RNAs: fresh perspectives into the RNA world," Trends Biochem Sci.,39(1):35-43 (Jan. 2014) doi: 10.1016/j.tibs.2013.10.002. Epub Nov. 27, 2013. Review.
Office Action issued in AU2011325956 on Sep. 23, 2014 (3 pages).
Office Action issued in AU2011349464 on Sep. 23, 2014 (3 pages).
Extended European Search Report issued in EP11840099.3 on Oct. 7, 2014 (7 pages).
Tano et al., "MALAT-1 enhances cell motility of lung adenocarcinoma cells by influencing the expression of motility-related genes," FEBS Letters, 584(22):4575-4580 (2010).
Taft et al., "Non-coding RNAs: regulators of disease," The Journal of Pathology, 220(2):126-139 (2009).
Astuti et al., "Epigenetic alteration at the DLK1-GTL2 imprinted domain in human neoplasia: analysis of neuroblastoma, phaeochromocytoma and Wilms' tumour," British Journal of Cancer, 92(8):1574-1580 (2005).
Costa et al., "Non-coding RNAs: New players in eukaryotic biology," Gene, 357(2):83-94 (2005).
Ali Faghihi et al., "Expression of a noncoding RNA is elevated in Alzheimer's disease and drives rapid fee-forward regulation of [beta]-secretase," Nature Medicine, 14(7):723-730 (Jul. 2008).
European Search Report issued in EP11852141.8 on Jan. 7, 2015 (7 pages).
Geneimprint: About Geneimprint, downloaded from the internet at http://www.geneimprint.com/site/about-this-site on May 22, 2015, 1 page.
Imprinted Gene, Mosby's Dictionary of Medicine, Nursing & Health Professions, 8th Edition, p. 949 (2009).
Schultz et al., "Enhancers compete with a long non-coding RNA for regulation of the Kcnq1 domain," Nucleic Acids Research, 2015, vol. 43, No. 2 745-759 (2014).
Catalogue of Parent of Origin Effects, Imprinted Genes and Related Effects, Parental Origins of de novo Mutations, downloaded at http://igc.otago.ac.nz/home.html on May 22, 2015, 2 pgs.

* cited by examiner

FIG. 1B
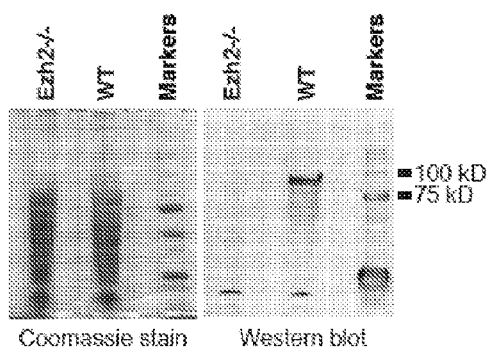
FIG. 1C
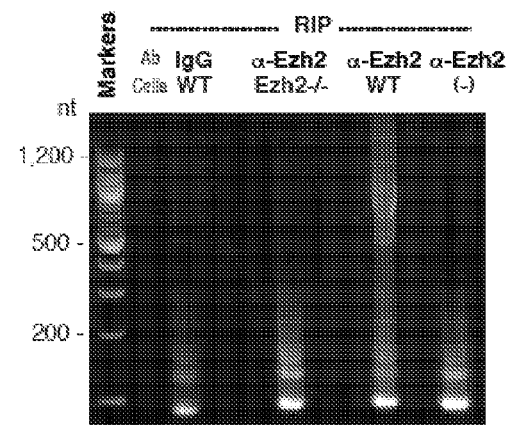
FIG. 1D
| Pilot library statistics | | | Number of reads (nonrepetitive fraction only) | | | |
|---|---|---|---|---|---|---|
| Libraries | Pilot reads | Reads remaining after filtering | Total distinct reads | ncRNA | Antisense RNA | Unannotated RNA |
| WT RIP-seq | 3,316,367 | 1,174,808 | 301,427 | 231,104 | 50,445 | 182,538 |
| Technical replicate | 2,857,116 | 356,435 | 98,704 | 74,305 | 14,886 | 58,099 |
| Biological replicate | 1,913,612 | 231,880 | 87,128 | 63,958 | 12,085 | 47,108 |
| Ezh2-/- control | 1,491,715 | 73,691 | 17,424 | 13,865 | 2,998 | 11,294 |
| IgG control | 486,315 | 4,888 | 1,050 | 973 | 191 | 783 |

FIG. 1E
| Libraries | CC |
| --- | --- |
| WT RIP-seq | 1.00 |
| Technical replicate | 0.90 |
| Biological replicate | 0.71 |
| Ezh2-/- control | 0.27 |
| IgG control | 0.01 |
FIG. 1F
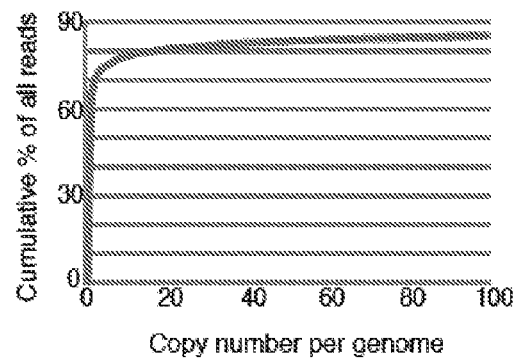
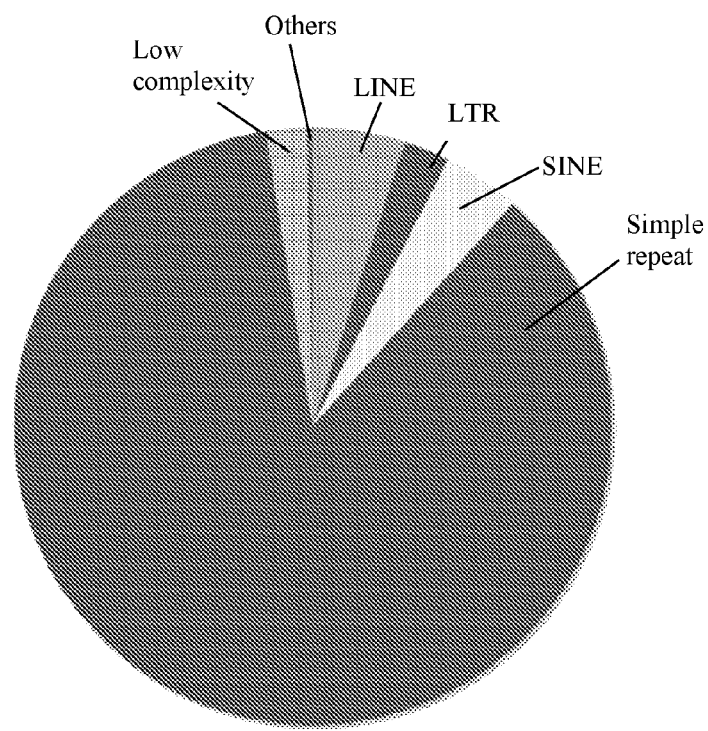
FIG. 1G

| PRC2 transcriptome | |
|---|---|
| Features | Number of transcripts * |
| Total PRC2-interacting RNA | 9,788 † |
|    Sense to annotated UCSC transcripts | 4,446 |
|    Antisense to annotated UCSC transcripts | 3,106 |
|    Bidirectional | 1,118 |
| PRC2-binding site | 330 (1,800) |
| Bivalent domain | 562 (2,704) |
| Imprinted gene | 34 (83) |
| Oncogene | 182 (441) |
| Tumor suppressor | 325 (793) |
| LincRNA | 216 (2127) |

\* Parenthesis indicate total transcripts in each feature; e.g., Of 83 known imprinted genes, 34 were present in the PRC2 transcriptome.
† The transcriptome size: 9,788 = 4,446 + 3,106 + (1,118 × 2)

FIG. 2B

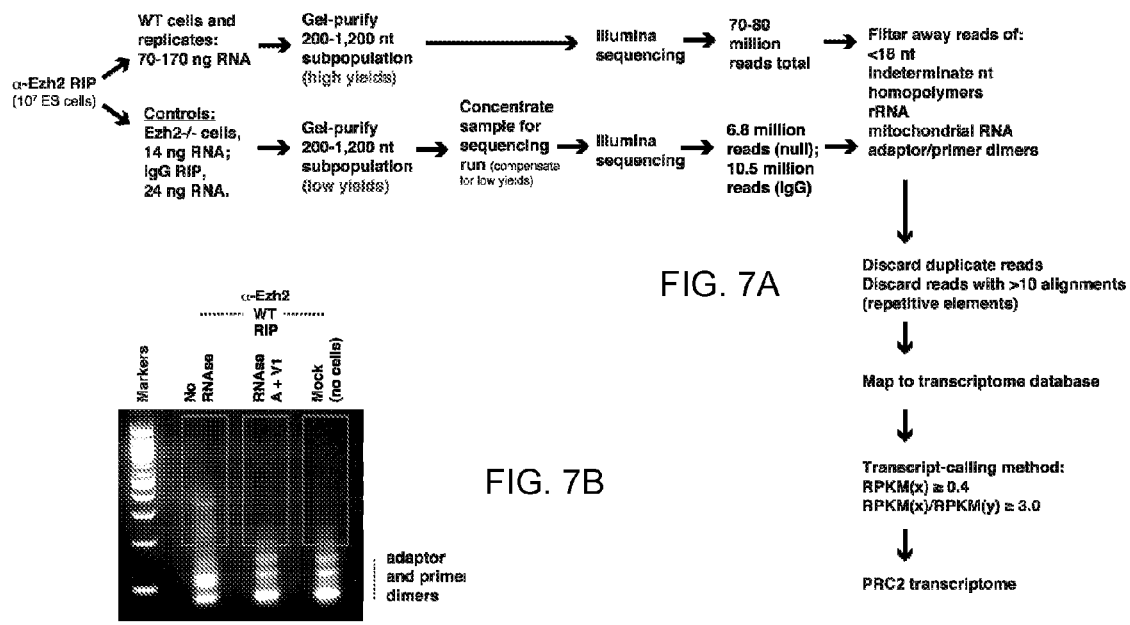
FIG. 7A
FIG. 7B
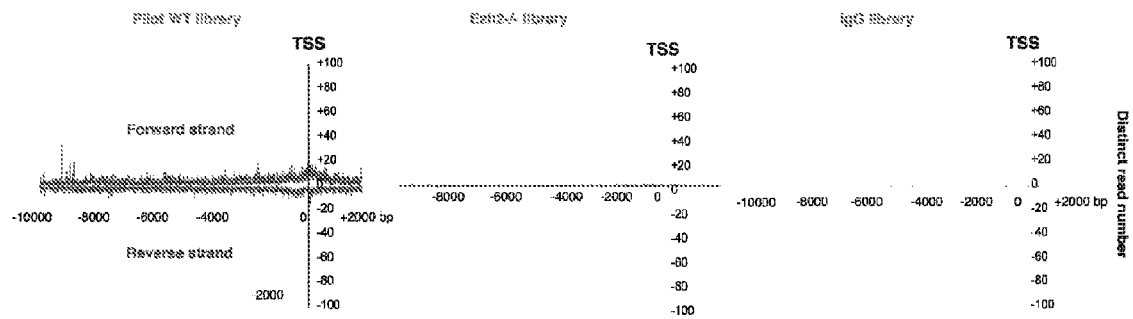
FIG. 7C

FIG. 15A

POLYCOMB-ASSOCIATED NON-CODING RNAS

RELATED APPLICATIONS

This application claims priority of U.S. provisional Nos. 61/412,862, filed on Nov. 12, 2010, 61/425,174 filed on Dec. 20, 2010, and 61/512,754 filed on Jul. 28, 2011, the entirety of each of which is incorporated by reference herein.

FEDERALLY SPONSORED RESEARCH OR DEVELOPMENT

This invention was made with Government support under Grant No. RO1-GM-090278 awarded by the National Institutes of Health. The Government has certain rights in the invention.

TECHNICAL FIELD

This invention relates to long non-coding RNAs (lncRNAs) that function to modulate gene expression, and methods of using them or inhibitory nucleic acids that bind them, to modulate gene expression.

BACKGROUND

Transcriptome analyses have suggested that, although only 1-2% of the mammalian genome is protein-coding, 70-90% is transcriptionally active (Carninci et al., 2005; Kapranov et al., 2007; Mercer et al., 2009). Ranging from 100 nt to >100 kb, these transcripts are largely unknown in function, may originate within or between genes, and may be conserved and developmentally regulated (Kapranov et al., 2007; Guttman et al., 2009). Recent discoveries argue that a subset of these transcripts play crucial roles in epigenetic regulation. For example, genes in the human HOX-D locus are regulated in trans by HOTAIR RNA, produced by the unlinked HOX-C locus (Rinn et al., 2007), and during X-chromosome inactivation, Tsix, RepA, and Xist RNAs target a chromatin modifier in cis to control chromosome-wide silencing (Zhao et al., 2008). Interestingly, all four RNAs bind and regulate Polycomb Repressive Complex 2 (PRC2), the complex that catalyzes trimethylation of histone H3-lysine27 (H3-K27me3) (Schwartz and Pirrotta, 2008). These observations support the idea that long ncRNAs are ideal for targeting chromatin modifiers to specific alleles or unique locations in the genome (Lee, 2009) (Lee, 2010).

RNA-mediated recruitment is especially attractive for Polycomb proteins. First identified in *Drosophila* as homeotic regulators, Polycomb proteins are conserved from flies to mammals and control many aspects of development (Ringrose and Paro, 2004; Boyer et al., 2006; Lee et al., 2006; Schuettengruber et al., 2007; Pietersen and van Lohuizen, 2008; Schwartz and Pirrotta, 2008). Mammalian PRC2 contains four core subunits, Eed, Suz12, RbAp48, and the catalytic Ezh2 In humans, aberrant PRC2 expression is linked to cancer and disease (Sparmann and van Lohuizen, 2006; Bernardi and Pandolfi, 2007; Miremadi et al., 2007; Rajasekhar and Begemann, 2007; Simon and Lange, 2008). Despite growing recognition of Polycomb's role in health, little is known about their regulation in vivo. In flies, Polycomb complexes may contain sequence-specific DNA-binding factors, such as Zeste, Pipsqueak (PSQ), or Pho, to help bind Polycomb-response elements (PRE) (Ringrose and Paro, 2004; Schwartz and Pirrotta, 2008). By contrast, mammalian Polycomb complexes are not thought to contain such subunits. Therefore, their mechanism of recruitment to thousands of genomic locations remains poorly understood, though PRE-like elements (Sing et al., 2009; Woo et al., 2010) and Jarid2 may facilitate binding (Li et al.; Pasini et al.; Peng et al., 2009; Shen et al., 2009). Interestingly, several PRC2 subunits have potential RNA-binding motifs (Denisenko et al., 1998; Bernstein and Allis, 2005; Bernstein et al., 2006b)—a possibility borne out by postulated functional interactions between Tsix/RepA/Xist RNA and PRC2 for X-inactivation (Zhao et al., 2008) and by HOTAIR and PRC2 for HOX regulation (Rinn et al., 2007). Recent work also identified several short RNAs of 50-200 nt as candidate PRC2 regulators (Kanhere et al., 2010). Control of Polycomb repressive complex 1 (PRC1) may also involve RNA (Yap et al., 2010).

In spite of their ubiquity, the structure and function of many long ncRNAs remain largely uncharacterized. Recent studies suggest that some long ncRNAs may have a function as an epigenetic regulator/RNA cofactor in chromatin remodeling and tumor suppression. Although knockdown technologies employing siRNAs and shRNAs have become staples in functional analysis of microRNAs (miRNAs) and cytoplasmically localized messenger RNAs (mRNAs) (4-6), these methods have been reported in some instances to be less consistently effective for long ncRNAs localized to the nucleus (Jepsen et al., Oligonucleotides, 14, 130-146 (2004)).

SUMMARY

A method, referred to herein as "RNA immunoprecipitation (RIP)-seq," was used to identify a genome-wide pool of >9,000 polycomb repressive complex 2 (PRC2)-interacting RNAs in embryonic stem cells (referred to herein as the "PRC2 transcriptome"). The transcriptome includes antisense, intergenic, and promoter-associated transcripts, as well as many unannotated RNAs. A large number of transcripts occur within imprinted regions, oncogene and tumor suppressor loci, and stem-cell-related bivalent domains. Evidence for direct RNA-protein interactions, some via the Ezh2 subunit, is provided. Further evidence is provided that inhibitory oligonucleotides that specifically bind to these PRC2-interacting RNAs can successfully up-regulate gene expression in a variety of separate and independent examples, presumably by inhibiting PRC2-associated repression. Gtl2 RNA was identifed as a PRC2 cofactor that directs PRC2 to the reciprocally imprinted Dlk1 coding gene. Thus, Polycomb proteins interact with a genome-wide family of RNAs, some of which may be used as biomarkers and therapeutic targets for human disease.

In one aspect, the invention provides methods for preparing a plurality of validated cDNAs complementary to a pool of nuclear ribonucleic acids (nRNAs). The methods include providing a sample comprising nuclear ribonucleic acids, e.g., a sample comprising nuclear lysate, e.g., comprising nRNAs bound to nuclear proteins; contacting the sample with an agent, e.g., an antibody, that binds specifically to a nuclear protein that is known or suspected to bind to nuclear ribonucleic acids, under conditions sufficient to form complexes between the agent and the protein; isolating the complexes; synthesizing DNA complementary to the nRNAs to provide an initial population of cDNAs; PCR-amplifying, if necessary, using strand-specific primers; purifying the initial population of cDNAs to obtain a purified population of cDNAs that are at least about 20 nucleotides (nt) in length, e.g., at least 25, 50, 75, 100, 150, 200, or 250 nt in length; sequencing at least part or substantially all of the purified population of cDNAs; aligning reads to a reference genome and retaining only those that are aligned; selecting high-confidence cDNA sequences, e.g., based on two criteria—(1) that the candidate transcript has a minimum read density in reads per kilobase per million reads (RPKM) terms (e.g., above a desired threshold); and (2) that the candidate transcript is enriched in the wildtype library versus a suitable control library (such as an IgG pulldown library or a protein-null pulldown library); thereby preparing the plurality of cDNAs.

Some examples of nuclear proteins that are known or suspected to bind to nuclear ribonucleic acids include Ezh2 (Zhao et al., Science. 2008 Oct. 31; 322(5902):750-6; Khalil et al., Proc Natl Acad Sci USA. 2009 Jul. 14; 106(28):11667-72. Epub 2009 Jul. 1); G9a (Nagano et al., Science. 2008 Dec. 12; 322(5908):1717-20. Epub 2008 Nov. 6); and Cbx7 (Yap et al., Mol Cell. 2010 Jun. 11; 38(5):662-74.)

In some embodiments, the invention includes methods for preparing a plurality of validated cDNAs complementary to a pool of nuclear ribonucleic acids (nRNAs). The methods can include providing a sample comprising nuclear ribonucleic acids, e.g., a sample comprising nuclear lysate, e.g., comprising nRNAs bound to nuclear proteins; contacting the sample with an agent, e.g., an antibody, that binds specifically to a nuclear protein that is known or suspected to bind to nuclear ribonucleic acids, e.g., Ezh2, G9a, or Cbx7, under conditions sufficient to form complexes between the agent and the protein, e.g., such that the nRNAs remain bound to the proteins; isolating the complexes; synthesizing DNA complementary to the nRNAs to provide an initial population of cDNAs; optionally PCR-amplifying the cDNAs using strand-specific primers; purifying the initial population of cDNAs to obtain a purified population of cDNAs that are at least about 20 nucleotides (nt) in length, e.g., at least 25, 50, 100, 150 or 200 nt in length; sequencing at least part or substantially all of the purified population of cDNAs; comparing the high-confidence sequences to a reference genome, and selecting those sequences that have a high degree of identity to sequences in the reference genome, e.g., at least 95%, 98%, or 99% identity, or that have fewer than 10, 5, 2, or 1 mismatches; and selecting those cDNAs that have (i) reads per kilobase per million reads (RPKM) above a desired threshold, and (ii) are enriched as compared to a control library (e.g., a protein-null library or library made from an IgG pulldown done in parallel); thereby preparing the library of cDNAs.

In some embodiments, the method is used to prepare a library representing a transcriptome associated with the protein of interest.

In some embodiments, the agent is an antibody and isolating the complexes comprises immunoprecipitating the complexes. In some embodiments, the cDNAs are synthesized using strand-specific adaptors.

In some embodiments, the methods further include sequencing substantially all of the cDNAs.

In another aspect, the invention features libraries of cDNAs complementary to a pool of nuclear ribonucleic acids (nRNAs) prepared by the method of claims 1-4. In some embodiments, each of the cDNAs is linked to an individually addressable bead or area on a substrate (e.g., a microarray).

In another aspect the invention features an inhibitory nucleic acid that specifically binds to, or is complementary to, an RNA that binds to Polycomb repressive complex 2 (PRC2), for example, SEQ ID NOS: 1-193,049. Without being bound by a theory of invention, these inhibitory nucleic acids are able to interfere with the binding of and function of PRC2, by preventing recruitment of PRC2 to a specific chromosomal locus. For example, data herein shows that a single administration of inhibitory nucleic acids designed to specifically bind a lncRNA can stably displace not only the lncRNA, but also the PRC2 that binds to the lncRNA, from binding chromatin. After displacement, the full complement of PRC2 is not recovered for up to 24 hours. Data provided herein also indicate that putative lncRNA binding sites for PRC2 show no conserved primary sequence motif, making it possible to design specific inhibitory nucleic acids that will interfere with PRC2 interaction with a single lncRNA, without generally disrupting PRC2 interactions with other lncRNAs. Further, data provided herein support that lncRNA can recruit PRC2 in a cis fashion, repressing gene expression at or near the specific chromosomal locus from which the lncRNA was transcribed, thus making it possible to design inhibitory nucleic acids that inhibit the function of PRC2 and increase the expression of a specific target gene.

In some embodiments, the inhibitory nucleic acid is provided for use in a method of modulating expression of a "gene targeted by the PRC2-binding RNA" (e.g., an intersecting or nearby gene, as set forth in Tables 1-8 below), meaning a gene whose expression is regulated by the PRC2-binding RNA. The term "PRC2-binding RNA" or "RNA that binds PRC2" is used interchangeably with "PRC2-associated RNA" and "PRC2-interacting RNA", and refers to a lncRNA, RNA transcript or a region thereof (e.g., a Peak as described below) that binds the PRC2 complex, directly or indirectly. Such binding may be determined by immunoprecipitation techniques using antibodies to a component of the PRC2 complex, e.g. Ezh2. SEQ ID NOS: 1-193,049 represent murine RNA sequences containing portions that have been experimentally determined to bind PRC2 using the RIP-seq method described herein, or human RNA sequences corresponding to these murine RNA sequences.

Such methods of modulating gene expression may be carried out in vitro, ex vivo, or in vivo. Table 8 displays genes targeted by the PRC2-binding RNA; the SEQ ID NOS: of the PRC2-binding RNA are set forth in the same row as the gene name. In some embodiments, the inhibitory nucleic acid is provided for use in a method of treating disease, e.g. a disease category as set forth in Table 9. The treatment may involve modulating expression (either up or down) of a gene targeted by the PRC2-binding RNA, preferably upregulating gene expression. The inhibitory nucleic acid may be formulated as a sterile composition for parenteral administration. It is understood that any reference to uses of compounds throughout the description contemplates use of the compound in preparation of a pharmaceutical composition or medicament for use in the treatment of a disease. Thus, as one nonlimiting example, this aspect of the invention includes use of such inhibitory nucleic acids in the preparation of a medicament for use in the treatment of disease, wherein the treatment involves upregulating expression of a gene targeted by the PRC2-binding RNA.

Diseases, disorders or conditions that may be treated according to the invention include cardiovascular, metabolic, inflammatory, bone, neurological or neurodegenerative, pulmonary, hepatic, kidney, urogenital, bone, cancer, and/or protein deficiency disorders. Examples of categories of diseases are set forth in Table 9.

In a related aspect, the invention features a process of preparing an inhibitory nucleic acid that modulates gene expression, the process comprising the step of synthesizing an inhibitory nucleic acid of between 5 and 40 bases in length, optionally single stranded, that specifically binds, or is complementary to, an RNA sequence that has been identified as binding to PRC2, optionally an RNA of any of Tables 1-8 or SEQ ID NOS: 1-193,049. This aspect of the invention may further comprise the step of identifying the RNA sequence as binding to PRC2, optionally through the RIP-seq method described herein.

In a further aspect of the present invention a process of preparing an inhibitory nucleic acid that specifically binds to an RNA that binds to Polycomb repressive complex 2 (PRC2) is provided, the process comprising the step of designing and/or synthesizing an inhibitory nucleic acid of between 5 and 40 bases in length, optionally single stranded, that specifically binds to an RNA sequence that binds to PRC2, optionally an RNA of any of Tables 1-8 or SEQ ID NOS: 1-193,049.

In some embodiments prior to synthesizing the inhibitory nucleic acid the process further comprises identifying an RNA that binds to PRC2.

In some embodiments the RNA has been identified by a method involving identifying an RNA that binds to PRC2.

In some embodiments the inhibitory nucleic acid is at least 80% complementary to a contiguous sequence of between 5 and 40 bases in said RNA sequence that binds to PRC2. In some embodiments the sequence of the designed and/or synthesized inhibitory nucleic acid is based on a said RNA sequence that binds to PRC2, or a portion thereof, said portion having a length of from 5 to 40 contiguous base pairs.

In some embodiments the sequence of the designed and/or synthesized inhibitory nucleic acid is based on a nucleic acid sequence that is complementary to said RNA sequence that binds to PRC2, or is complementary to a portion thereof, said portion having a length of from 5 to 40 contiguous base pairs.

The designed and/or synthesized inhibitory nucleic acid may be at least 80% complementary to (optionally one of at least 90%, 95%, 96%, 97%, 98%, 99% or 100% complementary to) the portion of the RNA sequence to which it binds or targets, or is intended to bind or target. In some embodiments it may contain 1, 2 or 3 base mismatches compared to the portion of the target RNA sequence or its complement respectively. In some embodiments it may have up to 3 mismatches over 15 bases, or up to 2 mismatches over 10 bases.

The inhibitory nucleic acid or portion of RNA sequence that binds to PRC2 may have a length of one of at least 8 to 40, or 10 to 50, or 5 to 50, bases, e.g. 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 bases. Where the inhibitory nucleic acid is based on an RNA sequence that binds to PRC2, a nucleic acid sequence that is complementary to said RNA sequence that binds to PRC2 or a portion of such a sequence, it may be based on information about that sequence, e.g. sequence information available in written or electronic form, which may include sequence information contained in publicly available scientific publications or sequence databases.

Where the design and/or synthesis involves design and/or synthesis of a sequence that is complementary to a nucleic acid described by such sequence information the skilled person is readily able to determine the complementary sequence, e.g. through understanding of Watson-Crick base pairing rules which form part of the common general knowledge in the field.

In the methods described above the RNA that binds to PRC2 may be, or have been, identified, or obtained, by a method that involves identifying RNA that binds to PRC2.

Such methods may involve the following steps: providing a sample containing nuclear ribonucleic acids, contacting the sample with an agent that binds specifically to PRC2 or a subunit thereof, allowing complexes to form between the agent and protein in the sample, partitioning the complexes, synthesizing nucleic acid that is complementary to nucleic acid present in the complexes.

If necessary, the method may further comprise the steps of amplifying the synthesized nucleic acid, and/or purifying the nucleic acid (or amplified nucleic acid), and/or sequencing the nucleic acids so obtained, and/or filtering/analysing the nucleic acids so obtained to identify high-probability PRC2 (or subunit thereof)-interacting transcripts.

In one embodiment the method involves the Rip-Seq method described herein.

In accordance with the above, in some embodiments the RNA that binds to PRC2 may be one that is known to bind PRC2, e.g. information about the sequence of the RNA and/or its ability to bind PRC2 is available to the public in written or electronic form allowing the design and/or synthesis of the inhibitory nucleic acid to be based on that information. As such, an RNA that binds to PRC2 may be selected from known sequence information and used to inform the design and/or synthesis of the inhibitory nucleic acid.

In other embodiments the RNA that binds to PRC2 may be identified as one that binds PRC2 as part of the method of design and/or synthesis.

In preferred embodiments design and/or synthesis of an inhibitory nucleic acid involves manufacture of a nucleic acid from starting materials by techniques known to those of skill in the art, where the synthesis may be based on a sequence of an RNA (or portion thereof) that has been selected as known to bind to Polycomb repressive complex 2.

Methods of design and/or synthesis of an inhibitory nucleic acid may involve one or more of the steps of:

Identifying and/or selecting an RNA sequence that binds to PRC2;

Identifying and/or selecting a portion of an RNA sequence that binds to PRC2;

Designing a nucleic acid sequence having a desired degree of sequence identity or complementarity to an RNA sequence that binds to PRC2 or a portion thereof;

Synthesizing a nucleic acid to the designed sequence;

Mixing the synthesized nucleic acid with at least one pharmaceutically acceptable diluent, carrier or excipient to form a pharmaceutical composition or medicament.

Inhibitory nucleic acids so designed and/or synthesized may be useful in method of modulating gene expression as described herein.

As such, the process of preparing an inhibitory nucleic acid may be a process that is for use in the manufacture of a pharmaceutical composition or medicament for use in the treatment of disease, optionally wherein the treatment involves modulating expression of a gene targeted by the RNA binds to PRC2.

In yet another aspect, the invention provides isolated nucleic acid comprising a sequence referred to in Table 1, 2, 3, 6, and/or 7, or Table 8, or in Appendix I of U.S. Prov. Appln. No. 61/425,174 filed on Dec. 20, 2010, which is not attached hereto but is incorporated by reference herein in its entirety, or a fragment comprising at least 20 nt thereof, e.g., as shown in Appendix I. In some embodiments, the isolated nucleic acid is synthetic.

In a further aspect, the invention provides methods for decreasing expression of an oncogene in a cell. In some embodiments, the methods include contacting the cell with a long non-coding RNA, or PRC2-binding fragment thereof, as referred to in Table 6 or a nucleic acid sequence that is at least about 90%, 91%, 92%, 93%, 94%, 95%, 96%, 97%, 98%, 99%, or 100% homologous to a lncRNA sequence, or PRC2-binding fragment thereof, as referred to in Table 6. PRC2-binding fragments of murine or orthologous lncRNAs, including human lncRNA, which retain the lncRNA's ability to bind PRC2, are contemplated. In some embodiments, the oncogene is c-myc. In some embodiments, the long non-coding RNA is Pvt1.

In yet another aspect, the invention features methods for increasing expression of a tumor suppressor in a mammal, e.g. human, in need thereof. The methods include administering to said mammal an inhibitory nucleic acid that specifically binds, or is complementary, to a human PRC2-interacting lncRNA corresponding to a tumor suppressor locus of Table 7, or a human lncRNA corresponding to an imprinted gene of Table 1, and/or a human lncRNA corresponding to a growth-suppressing gene of Table 2, or a related naturally occurring lncRNA that is orthologous or at least 90%, (e.g., 91%, 92%, 93%, 94%, 95%, 96%, 97%, 98%, 99%, or 100%) identical over at least 15 (e.g., at least 20, 21, 25, 30, 100) nucleobases thereof, in an amount effective to increase expression of the tumor suppressor. Thus, it is understood that one method of determining human orthologous lncRNA that corresponds to murine lncRNA is to identify a corresponding human sequence at least 90% identical to at least 15 nucleobases of the murine sequence (or at least 20, 21, 25, 30, 40, 50, 60, 70, 80, 90 or 100).

In an additional aspect, the invention provides methods for inhibiting or suppressing tumor growth in a mammal, e.g. human, with cancer comprising administering to said mammal an inhibitory nucleic acid that specifically binds, or is complementary, to a human PRC2-interacting lncRNA corresponding to a tumor suppressor locus of Table 7, or a human lncRNA corresponding to an imprinted gene of Table 1, and/or a human lncRNA corresponding to a growth-suppressing gene of Table 2, or a related naturally occurring lncRNA that is orthologous or at least 90%, (e.g., 91%, 92%, 93%, 94%, 95%, 96%, 97%, 98%, 99%, or 100%) identical over at least 15 (e.g., at least 20, 21, 25, 30, 50, 70, 100) nucleobases thereof, in an amount effective to suppress or inhibit tumor growth.

In another aspect, the invention features methods for treating a mammal, e.g., a human, with cancer comprising administering to said mammal an inhibitory nucleic acid that specifically binds, or is complementary, to a human lncRNA corresponding to a tumor suppressor locus of Table 7, or a human lncRNA corresponding to an imprinted gene of Table 1, and/or a human lncRNA corresponding to a growth-suppressing gene of Table 2, or a related naturally occurring lncRNA that is orthologous or at least 90% (e.g., 91%, 92%, 93%, 94%, 95%, 96%, 97%, 98%, 99%, or 100%) identical over at least 15 (e.g., at least 20, 21, 25, 30, 50, 70, 100) nucleobases thereof, in a therapeutically effective amount.

In some or any embodiments, the inhibitory nucleic acid is an oligomeric base compound or oligonucleotide mimetic that hybridizes to at least a portion of the target nucleic acid and modulates its function. In some or any embodiments, the inhibitory nucleic acid is single stranded or double stranded. A variety of exemplary inhibitory nucleic acids are known and described in the art. In some examples, the inhibitory nucleic acid is an antisense oligonucleotide, locked nucleic acid (LNA) molecule, peptide nucleic acid (PNA) molecule, ribozyme, siRNA, antagomirs, external guide sequence (EGS) oligonucleotide, microRNA (miRNA), small, temporal RNA (stRNA), or single- or double-stranded RNA interference (RNAi) compounds. It is understood that the term "LNA molecule" refers to a molecule that comprises at least one LNA modification; thus LNA molecules may have one or more locked nucleotides (conformationally constrained) and one or more non-locked nucleotides. It is also understood that the term "LNA" includes a nucleotide that comprises any constrained sugar that retains the desired properties of high affinity binding to complementary RNA, nuclease resistance, lack of immune stimulation, and rapid kinetics. Exemplary constrained sugars include those listed below. Similarly, it is understood that the term "PNA molecule" refers to a molecule that comprises at least one PNA modification and that such molecules may include unmodified nucleotides or internucleoside linkages.

In some or any embodiments, the inhibitory nucleic acid comprises at least one nucleotide and/or nucleoside modification (e.g., modified bases or with modified sugar moieties), modified internucleoside linkages, and/or combinations thereof. Thus, inhibitory nucleic acids can comprise natural as well as modified nucleosides and linkages. Examples of such chimeric inhibitory nucleic acids, including hybrids or gapmers, are described below.

In some embodiments, the inhibitory nucleic acid comprises one or more modifications comprising: a modified sugar moiety, and/or a modified internucleoside linkage, and/or a modified nucleotide and/or combinations thereof. In some embodiments, the modified internucleoside linkage comprises at least one of: alkylphosphonate, phosphorothioate, phosphorodithioate, alkylphosphonothioate, phosphoramidate, carbamate, carbonate, phosphate triester, acetamidate, carboxymethyl ester, or combinations thereof. In some embodiments, the modified sugar moiety comprises a 2'-O-methoxyethyl modified sugar moiety, a 2'-methoxy modified sugar moiety, a 2'-O-alkyl modified sugar moiety, or a bicyclic sugar moiety. Other examples of modifications include locked nucleic acid (LNA), peptide nucleic acid (PNA), arabinonucleic acid (ANA), optionally with 2'-F modification, 2'-fluoro-D-Arabinonucleic acid (FANA), phosphorodiamidate morpholino oligomer (PMO), ethylene-bridged nucleic acid (ENA), optionally with 2'-O,4'-C-ethylene bridge, and bicyclic nucleic acid (BNA). Yet other examples are described below and/or are known in the art.

In some embodiments, the inhibitory nucleic acid is 5-40 bases in length (e.g., 12-30, 12-28, 12-25). The inhibitory nucleic acid may also be 10-50, or 5-50 bases length. For example, the inhibitory nucleic acid may be one of any of 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 bases in length. In some embodiments, the inhibitory nucleic acid is double stranded and comprises an overhang (optionally 2-6 bases in length) at one or both termini. In other embodiments, the inhibitory nucleic acid is double stranded and blunt-ended. In some embodiments, the inhibitory nucleic acid comprises or consists of a sequence of bases at least 80% or 90% complementary to, e.g., at least 5, 10, 15, 20, 25 or 30 bases of, or up to 30 or 40 bases of, the target RNA, or comprises a sequence of bases with up to 3 mismatches (e.g., up to 1, or up to 2 mismatches) over 10, 15, 20, 25 or 30 bases of the target RNA.

Thus, the inhibitory nucleic acid can comprise or consist of a sequence of bases at least 80% complementary to at least 10 contiguous bases of the target RNA, or at least 80% complementary to at least 15, or 15-30, or 15-40 contiguous bases of the target RNA, or at least 80% complementary to at least 20, or 20-30, or 20-40 contiguous bases of the target RNA, or at least 80% complementary to at least 25, or 25-30, or 25-40 contiguous bases of the target RNA, or at least 80% complementary to at least 30, or 30-40 contiguous bases of the target RNA, or at least 80% complementary to at least 40 contiguous bases of the target RNA. Moreover, the inhibitory nucleic acid can comprise or consist of a sequence of bases at least 90% complementary to at least 10 contiguous bases of the target RNA, or at least 90% complementary to at least 15, or 15-30, or 15-40 contiguous bases of the target RNA, or at least 90% complementary to at least 20, or 20-30, or 20-40 contiguous bases of the target RNA, or at least 90% complementary to at least 25, or 25-30, or 25-40 contiguous bases of the target RNA, or at least 90% complementary to at least 30, or 30-40 contiguous bases of the target RNA, or at least 90% complementary to at least 40 contiguous bases of the target RNA. Similarly, the inhibitory nucleic acid can comprise or consist of a sequence of bases fully complementary to at least 5, 10, or 15 contiguous bases of the target RNA.

Complementarity can also be referenced in terms of the number of mismatches in complementary base pairing, as noted above. Thus, the inhibitory nucleic acid can comprise or consist of a sequence of bases with up to 3 mismatches over 10 contiguous bases of the target RNA, or up to 3 mismatches over 15 contiguous bases of the target RNA, or up to 3 mismatches over 20 contiguous bases of the target RNA, or up to 3 mismatches over 25 contiguous bases of the target RNA, or up to 3 mismatches over 30 contiguous bases of the target RNA. Similarly, the inhibitory nucleic acid can comprise or consist of a sequence of bases with up to 2 mismatches over 10 contiguous bases of the target RNA, or up to 2 mismatches over 15 contiguous bases of the target RNA, or up to 2 mismatches over 20 contiguous bases of the target RNA, or up to 2 mismatches over 25 contiguous bases of the target RNA, or up to 2 mismatches over 30 contiguous bases of the target RNA. Similarly, the inhibitory nucleic acid can comprise or consist of a sequence of bases with one mismatch over 10, 15, 20, 25 or 30 contiguous bases of the target RNA.

As such, in some embodiments the inhibitory nucleic acid comprises or consists of a sequence of bases about 5 to 40, or 10 to 50, or 5 to 50 bases in length, comprising a base sequence at least 80% complementary to (optionally one of at least 90%, 95%, 96%, 97%, 98%, 99% or 100% complementary to) a contiguous sequence of at least 5 to 40 bases (optionally one of at least 10, 15, 20, 25 or 30 bases, or one of 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 bases) of the target lncRNA. Thus, in some embodiments the inhibitory nucleic acid may comprise or consist of a sequence of at least 5 to 40, or 5 to 50, or 10 to 50, bases (optionally one of at least 10, 15, 20, 25 or 30 bases, or one of 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 bases) having at least 80% identity to (optionally one of at least 90%, 95%, 96%, 97%, 98%, 99% or 100% identity to) a contiguous sequence of bases of the same length of an antisense nucleic acid that is completely complementary in sequence to the target lncRNA. In some embodiments the sequence of the inhibitory nucleic acid may contain 1, 2 or 3 mismatches in complementary base pairing compared to the target lncRNA sequence, over 10, 15, 20, 25 or 30 bases (optionally one of 10, 11, 12, 13, 14, 15, 16, 17, 18, 19, 20, 21, 22, 23, 24, 25, 26, 27, 28, 29 or 30 bases) of the target lncRNA.

In some or any embodiments, the inhibitory nucleic acid is 5 to 40, or 10 to 50 bases in length (e.g., 12-30, 12-28, 12-25, 5-25, or 10-25, bases in length), and comprises a sequence of bases with up to 3 mismatches in complementary base pairing over 15 bases, or up to 2 mismatches over 10 bases.

In some embodiments, the cell is a cancer cell, e.g., a tumor cell, in vitro or in vivo, e.g., in a subject. In other embodiments, the cell is a stem cell that is contacted with the inhibitory nucleic acid, PRC2-binding lncRNA, or fragment thereof, ex vivo, for example to enhance pluripotency, enhance differentiation, or induce the stem cell to differentiate to a particular cell type, e.g. nerve, neuron, dopaminergic neuron, muscle, skin, heart, kidney, liver, lung, neuroendocrine, retinal, retinal pigment epithelium, pancreatic alpha or beta cells, hematopoietic, chondrocyte, bone cells and/or blood cells (e.g., T-cells, B-cells, macrophages, erythrocytes, platelets, and the like).

In some embodiments, the gene is Nkx2-1 (also known as Titf1). In some embodiments, the long non-coding (antisense) RNA to Nkx2-1 is on mouse Chromosome 12, approximately by 57,636,100 to 57,638,650, likely overlapping the Nkx2-1 promoter, including AK14300; or NR_003367.1. In humans, a similar antisense transcript occurs in the human NKX2-1 locus (likely overlapping, if not coincident, with Human gene BX161496; Chr14: bp 36,988, 521-36,991,722, in human genome assembly version GRCh37/hg19). Nkx2-1 is BOTH a tumor suppressor and an oncogene. Early on, it is required to form the tumor; but later on, its expression is lost and that loss correlates with a bad prognosis. So the lncRNA targeting Nkx2-1 has at least two uses: it can be administered itself to block cancer formation; or later on, its expression can be reduced to drive up expression of NKX2-1. In humans, NKX2-1 is frequently amplified or mutated in lung adenocarcinomas and has been directly linked to lung oncogenesis. It is described as a proto-oncogene in driving initial cancer development, but at the same time, its loss of expression is eventually associated with bad prognosis. Therefore, in some embodiments, the promoter-associated antisense transcript is administered to a subject, e.g., a subject with cancer, e.g., lung adenocarcinoma, and/or introduced into tumor cells to thereby reduce expression of NKX2-1 in patients with amplified NKX2-1 expression. Alternatively, in subjects (e.g., subjects with cancer, e.g., lung adenocarcinoma) with poor prognosis who have lost NKX2-1 expression, an inhibitory RNA, such as an LNA molecule, could be introduced to antagonize the PRC2-interacting antisense transcript and restart expression of the NKX2-1 gene.

In an additional aspect, the invention provides methods for enhancing pluripotency of a stem cell. The methods include contacting the cell with a long non-coding RNA, or PRC2-binding fragment thereof, as referred to in Table 3 or a nucleic acid sequence that is at least about 90%, 91%, 92%, 93%, 94%, 95%, 96%, 97%, 98% or 99% homologous to a lncRNA sequence, or PRC2-binding fragment thereof, as referred to in Table 3. PRC2-binding fragments of murine or orthologous lncRNAs, including human lncRNA, are contemplated in the aforementioned method.

In a further aspect, the invention features methods for enhancing differentiation of a stem cell, the method comprising contacting the cell with an inhibitory nucleic acid that specifically binds, or is complementary, to a long non-coding RNA as referred to in Table 3 and 4.

In some embodiments, the stem cell is an embryonic stem cell. In some embodiments, the stem cell is an iPS cell or an adult stem cell.

In an additional aspect, the invention provides sterile compositions including an inhibitory nucleic acid that specifically binds to or is at least 90% complementary to (e.g., at least 5, 10, 15, 20, 25 or 30 bases of, or up to 30 or 40 bases of) a lncRNA of Table 1, 2, 6, or 7, or Table 8, or a related naturally occurring lncRNA at least 90%, 91%, 92%, 93%, 94%, 95%, 96%, 97%, 98%, 99%, or 100% identical to at least 15 (e.g., at least 20, 21, 25, 30, 100) nucleobases of an lncRNA of Table 1, 2, 6, or 7, or Table 8, for parenteral administration. In some embodiments, the inhibitory nucleic acid is selected from the group consisting of antisense oligonucleotides, ribozymes, external guide sequence (EGS) oligonucleotides, siRNA compounds, micro RNAs (miRNAs); small, temporal RNAs (stRNA), and single- or double-stranded RNA interference (RNAi) compounds. In some embodiments, the RNAi compound is selected from the group consisting of short interfering RNA (siRNA); or a short, hairpin RNA (shRNA); small RNA-induced gene activation (RNAa); and small activating RNAs (saRNAs).

In some embodiments, the antisense oligonucleotide is selected from the group consisting of antisense RNAs, antisense DNAs, chimeric antisense oligonucleotides, and antisense oligonucleotides.

In some embodiments, the inhibitory nucleic acid comprises one or more modifications comprising: a modified sugar moiety, a modified internucleoside linkage, a modified nucleotide and/or combinations thereof. In some embodiments, the modified internucleoside linkage comprises at least one of: alkylphosphonate, phosphorothioate, phosphorodithioate, alkylphosphonothioate, phosphoramidate, carbamate, carbonate, phosphate triester, acetamidate, carboxymethyl ester, or combinations thereof. In some embodiments, the modified sugar moiety comprises a 2'-O-methoxyethyl modified sugar moiety, a 2'-methoxy modified sugar moiety, a 2'-O-alkyl modified sugar moiety, or a bicyclic sugar moiety. Other examples of modifications include locked nucleic acid (LNA), peptide nucleic acid (PNA), arabinonucleic acid (ANA), optionally with 2'-F modification, 2'-fluoro-D-Arabinonucleic acid (FANA), phosphorodiamidate morpholino oligomer (PMO), ethylene-bridged nucleic acid (ENA), optionally with 2'-O,4'-C-ethylene bridge, and bicyclic nucleic acid (BNA). Yet other examples are described below and/or are known in the art.

PRC2-binding fragments of any of the RNA set forth in the sequence listing as summarized below are contemplated. In some aspects, the fragments may recruit PRC2 and enhance PRC2 activity, thereby repressing gene expression, while in other instances the fragments may interfere with PRC2 activity by masking the lncRNA-binding sites on PRC2. In particular, the invention features uses of fragments of the RNA below to modulate expression of any of the genes set forth in Tables 1-8, for use in treating a disease, disorder, condition or association described in any of the categories set forth in Table 9 (whether in the "opposite strand" column or the "same strand" column).

Moreover, inhibitory nucleic acids that specifically bind to any of the RNA set forth in the sequence listing as summarized below, SEQ ID NOS: 1-193,049, are also contemplated. In particular, the invention features uses of these inhibitory nucleic acids to upregulate expression of any of the genes set forth in the Tables 1-8, for use in treating a disease, disorder, condition or association described in any of the categories set forth in Table 9 (whether in the "opposite strand" column or the "same strand" column of Table 8); upregulations of a set of genes grouped together in any one of the categories is contemplated. Evidence is provided herein that such inhibitory nucleic acids increased expression of mRNA corresponding to the gene by at least about 50% (i.e. 150% of normal or 1.5-fold), or by about 2-fold to about 5-fold. In some embodiments it is contemplated that expression may be increased by at least about 15-fold, 20-fold, 30-fold, 40-fold, 50-fold or 100-fold, or any range between any of the foregoing numbers. In other experiments, increased mRNA expression has been shown to correlate to increased protein expression.

A summary of the sequences in the sequence listing is set forth below.

TABLE

| Organism | Start SEQ ID NO: | End SEQ ID NO: |
|---|---|---|
| 1 Mus musculus | 1 | 49 |
| 2 Mus musculus | 50 | 9836 |
| 3 Mus musculus | 9837 | 10960 |
| 4 Mus musculus | 10961 | 11620 |
| 5 Mus musculus | 11621 | 12052 |
| 6 Mus musculus | 12053 | 12267 |
| 7 Mus musculus | 12268 | 12603 |
| 1 Homo sapiens | 12604 | 12632 |
| 2 Homo sapiens | 12633 | 19236 |
| 3 Homo sapiens | 19237 | 20324 |
| 4 Homo sapiens | 20325 | 20956 |
| 5 Homo sapiens | 20957 | 21194 |
| 6 Homo sapiens | 21195 | 21337 |
| 7 Homo sapiens | 21338 | 21582 |
| 8 Mus musculus Peaks | 21583 | 124436 |
| 8 Homo sapiens Peaks | 124437 | 190716 |
| 8 Mus musculus Peaks | 190717 | 190933 |
| 8 Homo sapiens Peaks | 190934 | 191086 |
| 8 H. sapiens Peak Ex. 7 | 191087 | |
| 8 M. musculus Peak Ex. 7 | 191088 | |
| 2 Homo sapiens | 191089 | 192873 |
| 1 Homo sapiens | 192874 | 192885 |
| 3 Homo sapiens | 192886 | 192906 |
| 4 Homo sapiens | 192907 | 192916 |
| 5 Homo sapiens | 192917 | 192979 |
| 6 Homo sapiens | 192980 | 193006 |
| 7 Homo sapiens | 193007 | 193049 |

The SEQ ID number refers to the RNA that associates (binds) with PRC2 (i.e., the RNA against which inhibitory nucleic acids would be directed). Each of (a) the reference genes described in the tables, (b) the Prc2-binding transcripts or Peaks (i.e., smaller regions of RNA that bind to PRC2) that target (modulate expression of) these genes, and (c) the inhibitory nucleic acids that specifically bind to, or are complementary to, the PRC2-binding transcripts or Peaks, may conveniently be grouped into any one of these categories, represented by numbers in Table 9 as follows:

Diseases are marked by category numbers 11, 14, 15, 17, 21, 24, 26, 42, 44, 49, 58, 69, 82, 103, 119, 120, 126, 143, 163, 167, 172, 177, 182, 183, 184, 187, 191, 196, 200, 203, 204, 212, any one of 300-323, or any one of 400-643.

Other functional groups are marked by category numbers 10, 12, 13, 16, 18, 19, 20, 22, 23, 25, 27, 28, 29, 30, 31, 32, 33, 34, 35, 36, 37, 38, 39, 40, 41, 43, 45, 46, 47, 48, 50, 51, 52, 53, 54, 55, 56, 57, 59, 60, 61, 62, 63, 64, 65, 66, 67, 68, 70, 71, 72, 73, 74, 75, 76, 77, 78, 79, 80, 81, 83, 84, 85, 86, 87, 88, 89, 90, 91, 92, 93, 94, 95, 96, 97, 98, 99, 100, 101, 102, 104, 105, 106, 107, 108, 109, 110, 111, 112, 113, 114, 115, 116, 117, 118, 121, 122, 123, 124, 125, 127, 128, 129, 130, 131, 132, 133, 134, 135, 136, 137, 138, 139, 140, 141, 142, 144, 145, 146, 147, 148, 149, 150, 151, 152, 153, 154, 155, 156, 157, 158, 159, 160, 161, 162, 164, 165, 166, 168, 169, 170, 171, 173, 174, 175, 176, 178, 179, 180, 181, 185, 186, 188, 189, 190, 192, 193, 194, 195, 197, 198, 199, 201, 202, 205, 206, 207, 208, 209, 210, 211, 213, 214, 215, 216, 217, or 218.

| Category |
|---|
| No. Name |
| 10 actin cytoskeleton organization |
| 11 Acute myeloid leukemia |
| 12 Adherens junction |
| 13 Adipocytokine signaling pathway |
| 14 aging |
| 15 Alzheimer's disease |
| 16 Amino sugar and nucleotide sugar metabolism |

| Category | |
|---|---|
| No. | Name |

17 Amyotrophic lateral sclerosis (ALS)
18 angiogenesis
19 Apoptosis
20 Arginine and proline metabolism
21 Arrhythmogenic right ventricular cardiomyopathy (ARVC)
22 Axon guidance
23 B cell receptor signaling pathway
24 Basal cell carcinoma, also in category 644
25 Basal transcription factors
26 Bladder cancer, also in category 644
27 blood coagulation
28 blood vessel development
29 bone development
30 Calcium signaling pathway
31 Cardiac muscle contraction
32 cation channel activity
33 cell adhesion
34 cell cycle
35 Cell cycle
36 cell motion
37 cell surface receptor linked signal transduction
38 cellular response to stress
39 channel activity
40 Chemokine signaling pathway
41 cholesterol metabolic process
42 Chronic myeloid leukemia
43 Citrate cycle (TCA cycle)
44 Colorectal cancer
45 Complement and coagulation cascades
46 cytokine activity
47 cytoskeletal protein binding
48 cytosol
49 Dilated cardiomyopathy
50 DNA binding
51 DNA repair
52 DNA replication
53 DNA replication
54 Drug metabolism
55 embryonic morphogenesis
56 endocytosis
57 Endocytosis
58 Endometrial cancer
59 endoplasmic reticulum
60 ErbB signaling pathway
61 extracellular region
62 eye development
63 Fatty acid metabolism
64 Fructose and mannose metabolism
65 G-protein coupled receptor protein signaling pathway
66 gamete generation
67 Gap junction
68 gene silencing by miRNA
69 Glioma
70 glucose metabolic process
71 Glycolysis/Gluconeogenesis
72 Golgi apparatus
73 growth factor activity
74 GTPase regulator activity
75 heart development
76 Hedgehog signaling pathway
77 Hematopoietic cell lineage
78 hemopoiesis
79 hemopoietic or lymphoid organ development
80 histone modification
81 Huntington's disease
82 Hypertrophic cardiomyopathy (HCM)
83 immune response
84 immune system development
85 inflammatory response
86 Insulin signaling pathway
87 intracellular signaling cascade
88 ion channel activity
89 ion transport
90 Jak-STAT signaling pathway
91 learning or memory
92 leukocyte activation
93 Leukocyte transendothelial migration
94 limb development
95 locomotory behavior
96 Long-term potentiation
97 lung development
98 lysosome
99 Lysosome
100 MAPK signaling pathway
101 MAPKKK cascade
102 Melanogenesis
103 Melanoma
104 Mismatch repair
105 mitochondrion
106 mitochondrion organization
107 mTOR signaling pathway
108 muscle tissue development
109 ncRNA metabolic process
110 neuron development
111 Neurotrophin signaling pathway
112 Non-small cell lung cancer, also in category 644
113 Notch signaling pathway
114 nucleolus
115 Oocyte meiosis
116 oxidation reduction
117 Oxidative phosphorylation
118 p53 signaling pathway
119 Pancreatic cancer, also in category 644
120 Parkinson's disease
121 Pathways in cancer, also in category 644
122 phosphatase activity
123 phosphoprotein phosphatase activity
124 positive regulation of cellular biosynthetic process
125 PPAR signaling pathway
126 Prostate cancer, also in category 644
127 Proteasome
128 protein amino acid dephosphorylation
129 protein folding
130 protein kinase activity
131 protein serine/threonine kinase activity
132 Purine metabolism
133 Pyrimidine metabolism
134 Ras protein signal transduction
135 Regulation of actin cytoskeleton
136 Regulation of autophagy
137 regulation of cell death, also in category 644
138 regulation of cell proliferation, also in category 644
139 regulation of cell size
140 regulation of protein ubiquitination
141 regulation of Ras protein signal transduction
142 regulation of transcription
143 Renal cell carcinoma, also in category 644
144 response to hypoxia
145 response to steroid hormone stimulus
146 response to virus
147 ribosome
148 RNA degradation
149 RNA processing
150 RNA splicing, via transesterification reactions
151 secretion
152 skeletal system development
153 skeletal system morphogenesis
154 Small cell lung cancer, also in category 644
155 small GTPase regulator activity
156 spermatogenesis
157 Sphingolipid metabolism
158 spliceosome
159 Spliceosome
160 stem cell differentiation
161 Steroid biosynthesis
162 synapse
163 Systemic lupus erythematosus
164 T cell activation
165 T cell receptor signaling pathway
166 TGF-beta signaling pathway -continued

| Category |
|---|
| No. Name |

167 Thyroid cancer, also in category 644
168 Toll-like receptor signaling pathway
169 transcription activator activity
170 transcription factor activity
171 translation
172 Type II diabetes mellitus
173 Ubiquitin mediated proteolysis
174 Vascular smooth muscle contraction
175 vasculature development
176 VEGF signaling pathway
177 Viral myocarditis
178 Wnt signaling pathway
179 amino-acid biosynthesis
180 ank repeat
181 bromodomain
182 Cardiomyopathy
183 cataract
184 charcot-marie-tooth disease
185 cytokine
186 cytokine receptor
187 deafness
188 disease mutation
189 egf-like domain
190 endosome
191 epilepsy
192 glycoprotein
193 growth factor
194 Growth factor binding
195 growth factor receptor
196 Ichthyosis
197 Immunoglobulin domain
198 ionic channel
199 leucine-rich repeat
200 leukodystrophy
201 methylation
202 methyltransferase
203 neurodegeneration
204 neuropathy
205 nucleus
206 obesity
207 protein phosphatase
208 protein phosphatase inhibitor
209 Oncogene (including proto-oncogenes), also in category 644
210 Secreted
211 serine/threonine-specific protein kinase
212 systemic lupus erythematosus
213 transmembrane
214 transmembrane protein
215 tumor suppressor, also in category 644
216 tyrosine-protein kinase
217 ubl conjugation pathway
218 wd repeat
300 Downregulated in Bladder cancer, also in category 644
301 Downregulated in Leukemia, also in category 644
302 Downregulated in Brain cancer, also in category 644
303 Downregulated in Breast cancer, also in category 644
304 Downregulated in Cervical cancer, also in category 644
305 Downregulated in Colon cancer, also in category 644
306 Downregulated in Esophageal cancer, also in category 644
307 Downregulated in Gastric cancer, also in category 644
308 Downregulated in Head and Neck cancer, also in category 644
309 Downregulated in Renal cancer, also in category 644
310 Downregulated in Liver cancer, also in category 644
311 Downregulated in Lung cancer, also in category 644
312 Downregulated in Lymphoma, also in category 644
313 Downregulated in Melanoma, also in category 644
314 Downregulated in Multiple Myeloma, also in category 644
315 Downregulated in Ovarian cancer, also in category 644
316 Downregulated in Pancreatic cancer, also in category 644
317 Downregulated in Prostate cancer, also in category 644
318 Downregulated in Sarcoma, also in category 644
319 Downregulated in Non-melanoma skin cancer, also in category 644
320 Downregulated in Uterine cancer, also in category 644
321 Downregulated in Mesothelioma, also in category 644
322 Downregulated in Adrenal cancer, also in category 644

-continued

| Category |
|---|
| No. Name |

323 Downregulated in Parathyroid cancer, also in category 644
400 Upregulated in Clear cell sarcoma of kidney, also in category 644
401 Upregulated in Acute lung injury
402 Upregulated in Acute megakaryoblastic leukemia, also in category 644
403 Upregulated in Acute myelocytic leukemia, also in category 644
404 Upregulated in Acute pancreatitis unspecified
405 Upregulated in Adenocarcinoma of esophagus, also in category 644
406 Upregulated in Adenocarcinoma of lung, also in category 644
407 Upregulated in Adenoma of small intestine, also in category 644
408 Upregulated in Adenovirus infection
409 Upregulated in AIDS with encephalitis
410 Upregulated in Alcohol poisoning
411 Upregulated in Alexander disease
412 Upregulated in alpha-l-Antitrypsin deficiency
413 Upregulated in Alzheimer's disease
414 Upregulated in Anaplastic oligoastrocytoma, also in category 644
415 Upregulated in Androgen insensitivity syndrome
416 Upregulated in Astrocytoma, also in category 644
417 Upregulated in Atrophy - muscular
418 Upregulated in Autoimmune hepatitis
419 Upregulated in Bacterial infection
420 Upregulated in Barrett's esophagus
421 Upregulated in Carcinoma in situ of small intestin, also in category 644e
422 Upregulated in Cardiomyopathy
423 Upregulated in Chronic granulomatous disease
424 Upregulated in Chronic lymphocytic leukemia
425 Upregulated in Chronic obstructive airway disease
426 Upregulated in Chronic polyarticular juvenile rheumatoid arthritis
427 Upregulated in Cirrhosis of liver
428 Upregulated in Cocaine dependence
429 Upregulated in Complex dental caries
430 Upregulated in Crohn's disease
431 Upregulated in Decompensated cardiac failure
432 Upregulated in Dehydration
433 Upregulated in Dilated cardiomyopathy
434 Upregulated in Dilated cardiomyopathy secondary to viral myocarditis
435 Upregulated in Epithelial proliferation
436 Upregulated in Escherichia coli infection of the central nervous system
437 Upregulated in Essential thrombocythemia
438 Upregulated in Exhaustion due to excessive exertion
439 Upregulated in Familial hypophosphatemic bone disease
440 Upregulated in Fracture
441 Upregulated in Fracture of femur
442 Upregulated in Generalized ischemic myocardial dysfunction
443 Upregulated in Glioblastoma, also in category 644
444 Upregulated in Hamman-Rich syndrome
445 Upregulated in Helicobacter pylori gastrointestinal tract infection
446 Upregulated in Hepatitis C
447 Upregulated in HIV infection
448 Upregulated in Huntington's disease
449 Upregulated in Hypercholesterolemia
450 Upregulated in Hypertrophy
451 Upregulated in Idiopathic thrombocytopenic purpura
452 Upregulated in Infection by Yersinia enterocolitica
453 Upregulated in Infertility due to azoospermia
454 Upregulated in Injury of heart
455 Upregulated in ISM - In situ melanoma of skin
456 Upregulated in Leber's amaurosis
457 Upregulated in Liver carcinoma, also in category 644
458 Upregulated in Macular degeneration
459 Upregulated in Malignant lymphoma, also in category 644
460 Upregulated in Malignant neoplasm of cervix uteri, also in category 644
461 Upregulated in Malignant neoplasm of duodenum, also in category 644
462 Upregulated in Malignant neoplasm of prostate, also in category 644
463 Upregulated in Malignant neoplasm of stomach, also in category 644
464 Upregulated in Malignant neoplasm of testis, also in category 644
465 Upregulated in Malignant tumor of colon, also in category 644
466 Upregulated in Multiple benign melanocytic nevi
467 Upregulated in Nephropathy - diabetic

| Category | |
|---|---|
| No. | Name |

468 Upregulated in Non-insulin dependent diabetes mellitus
469 Upregulated in Nutritional deficiency
470 Upregulated in Obstructive sleep apnea
471 Upregulated in Oligodendroglioma, also in category 644
472 Upregulated in Papillary thyroid carcinoma, also in category 644
473 Upregulated in Parkinson disease
474 Upregulated in Porcine nephropathy
475 Upregulated in Pre-eclampsia
476 Upregulated in Primary cardiomyopathy
477 Upregulated in Primary open angle glaucoma
478 Upregulated in Primary pulmonary hypoplasia
479 Upregulated in Pseudomonas infection
480 Upregulated in Pulmonary emphysema
481 Upregulated in Pulmonary hypertension
482 Upregulated in Renal disorder associated with type II diabetes mellitus
483 Upregulated in Retinal damage
484 Upregulated in Retinitis pigmentosa
485 Upregulated in Rheumatoid arthritis
486 Upregulated in Squamous cell carcinoma, also in category 644
487 Upregulated in Squamous cell carcinoma of lung, also in category 644
488 Upregulated in Status epilepticus
489 Upregulated in Systemic infection
490 Upregulated in Thrombocytopenia
491 Upregulated in Thymic carcinoma, also in category 644
492 Upregulated in Transitional cell carcinoma, also in category 644
493 Upregulated in Transitional cell carcinoma in situ, also in category 644
494 Upregulated in Ulcerative colitis
495 Upregulated in Uterine fibroids
496 Upregulated in Ventilator-associated lung injury
497 Upregulated in Ventricular hypertrophy
498 Upregulated in Ventricular hypertrophy (& [left])
499 Upregulated in Vitamin A deficiency
500 Downregulated in Clear cell sarcoma of kidney, also in category 644
501 Downregulated in Acute lung injury
502 Downregulated in Acute megakaryoblastic leukemia, also in category 644
503 Downregulated in Acute myelocytic leukemia, also in category 644
504 Downregulated in Acute pancreatitis unspecified
505 Downregulated in Adenocarcinoma of esophagus, also in category 644
506 Downregulated in Adenocarcinoma of lung, also in category 644
507 Downregulated in Adenoma of small intestine, also in category 644
508 Downregulated in Adenovirus infection
509 Downregulated in AIDS with encephalitis
510 Downregulated in Alcohol poisoning
511 Downregulated in Alexander disease
512 Downregulated in alpha-1-Antitrypsin deficiency
513 Downregulated in Alzheimer's disease
514 Downregulated in Anaplastic oligoastrocytoma
515 Downregulated in Androgen insensitivity syndrome
516 Downregulated in Astrocytoma, also in category 644
517 Downregulated in Atrophy - muscular
518 Downregulated in Autoimmune hepatitis
519 Downregulated in Bacterial infection
520 Downregulated in Barrett's esophagus
521 Downregulated in Carcinoma in situ of small intestine, also in category 644
522 Downregulated in Cardiomyopathy
523 Downregulated in Chronic granulomatous disease
524 Downregulated in Chronic lymphocytic leukemia
525 Downregulated in Chronic obstructive airway disease
526 Downregulated in Chronic polyarticular juvenile rheumatoid arthritis
527 Downregulated in Cirrhosis of liver
528 Downregulated in Cocaine dependence
529 Downregulated in Complex dental caries
530 Downregulated in Crohn's disease
531 Downregulated in Decompensated cardiac failure
532 Downregulated in Dehydration
533 Downregulated in Dilated cardiomyopathy
534 Downregulated in Dilated cardiomyopathy secondary to viral myocarditis
535 Downregulated in Epithelial proliferation
536 Downregulated in Escherichia coli infection of the central nervous system
537 Downregulated in Essential thrombocythemia
538 Downregulated in Exhaustion due to excessive exertion
539 Downregulated in Familial hypophosphatemic bone disease
540 Downregulated in Fracture
541 Downregulated in Fracture of femur
542 Downregulated in Generalized ischemic myocardial dysfunction
543 Downregulated in Glioblastoma, also in category 644
544 Downregulated in Hamman-Rich syndrome
545 Downregulated in Helicobacter pylori gastrointestinal tract infection
546 Downregulated in Hepatitis C
547 Downregulated in HIV infection
548 Downregulated in Huntington's disease
549 Downregulated in Hypercholesterolemia
550 Downregulated in Hypertrophy
551 Downregulated in Idiopathic thrombocytopenic purpura
552 Downregulated in Infection by Yersinia enterocolitica
553 Downregulated in Infertility due to azoospermia
554 Downregulated in Injury of heart
555 Downregulated in ISM - In situ melanoma of skin, also in category 644
556 Downregulated in Leber's amaurosis
557 Downregulated in Liver carcinoma, also in category 644
558 Downregulated in Macular degeneration
559 Downregulated in Malignant lymphoma, also in category 644
560 Downregulated in Malignant neoplasm of cervix uteri, also in category 644
561 Downregulated in Malignant neoplasm of duodenum, also in category 644
562 Downregulated in Malignant neoplasm of prostate, also in category 644
563 Downregulated in Malignant neoplasm of stomach, also in category 644
564 Downregulated in Malignant neoplasm of testis, also in category 644
565 Downregulated in Malignant tumor of colon, also in category 644
566 Downregulated in Multiple benign melanocytic nevi
567 Downregulated in Nephropathy - diabetic
568 Downregulated in Non-insulin dependent diabetes mellitus
569 Downregulated in Nutritional deficiency
570 Downregulated in Obstructive sleep apnea
571 Downregulated in Oligodendroglioma
572 Downregulated in Papillary thyroid carcinoma
573 Downregulated in Parkinson disease
574 Downregulated in Porcine nephropathy
575 Downregulated in Pre-eclampsia
576 Downregulated in Primary cardiomyopathy
577 Downregulated in Primary open angle glaucoma
578 Downregulated in Primary pulmonary hypoplasia
579 Downregulated in Pseudomonas infection
580 Downregulated in Pulmonary emphysema
581 Downregulated in Pulmonary hypertension
582 Downregulated in Renal disorder associated with type II diabetes mellitus
583 Downregulated in Retinal damage
584 Downregulated in Retinitis pigmentosa
585 Downregulated in Rheumatoid arthritis
586 Downregulated in Squamous cell carcinoma, also in category 644
587 Downregulated in Squamous cell carcinoma of lung, also in category 644
588 Downregulated in Status epilepticus
589 Downregulated in Systemic infection
590 Downregulated in Thrombocytopenia
591 Downregulated in Thymic carcinoma, also in category 644
592 Downregulated in Transitional cell carcinoma, also in category 644
593 Downregulated in Transitional cell carcinoma in situ, also in category 644
594 Downregulated in Ulcerative colitis
595 Downregulated in Uterine fibroids
596 Downregulated in Ventilator-associated lung injury
597 Downregulated in Ventricular hypertrophy
598 Downregulated in Ventricular hypertrophy (& [left])
599 Downregulated in Vitamin A deficiency
600 is associated with Bone diseases
601 is associated with Cancer diseases, also in category 644
602 is associated with Cardiovascular diseases
603 is associated with Connective tissue disorder diseases -continued

| Category | |
|---|---|
| No. | Name |
| 604 | is associated with Dermatological diseases |
| 605 | is associated with Developmental diseases |
| 606 | is associated with Ear, Nose, Throat diseases |
| 607 | is associated with Endocrine diseases |
| 608 | is associated with Gastrointestinal diseases |
| 609 | is associated with Hematological diseases |
| 610 | is associated with Immunological diseases |
| 611 | is associated with Metabolic diseases |
| 612 | is associated with multiple diseases |
| 613 | is associated with Muscular diseases |
| 614 | is associated with Neurological diseases |
| 615 | is associated with Nutritional diseases |
| 616 | is associated with Ophthamological diseases |
| 617 | is associated with Other diseases |
| 618 | is associated with Psychiatric diseases |
| 619 | is associated with Renal diseases |
| 620 | is associated with Respiratory diseases |
| 621 | is associated with Skeletal diseases |
| 622 | is decreased in Bone diseases |
| 623 | is decreased in Cancer diseases, also in category 644 |
| 624 | is decreased in Cardiovascular diseases |
| 625 | is decreased in Connective tissue disorder diseases |
| 626 | is decreased in Dermatological diseases |
| 627 | is decreased in Developmental diseases |
| 628 | is decreased in Ear, Nose, Throat diseases |
| 629 | is decreased in Endocrine diseases |
| 630 | is decreased in Gastrointestinal diseases |
| 631 | is decreased in Hematological diseases |
| 632 | is decreased in Immunological diseases |
| 633 | is decreased in Metabolic diseases |
| 634 | is decreased in multiple diseases |
| 635 | is decreased in Muscular diseases |
| 636 | is decreased in Neurological diseases |
| 637 | is decreased in Nutritional diseases |
| 638 | is decreased in Ophthamological diseases |
| 639 | is decreased in Other diseases |
| 640 | is decreased in Psychiatric diseases |
| 641 | is decreased in Renal diseases |
| 642 | is decreased in Respiratory diseases |
| 643 | is decreased in Skeletal diseases |
| 644 | is involved in cancer |

Category
No. Name
10 actin cytoskeleton organization
11 Acute myeloid leukemia
12 Adherens junction
13 Adipocytokine signaling pathway
14 aging
15 Alzheimer's disease
16 Amino sugar and nucleotide sugar metabolism
17 Amyotrophic lateral sclerosis (ALS)
18 angiogenesis
19 Apoptosis
20 Arginine and proline metabolism
21 Arrhythmogenic right ventricular cardiomyopathy (ARVC)
22 Axon guidance
23 B cell receptor signaling pathway
24 Basal cell carcinoma, also in category 644
25 Basal transcription factors
26 Bladder cancer, also in category 644
27 blood coagulation
28 blood vessel development
29 bone development
30 Calcium signaling pathway
31 Cardiac muscle contraction
32 cation channel activity
33 cell adhesion
34 cell cycle
35 Cell cycle
36 cell motion
37 cell surface receptor linked signal transduction
38 cellular response to stress
39 channel activity
40 Chemokine signaling pathway
41 cholesterol metabolic process
42 Chronic myeloid leukemia
43 Citrate cycle (TCA cycle)
44 Colorectal cancer
45 Complement and coagulation cascades
46 cytokine activity
47 cytoskeletal protein binding
48 cytosol
49 Dilated cardiomyopathy
50 DNA binding
51 DNA repair
52 DNA replication
53 DNA replication
54 Drug metabolism
55 embryonic morphogenesis
56 endocytosis
57 Endocytosis
58 Endometrial cancer
59 endoplasmic reticulum
60 ErbB signaling pathway
61 extracellular region
62 eye development
63 Fatty acid metabolism
64 Fructose and mannose metabolism
65 G-protein coupled receptor protein signaling pathway
66 gamete generation
67 Gap junction
68 gene silencing by miRNA
69 Glioma
70 glucose metabolic process
71 Glycolysis/Gluconeogenesis
72 Golgi apparatus
73 growth factor activity
74 GTPase regulator activity
75 heart development
76 Hedgehog signaling pathway
77 Hematopoietic cell lineage
78 hemopoiesis
79 hemopoietic or lymphoid organ development
80 histone modification
81 Huntington's disease
82 Hypertrophic cardiomyopathy (HCM)
83 immune response
84 immune system development
85 inflammatory response
86 Insulin signaling pathway
87 intracellular signaling cascade
88 ion channel activity
89 ion transport
90 Jak-STAT signaling pathway
91 learning or memory
92 leukocyte activation
93 Leukocyte transendothelial migration
94 limb development
95 locomotory behavior
96 Long-term potentiation
97 lung development
98 lysosome
99 Lysosome
100 MAPK signaling pathway 101 MAPKKK cascade
102 Melanogenesis
103 Melanoma
104 Mismatch repair
105 mitochondrion
106 mitochondrion organization
107 mTOR signaling pathway
108 muscle tissue development
109 ncRNA metabolic process
110 neuron development
111 Neurotrophin signaling pathway
112 Non-small cell lung cancer, also in category 644
113 Notch signaling pathway
114 nucleolus
115 Oocyte meiosis
116 oxidation reduction
117 Oxidative phosphorylation
118 p53 signaling pathway
119 Pancreatic cancer, also in category 644
120 Parkinson's disease
121 Pathways in cancer, also in category 644
122 phosphatase activity
123 phosphoprotein phosphatase activity
124 positive regulation of cellular biosynthetic process
125 PPAR signaling pathway
126 Prostate cancer, also in category 644
127 Proteasome
128 protein amino acid dephosphorylation
129 protein folding
130 protein kinase activity
131 protein serine/threonine kinase activity
132 Purine metabolism
133 Pyrimidine metabolism
134 Ras protein signal transduction
135 Regulation of actin cytoskeleton
136 Regulation of autophagy
137 regulation of cell death, also in category 644
138 regulation of cell proliferation, also in category 644
139 regulation of cell size
140 regulation of protein ubiquitination
141 regulation of Ras protein signal transduction
142 regulation of transcription
143 Renal cell carcinoma, also in category 644
144 response to hypoxia
145 response to steroid hormone stimulus
146 response to virus
147 ribosome
148 RNA degradation
149 RNA processing
150 RNA splicing, via transesterification reactions
151 secretion
152 skeletal system development
153 skeletal system morphogenesis
154 Small cell lung cancer, also in category 644
155 small GTPase regulator activity
156 spermatogenesis
157 Sphingolipid metabolism
158 spliceosome
159 Spliceosome
160 stem cell differentiation
161 Steroid biosynthesis
162 synapse
163 Systemic lupus erythematosus
164 T cell activation
165 T cell receptor signaling pathway
166 TGF-beta signaling pathway
167 Thyroid cancer, also in category 644
168 Toll-like receptor signaling pathway
169 transcription activator activity
170 transcription factor activity
171 translation
172 Type II diabetes mellitus
173 Ubiquitin mediated proteolysis
174 Vascular smooth muscle contraction
175 vasculature development
176 VEGF signaling pathway
177 Viral myocarditis
178 Wnt signaling pathway
179 amino-acid biosynthesis
180 ank repeat
181 bromodomain
182 Cardiomyopathy
183 cataract
184 charcot-marie-tooth disease
185 cytokine
186 cytokine receptor
187 deafness
188 disease mutation
189 egf-like domain
190 endosome
191 epilepsy
192 glycoprotein
193 growth factor
194 Growth factor binding
195 growth factor receptor
196 Ichthyosis
197 Immunoglobulin domain
198 ionic channel
199 leucine-rich repeat
200 leukodystrophy
201 methylation
202 methyltransferase
203 neurodegeneration
204 neuropathy
205 nucleus
206 obesity
207 protein phosphatase
208 protein phosphatase inhibitor
209 Oncogene (including proto-oncogenes), also in category 644
210 Secreted
211 serine/threonine-specific protein kinase
212 systemic lupus erythematosus
213 transmembrane
214 transmembrane protein
215 tumor suppressor, also in category 644
216 tyrosine-protein kinase
217 ubl conjugation pathway
218 wd repeat
300 Downregulated in Bladder cancer, also in category 644
301 Downregulated in Leukemia, also in category 644
302 Downregulated in Brain cancer, also in category 644
303 Downregulated in Breast cancer, also in category 644
304 Downregulated in Cervical cancer, also in category 644
305 Downregulated in Colon cancer, also in category 644
306 Downregulated in Esophageal cancer, also in category 644
307 Downregulated in Gastric cancer, also in category 644
308 Downregulated in Head and Neck cancer, also in category 644
309 Downregulated in Renal cancer, also in category 644
310 Downregulated in Liver cancer, also in category 644
311 Downregulated in Lung cancer, also in category 644

312 Downregulated in Lymphoma, also in category 644
313 Downregulated in Melanoma, also in category 644
314 Downregulated in Multiple Myeloma, also in category 644
315 Downregulated in Ovarian cancer, also in category 644
316 Downregulated in Pancreatic cancer, also in category 644
317 Downregulated in Prostate cancer, also in category 644
318 Downregulated in Sarcoma, also in category 644
319 Downregulated in Non-melanoma skin cancer, also in category 644
320 Downregulated in Uterine cancer, also in category 644
321 Downregulated in Mesothelioma, also in category 644
322 Downregulated in Adrenal cancer, also in category 644
323 Downregulated in Parathyroid cancer, also in category 644
400 Upregulated in Clear cell sarcoma of kidney, also in category 644
401 Upregulated in Acute lung injury
402 Upregulated in Acute megakaryoblastic leukemia, also in category 644
403 Upregulated in Acute myelocytic leukemia, also in category 644
404 Upregulated in Acute pancreatitis unspecified
405 Upregulated in Adenocarcinoma of esophagus, also in category 644
406 Upregulated in Adenocarcinoma of lung, also in category 644
407 Upregulated in Adenoma of small intestine, also in category 644
408 Upregulated in Adenovirus infection
409 Upregulated in AIDS with encephalitis
410 Upregulated in Alcohol poisoning
411 Upregulated in Alexander disease
412 Upregulated in alpha-1-Antitrypsin deficiency
413 Upregulated in Alzheimer's disease
414 Upregulated in Anaplastic oligoastrocytoma, also in category 644
415 Upregulated in Androgen insensitivity syndrome
416 Upregulated in Astrocytoma, also in category 644
417 Upregulated in Atrophy—muscular
418 Upregulated in Autoimmune hepatitis
419 Upregulated in Bacterial infection
420 Upregulated in Barrett's esophagus
421 Upregulated in Carcinoma in situ of small intestin, also in category 644e
422 Upregulated in Cardiomyopathy
423 Upregulated in Chronic granulomatous disease
424 Upregulated in Chronic lymphocytic leukemia
425 Upregulated in Chronic obstructive airway disease
426 Upregulated in Chronic polyarticular juvenile rheumatoid arthritis
427 Upregulated in Cirrhosis of liver
428 Upregulated in Cocaine dependence
429 Upregulated in Complex dental caries
430 Upregulated in Crohn's disease
431 Upregulated in Decompensated cardiac failure
432 Upregulated in Dehydration
433 Upregulated in Dilated cardiomyopathy
434 Upregulated in Dilated cardiomyopathy secondary to viral myocarditis
435 Upregulated in Epithelial proliferation
436 Upregulated in *Escherichia coli* infection of the central nervous system
437 Upregulated in Essential thrombocythemia
438 Upregulated in Exhaustion due to excessive exertion
439 Upregulated in Familial hypophosphatemic bone disease
440 Upregulated in Fracture
441 Upregulated in Fracture of femur
442 Upregulated in Generalized ischemic myocardial dysfunction
443 Upregulated in Glioblastoma, also in category 644
444 Upregulated in Hamman-Rich syndrome
445 Upregulated in *Helicobacter pylori* gastrointestinal tract infection
446 Upregulated in Hepatitis C
447 Upregulated in HIV infection
448 Upregulated in Huntington's disease
449 Upregulated in Hypercholesterolemia
450 Upregulated in Hypertrophy
451 Upregulated in Idiopathic thrombocytopenic purpura
452 Upregulated in Infection by *Yersinia enterocolitica*
453 Upregulated in Infertility due to azoospermia
454 Upregulated in Injury of heart
455 Upregulated in ISM—In situ melanoma of skin
456 Upregulated in Leber's amaurosis
457 Upregulated in Liver carcinoma, also in category 644
458 Upregulated in Macular degeneration
459 Upregulated in Malignant lymphoma, also in category 644
460 Upregulated in Malignant neoplasm of cervix uteri, also in category 644
461 Upregulated in Malignant neoplasm of duodenum, also in category 644
462 Upregulated in Malignant neoplasm of prostate, also in category 644
463 Upregulated in Malignant neoplasm of stomach, also in category 644
464 Upregulated in Malignant neoplasm of testis, also in category 644
465 Upregulated in Malignant tumor of colon, also in category 644
466 Upregulated in Multiple benign melanocytic nevi
467 Upregulated in Nephropathy—diabetic
468 Upregulated in Non-insulin dependent diabetes mellitus
469 Upregulated in Nutritional deficiency
470 Upregulated in Obstructive sleep apnea
471 Upregulated in Oligodendroglioma, also in category 644
472 Upregulated in Papillary thyroid carcinoma, also in category 644
473 Upregulated in Parkinson disease
474 Upregulated in Porcine nephropathy
475 Upregulated in Pre-eclampsia
476 Upregulated in Primary cardiomyopathy
477 Upregulated in Primary open angle glaucoma
478 Upregulated in Primary pulmonary hypoplasia
479 Upregulated in *Pseudomonas* infection
480 Upregulated in Pulmonary emphysema
481 Upregulated in Pulmonary hypertension
482 Upregulated in Renal disorder associated with type II diabetes mellitus
483 Upregulated in Retinal damage
484 Upregulated in Retinitis pigmentosa
485 Upregulated in Rheumatoid arthritis
486 Upregulated in Squamous cell carcinoma, also in category 644
487 Upregulated in Squamous cell carcinoma of lung, also in category 644
488 Upregulated in Status epilepticus
489 Upregulated in Systemic infection 490 Upregulated in Thrombocytopenia
491 Upregulated in Thymic carcinoma, also in category 644
492 Upregulated in Transitional cell carcinoma, also in category 644
493 Upregulated in Transitional cell carcinoma in situ, also in category 644
494 Upregulated in Ulcerative colitis
495 Upregulated in Uterine fibroids
496 Upregulated in Ventilator-associated lung injury
497 Upregulated in Ventricular hypertrophy
498 Upregulated in Ventricular hypertrophy (& [left])
499 Upregulated in Vitamin A deficiency
500 Downregulated in Clear cell sarcoma of kidney, also in category 644
501 Downregulated in Acute lung injury
502 Downregulated in Acute megakaryoblastic leukemia, also in category 644
503 Downregulated in Acute myelocytic leukemia, also in category 644
504 Downregulated in Acute pancreatitis unspecified
505 Downregulated in Adenocarcinoma of esophagus, also in category 644
506 Downregulated in Adenocarcinoma of lung, also in category 644
507 Downregulated in Adenoma of small intestine, also in category 644
508 Downregulated in Adenovirus infection
509 Downregulated in AIDS with encephalitis
510 Downregulated in Alcohol poisoning
511 Downregulated in Alexander disease
512 Downregulated in alpha-1-Antitrypsin deficiency
513 Downregulated in Alzheimer's disease
514 Downregulated in Anaplastic oligoastrocytoma
515 Downregulated in Androgen insensitivity syndrome
516 Downregulated in Astrocytoma, also in category 644
517 Downregulated in Atrophy—muscular
518 Downregulated in Autoimmune hepatitis
519 Downregulated in Bacterial infection
520 Downregulated in Barrett's esophagus
521 Downregulated in Carcinoma in situ of small intestine, also in category 644
522 Downregulated in Cardiomyopathy
523 Downregulated in Chronic granulomatous disease
524 Downregulated in Chronic lymphocytic leukemia
525 Downregulated in Chronic obstructive airway disease
526 Downregulated in Chronic polyarticular juvenile rheumatoid arthritis
527 Downregulated in Cirrhosis of liver
528 Downregulated in Cocaine dependence
529 Downregulated in Complex dental caries
530 Downregulated in Crohn's disease
531 Downregulated in Decompensated cardiac failure
532 Downregulated in Dehydration
533 Downregulated in Dilated cardiomyopathy
534 Downregulated in Dilated cardiomyopathy secondary to viral myocarditis
535 Downregulated in Epithelial proliferation
536 Downregulated in *Escherichia coli* infection of the central nervous system
537 Downregulated in Essential thrombocythemia
538 Downregulated in Exhaustion due to excessive exertion
539 Downregulated in Familial hypophosphatemic bone disease
540 Downregulated in Fracture
541 Downregulated in Fracture of femur
542 Downregulated in Generalized ischemic myocardial dysfunction
543 Downregulated in Glioblastoma, also in category 644
544 Downregulated in Hamman-Rich syndrome
545 Downregulated in *Helicobacter pylori* gastrointestinal tract infection
546 Downregulated in Hepatitis C
547 Downregulated in HIV infection
548 Downregulated in Huntington's disease
549 Downregulated in Hypercholesterolemia
550 Downregulated in Hypertrophy
551 Downregulated in Idiopathic thrombocytopenic purpura
552 Downregulated in Infection by *Yersinia* enterocolitica
553 Downregulated in Infertility due to azoospermia
554 Downregulated in Injury of heart
555 Downregulated in ISM—In situ melanoma of skin, also in category 644
556 Downregulated in Leber's amaurosis
557 Downregulated in Liver carcinoma, also in category 644
558 Downregulated in Macular degeneration
559 Downregulated in Malignant lymphoma, also in category 644
560 Downregulated in Malignant neoplasm of cervix uteri, also in category 644
561 Downregulated in Malignant neoplasm of duodenum, also in category 644
562 Downregulated in Malignant neoplasm of prostate, also in category 644
563 Downregulated in Malignant neoplasm of stomach, also in category 644
564 Downregulated in Malignant neoplasm of testis, also in category 644
565 Downregulated in Malignant tumor of colon, also in category 644
566 Downregulated in Multiple benign melanocytic nevi
567 Downregulated in Nephropathy—diabetic
568 Downregulated in Non-insulin dependent diabetes mellitus
569 Downregulated in Nutritional deficiency
570 Downregulated in Obstructive sleep apnea
571 Downregulated in Oligodendroglioma
572 Downregulated in Papillary thyroid carcinoma
573 Downregulated in Parkinson disease
574 Downregulated in Porcine nephropathy
575 Downregulated in Pre-eclampsia
576 Downregulated in Primary cardiomyopathy
577 Downregulated in Primary open angle glaucoma
578 Downregulated in Primary pulmonary hypoplasia
579 Downregulated in *Pseudomonas* infection
580 Downregulated in Pulmonary emphysema
581 Downregulated in Pulmonary hypertension
582 Downregulated in Renal disorder associated with type II diabetes mellitus
583 Downregulated in Retinal damage
584 Downregulated in Retinitis pigmentosa
585 Downregulated in Rheumatoid arthritis
586 Downregulated in Squamous cell carcinoma, also in category 644
587 Downregulated in Squamous cell carcinoma of lung, also in category 644
588 Downregulated in Status epilepticus
589 Downregulated in Systemic infection
590 Downregulated in Thrombocytopenia
591 Downregulated in Thymic carcinoma, also in category 644

592 Downregulated in Transitional cell carcinoma, also in category 644
593 Downregulated in Transitional cell carcinoma in situ, also in category 644
594 Downregulated in Ulcerative colitis
595 Downregulated in Uterine fibroids
596 Downregulated in Ventilator-associated lung injury
597 Downregulated in Ventricular hypertrophy
598 Downregulated in Ventricular hypertrophy (& [left])
599 Downregulated in Vitamin A deficiency
600 is associated with Bone diseases
601 is associated with Cancer diseases, also in category 644
602 is associated with Cardiovascular diseases
603 is associated with Connective tissue disorder diseases
604 is associated with Dermatological diseases
605 is associated with Developmental diseases
606 is associated with Ear, Nose, Throat diseases
607 is associated with Endocrine diseases
608 is associated with Gastrointestinal diseases
609 is associated with Hematological diseases
610 is associated with Immunological diseases
611 is associated with Metabolic diseases
612 is associated with multiple diseases
613 is associated with Muscular diseases
614 is associated with Neurological diseases
615 is associated with Nutritional diseases
616 is associated with Ophthamological diseases
617 is associated with Other diseases
618 is associated with Psychiatric diseases
619 is associated with Renal diseases
620 is associated with Respiratory diseases
621 is associated with Skeletal diseases
622 is decreased in Bone diseases
623 is decreased in Cancer diseases, also in category 644
624 is decreased in Cardiovascular diseases
625 is decreased in Connective tissue disorder diseases
626 is decreased in Dermatological diseases
627 is decreased in Developmental diseases
628 is decreased in Ear, Nose, Throat diseases
629 is decreased in Endocrine diseases
630 is decreased in Gastrointestinal diseases
631 is decreased in Hematological diseases
632 is decreased in Immunological diseases
633 is decreased in Metabolic diseases
634 is decreased in multiple diseases
635 is decreased in Muscular diseases
636 is decreased in Neurological diseases
637 is decreased in Nutritional diseases
638 is decreased in Ophthamological diseases
639 is decreased in Other diseases
640 is decreased in Psychiatric diseases
641 is decreased in Renal diseases
642 is decreased in Respiratory diseases
643 is decreased in Skeletal diseases
644 is involved in cancer Thus, in various aspects, the invention features inhibitory nucleic acids that specifically bind to any of the RNA sequences of any of Tables 1-8, for use in modulating expression of a group of reference genes that fall within any one or more of the categories set forth in the tables, and for treating the corresponding diseases, disorders or conditions in any one or more of the categories set forth in Table 9 (which sets forth the diseases associated with each reference gene).

In another aspect, the invention also features inhibitory nucleic acids that specifically bind, or are complementary, to any of the RNA sequences of SEQ ID NOS: 124437 to 190716, or 190934 to 191086, or 191087 (human Peaks), or SEQ ID NOS: 21583 to 124436, or 190717 to 190933, or 191088 (mouse Peaks), set forth in Table 8, whether in the "opposite strand" column or the "same strand" column. In some embodiments, the inhibitory nucleic acid is provided for use in a method of modulating expression of a gene targeted by the PRC2-binding RNA (e.g., an intersecting or nearby gene, as set forth in Tables 1-8 below). Such methods may be carried out in vitro, ex vivo, or in vivo. In some embodiments, the inhibitory nucleic acid is provided for use in methods of treating disease, e.g. as described in Table 9 below. The treatments may involve modulating expression (either up or down) of a gene targeted by the PRC2-binding RNA, preferably upregulating gene expression. In some embodiments, the inhibitory nucleic acid is formulated as a sterile composition for parenteral administration. The reference genes targeted by these RNA sequences are set forth in Table 8 and are grouped according to categories 1-643 in Table 9. Thus, in one aspect the invention describes a group of inhibitory nucleic acids that specifically bind, or are complementary to, a group of RNA sequences, either transcripts or Peaks, in any one of categories 1-643. In particular, the invention features uses of such inhibitory nucleic acids to upregulate expression of any of the reference genes set forth in Table 8, for use in treating a disease, disorder, condition or association described in any of the categories set forth in Table 9 (e.g., any one or more of category numbers 11, 14, 15, 17, 21, 24, 26, 42, 44, 49, 58, 69, 82, 103, 119, 120, 126, 143, 163, 167, 172, 177, 182, 183, 184, 187, 191, 196, 200, 203, 204, 212, 300-323, and/or 400-643).

By way of nonlimiting example, category 45 (Complement and coagulation cascades) includes reference genes selected from the group consisting of TFPI, F2, F2R, CD46, PROS1, SERPINE1, A2M, C1S, C3AR1, BDKRB1, C1R, SERPING1, BDKRB2, F5, C8G, THBD, and/or PLAU (gene IDs 7035, 2147, 2149, 4179, 5627, 5054, 2, 716, 719, 623, 715, 710, 624, 2153, 733, 7056, and 5328, respectively). In turn, each of TFPI, F2, F2R, CD46, PROS1, SERPINE1, A2M, C1S, C3AR1, BDKRB1, C1R, SERPING1, BDKRB2, F5, C8G, THBD, and/or PLAU are targeted by PRC2-binding RNA having the SEQ ID NOs displayed in the applicable row of Table 8. For example, TFPI SEQ ID NOs include 13245[F], 155228[F], 155229[F], 155230[F], 155231[F], 155232[F], 155233[F], 155234[F], 155235[F], 155236[F], 155237[F], 155238[F], 155239[F], 155240[F], 155241[F], 155242[F], 155243[F], 155244[F], 155245[F], 155246[F], 155247[F], 155248[F], 155249[F], 155250[F], 155251[F], 155252[F], 155255[F], 155256[F], 13245[66912], 155237[−806], 879 [F], 68709[F], 68710[F], 68711[F], 68712[F], 68713[F], 68714[F], 68715[F], 68716[F], 68717[F], 68718[F], 68719 [F], 68720[F], 68721[F], 68722[F], 68723[F], 68724[F], 68725[F], 68726[F], 68727[F], 68728[F], 68729[F], 68730 [F], 68731[F], 68732[F], 68733[F], 68734[F], 68735[F], 68736[F], 68737[F], 68738[F], 68739[F], 68740[F], 68741 [F], 68742[F], 68743[F], 68744[F], 68745[F], 68746[F], 68747[F], 68748[F], 68749[F], and/or 68713[−245] according to Table 8. The group of inhibitory nucleic acids selected from the group consisting of inhibitory nucleic acids that specifically bind to, or are complementary to, any one of these SEQ ID NOS: that are listed in Table 8 as targeting refGenes TFPI, F2, F2R, CD46, PROS1, SERPINE1, A2M, C1S, C3AR1, BDKRB1, C1R, SERPING1, BDKRB2, F5, C8G, THBD, and/or PLAU are contemplated for use in any of the compositions and methods described herein, including but not limited to use in treating a disease of category 45 (Complement and coagulation cascades), the treatment involving modulation of any of the refGenes TFPI, F2, F2R, CD46, PROS1, SERPINE1, A2M, C1S, C3AR1, BDKRB1, C1R, SERPING1, BDKRB2, F5, C8G, THBD, and/or PLAU. Similarly, inhibitory nucleic acids that specifically bind to, or are complementary to, genes in category 643 ("is decreased in Skeletal disease") are contemplated for use in any of the compositions and methods described herein, including but not limited to use in treating Skeletal disease. Inhibitory nucleic acids that specifically bind to, or are complementary to, genes in the categories that are also part of category 644 (involved in cancer) are contemplated for use in any of the compositions and methods described herein, including but not limited to use in treating cancer.

In various aspects, the invention further features inhibitory nucleic acids that bind to the RNA sequence between two or more Peaks that correspond to chromosomal coordinates that are near each other, e.g. within 100 bases, 200 bases, 300 bases, 400 bases, 500 bases, 1 kb, or 2 kb of each other, and that are preferably associated with (i) the same reference gene in Table 9 or (ii) the same UCSC transcript in Table 9. For example, the invention features inhibitory nucleic acids that specifically bind, or are complementary to, a fragment of any of the RNA transcripts of SEQ ID NOS: 1 to 21582 or 191089 to 193049, said fragment about 2000, about 1750, about 1500, or about 1250 nucleotides in length, or preferably about 1000, about 750, about 500, about 400, about 300 nucleotides in length, or more preferably about 200, about 150, or about 100 nucleotides in length, wherein the fragment of RNA comprises a stretch of at least five (5) consecutive nucleotides within any of SEQ ID NOS: 124437 to 190716, or 190934 to 191086, or 191087 (human Peaks), or SEQ ID NOS: 21583 to 124436, or 190717 to 190933, or 191088 (mouse Peaks), or the reverse complement of any of the cDNA sequences of Appendix I of U.S. Prov. Appl. No. 61/425,174 filed on Dec. 20, 2010, which is not attached hereto but is incorporated by reference herein in its entirety. In exemplary embodiments the fragment of RNA comprises at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 consecutive nucleotides within any of SEQ ID NOS: 124437 to 190716, or 190934 to 191086, or 191087 (human Peaks), or SEQ ID NOS: 21583 to 124436, or 190717 to 190933, or 191088 (mouse Peaks), or the reverse complement of any of the cDNA sequences of Appendix I of U.S. Prov. Appl. No. 61/425,174 filed on Dec. 20, 2010.

In some or any embodiments, the inhibitory nucleic acids are, e.g., about 5 to 40, or 10 to 50 bases, or 5 to 50 bases in length. In some embodiments, the inhibitory nucleic acid comprises or consists of a sequence of bases at least 80% or 90% complementary to, e.g., at least 5, 10, 15, 20, 25 or 30 bases of, or up to 30 or 40 bases of, the target RNA (i.e., any one of SEQ ID NOS: 1-193,049), or comprises a sequence of bases with up to 3 mismatches (e.g., up to 1, or up to 2 mismatches) over 10, 15, 20, 25 or 30 bases of the target RNA.

Thus, as noted above, the inhibitory nucleic acid can comprise or consist of a sequence of bases at least 80% complementary to at least 10, or 10-30, or 10-40 contiguous bases of the target RNA, or at least 80% complementary to at least 15, or 15-30, or 15-40 contiguous bases of the target RNA, or at least 80% complementary to at least 20, or 20-30, or 20-40 contiguous bases of the target RNA, or at least 80% complementary to at least 25, or 25-30, or 25-40 contiguous bases of the target RNA, or at least 80% complementary to at least 30, or 30-40 contiguous bases of the target RNA, or at least 80% complementary to at least 40 contiguous bases of the target RNA. Moreover, the inhibitory nucleic acid can comprise or consist of a sequence of bases at least 90% complementary to at least 5, or 5-30, or 5-40 contiguous bases of the target RNA, or at least 90% complementary to at least 10, or 10-30, or 10-40 contiguous bases of the target RNA, or at least 90% complementary to at least 15, or 15-30, or 15-40 contiguous bases of the target RNA, or at least 90% complementary to at least 20, or 20-30, or 20-40 contiguous bases of the target RNA, or at least 90% complementary to at least 25, or 25-30, or 25-40 contiguous bases of the target RNA, or at least 90% complementary to at least 30, or 30-40 contiguous bases of the target RNA, or at least 90% complementary to at least 40 contiguous bases of the target RNA. Similarly, the inhibitory nucleic acid can comprise or consist of a sequence of bases fully complementary to at least 5, 10, or 15 contiguous bases of the target RNA. It is understood that some additional non-complementary bases may be included. It is understood that inhibitory nucleic acids that comprise such sequences of bases as described may also comprise other non-complementary bases. For example, an inhibitory nucleic acid can be 20 bases in total length but comprise a 15 base portion that is fully complementary to 15 bases of the target RNA. Similarly, an inhibitory nucleic acid can be 20 bases in total length but comprise a 15 base portion that is at least 80% complementary to 15 bases of the target RNA.

Complementarity can also be referenced in terms of the number of mismatches in complementary base pairing, as noted above. Thus, the inhibitory nucleic acid can comprise or consist of a sequence of bases with up to 3 mismatches over 10 contiguous bases of the target RNA, or up to 3 mismatches over 15 contiguous bases of the target RNA, or up to 3 mismatches over 20 contiguous bases of the target RNA, or up to 3 mismatches over 25 contiguous bases of the target RNA, or up to 3 mismatches over 30 contiguous bases of the target RNA. Similarly, the inhibitory nucleic acid can comprise or consist of a sequence of bases with up to 2 mismatches over 10 contiguous bases of the target RNA, or up to 2 mismatches over 15 contiguous bases of the target RNA, or up to 2 mismatches over 20 contiguous bases of the target RNA, or up to 2 mismatches over 25 contiguous bases of the target RNA, or up to 2 mismatches over 30 contiguous bases of the target RNA. Similarly, the inhibitory nucleic acid can comprise or consist of a sequence of bases with one mismatch over 10, 15, 20, 25 or 30 contiguous bases of the target RNA.

In some or any of the embodiments of inhibitory nucleic acids described herein (e.g. in the summary, detailed description, or examples of embodiments) or the processes for designing or synthesizing them, the inhibitory nucleic acids may optionally exclude (a) any one or more of the specific inhibitory nucleic acids made or actually disclosed (i.e. specific chemistry, single or double stranded, specific modifications, and specific base sequence), set forth in the following SEQ ID NOS.; and/or (b) the base sequence of any one or more of the inhibitory nucleic acids of (a); and/or (c) the group of inhibitory nucleic acids that specifically bind or are complementary to the same specific portion of RNA (a stretch of contiguous bases) as any one or more of the inhibitory nucleic acids of (a); as disclosed in any one or more of the following publications: as target HOTAIR RNA (Rinn et al., 2007), Tsix, RepA, or Xist RNAs ((Zhao et al., 2008) [SEQ ID NOS: 194206-194210], or (Sarma et al., 2010) [SEQ ID NOS: 194217-194226] or (Zhao et al., 2010) [SEQ ID NOS: 194227-194228] or (Prasanath, et al., 2005) [SEQ ID NOS: 194213-194216] or (Shamovsky, et al., 2006) [SEQ ID NO: 194212] or (Mariner, et al., 2008) [SEQ ID NOS: 194211] or (Sunwoo, et al., 2008) or (Bernard, et al., 2010) [SEQ ID NOS: 194229]; or as targeting short RNAs of 50-200 nt that are identified as candidate PRC2 regulators (Kanhere et al., 2010); or (Kuwabara et al., US 2005/0226848) [SEQ ID NOS: 194230-194231] or (Li et al., US 2010/0210707) [SEQ ID NOS: 194232-194267] or (Corey et al., U.S. Pat. No. 7,709,456) [SEQ ID NOS: 194268-194285] or (Mattick et al., WO 2009/124341) or (Corey et al., US 2010/0273863) [SEQ ID NOS: 194286-194305], or (Wahlstedt et al., US 2009/0258925) [SEQ ID NOS: 193140-193206], or BACE: US 2009/0258925 [SEQ ID NOS: 193140-193206]; ApoA1: US 2010/0105760/EP235283 [SEQ ID NOS: 193207-193379], P73, p53, PTEN, WO 2010/065787 A2/EP2370582 [SEQ ID NOS: 193380-193425]; SIRT1: WO 2010/065662 A2/EP09831068 [SEQ ID NOS: 193426-193472]; VEGF: WO 2010/065671 A2/EP2370581 [SEQ ID NOS: 193473-193483]; EPO: WO 2010/065792 A2/EP09831152 [SEQ ID NOS: 193484-193492]; BDNF: WO2010/093904 [SEQ ID NOS: 193493-193503], DLK1: WO 2010/107740 [SEQ ID NOS: 193504-193510]; NRF2/NFE2L2: WO 2010/107733 [SEQ ID NOS: 193511-193518]; GDNF: WO 2010/093906 [SEQ ID NOS: 193519-193556]; SOX2, KLF4, Oct3A/B, "reprogramming factors: WO 2010/135329 [SEQ ID NOS: 193557-193573]; Dystrophin: WO 2010/129861 [SEQ ID NOS: 193574-193605]; ABCA1, LCAT, LRP1, ApoE, LDLR, ApoA1: WO 2010/129799 [SEQ ID NOS: 193606-193884]; HgF: WO 2010/127195 [SEQ ID NOS: 193885-193889]; TTP/Zfp36: WO 2010/129746 [SEQ ID NOS: 193890-193904]; TFE3, IRS2: WO 2010/135695 [SEQ ID NOS: 193905-193919]; RIG1, MDA5, IFNA1: WO 2010/138806 [SEQ ID NOS: 193920-193958]; PON1: WO 2010/148065 [SEQ ID NOS: 193959-193965]; Collagen: WO/2010/148050 [SEQ ID NOS: 193966-193998]; Dyrk1A, Dscr1, "Down Syndrome Gene": WO/2010/151674 [SEQ ID NOS: 193999-194022]; TNFR2: WO/2010/151671 [SEQ ID NOS: 194023-194029]; Insulin: WO/2011/017516 [SEQ ID NOS: 194030-194039]; ADIPOQ: WO/2011/019815 [SEQ ID NOS: 194040-194064]; CHIP: WO/2011/022606 [SEQ ID NOS: 194065-194074]; ABCB1: WO/2011/025862 [SEQ ID NOS: 194075-194082]; NEUROD1, EUROD1, HNF4A, MAFA, PDX, KX6, "Pancreatic development gene": WO/2011/085066 [SEQ ID NOS: 194083-194115]; MBTPS1: WO/2011/084455 [SEQ ID NOS: 194116-194119]; SHBG: WO/2011/085347 [SEQ ID NOS: 194120-194133]; IRF8: WO/2011/082409 [SEQ ID NOS: 194134-194137]; UCP2: WO/2011/079263 [SEQ ID NOS: 194138-194148]; HGF: WO/2011/079261 [SEQ ID NOS: 194149-194156]; GH: WO/2011/038205 [SEQ ID NOS: 194157-194161]; IQGAP: WO/2011/031482 [SEQ ID NOS: 194162-194166]; NRF1: WO/2011/090740 [SEQ ID NOS: 194167-194172]; P63: WO/2011/090741 [SEQ ID NOS: 194173-194176]; RNAseH1: WO/2011/091390 [SEQ ID NOS: 194177-194184]; ALOX12B: WO/2011/097582 [SEQ ID NOS: 194185-194189]; PYCR1: WO/2011/103528 [SEQ ID NOS: 194190-194193]; CSF3: WO/2011/123745 [SEQ ID NOS: 194194-194198]; FGF21: WO/2011/127337 [SEQ ID NOS: 194199-194205]; of which each of the foregoing is incorporated by reference in its entirety herein. In some or any embodiments, optionally excluded from the invention are inhibitory nucleic acids that specifically bind to, or are complementary to, any one or more of the following regions: Nucleotides 1-932 of SEQ ID NO: 193208; Nucleotides 1-1675 of SEQ ID NO: 193386; Nucleotides 1-518 of SEQ ID NO: 193387; Nucleotides 1-759 of SEQ ID NO: 193388; Nucleotides 1-25892 of SEQ ID NO: 193389; Nucleotides 1-279 of SEQ ID NO: 193390; Nucleotides 1-1982 of SEQ ID NO: 193391; Nucleotides 1-789 of SEQ ID NO: 193392; Nucleotides 1-467 of SEQ ID NO: 193393; Nucleotides 1-1028 of SEQ ID NO: 193427; Nucleotides 1-429 of SEQ ID NO: 193428; Nucleotides 1-156 of SEQ ID NO: 193429; Nucleotides 1-593 of SEQ ID NO: 193430; Nucleotides 1-643 of SEQ ID NO: 193475; Nucleotides 1-513 of SEQ ID NO: 193476; Nucleotides 1-156 of SEQ ID NO: 193486; Nucleotides 1-3175 of SEQ ID NO: 193494; Nucleotides 1-1347 of SEQ ID NO: 193506; Nucleotides 1-5808 of SEQ ID NO: 193513; Nucleotides 1-237 of SEQ ID NO: 193520; Nucleotides 1-1246 of SEQ ID NO: 193521; Nucleotides 1-684 of SEQ ID NO: 193522; Nucleotides 1-400 of SEQ ID NO: 193553; Nucleotides 1-619 of SEQ ID NO: 193554; Nucleotides 1-813 of SEQ ID NO: 193555; Nucleotides 1-993 of SEQ ID NO: 193560; Nucleotides 1-401 of SEQ ID NO: 193560; Nucleotides 1-493 of SEQ ID NO: 193561; Nucleotides 1-418 of SEQ ID NO: 193562; Nucleotides 1-378 of SEQ ID NO: 193576; Nucleotides 1-294 of SEQ ID NO: 193577; Nucleotides 1-686 of SEQ ID NO: 193578; Nucleotides 1-480 of SEQ ID NO: 193579; Nucleotides 1-501 of SEQ ID NO: 193580; Nucleotides 1-1299 of SEQ ID NO: 193613; Nucleotides 1-918 of SEQ ID NO: 193614; Nucleotides 1-1550 of SEQ ID NO: 193615; Nucleotides 1-329 of SEQ ID NO: 193616; Nucleotides 1-1826 of SEQ ID NO: 193617; Nucleotides 1-536 of SEQ ID NO: 193618; Nucleotides 1-551 of SEQ ID NO: 193619; Nucleotides 1-672 of SEQ ID NO: 193620; Nucleotides 1-616 of SEQ ID NO: 193621; Nucleotides 1-471 of SEQ ID NO: 193622; Nucleotides 1-707 of SEQ ID NO: 193623; Nucleotides 1-741 of SEQ ID NO: 193624; Nucleotides 1-346 of SEQ ID NO: 193625; Nucleotides 1-867 of SEQ ID NO: 193626; Nucleotides 1-563 of SEQ ID NO: 193627; Nucleotides 1-970 of SEQ ID NO: 193892; Nucleotides 1-1117 of SEQ ID NO: 193893; Nucleotides 1-297 of SEQ ID NO: 193894; Nucleotides 1-497 of SEQ ID NO: 193907; Nucleotides 1-1267 of SEQ ID NO: 193923; Nucleotides 1-586 of SEQ ID NO: 193924; Nucleotides 1-741 of SEQ ID NO: 193925; Nucleotides 1-251 of SEQ ID NO: 193926; Nucleotides 1-681 of SEQ ID NO: 193927; Nucleotides 1-580 of SEQ ID NO: 193928; Nucleotides 1-534 of SEQ ID NO: 193960; Nucleotides 1-387 of SEQ ID NO: 193969; Nucleotides 1-561 of SEQ ID NO: 193970; Nucleotides 1-335 of SEQ ID NO: 193971; Nucleotides 1-613 of SEQ ID NO: 193972; Nucleotides 1-177 of SEQ ID NO: 193973; Nucleotides 1-285 of SEQ ID NO: 193974; Nucleotides 1-3814 of SEQ ID NO: 194001; Nucleotides 1-633 of SEQ ID NO: 194002; Nucleotides 1-497 of SEQ ID NO: 194003; Nucleotides 1-545 of SEQ ID NO: 194004; Nucleotides 1-413 of SEQ ID NO: 194306; Nucleotides 1-413 of SEQ ID NO: 194307; Nucleotides 1-334 of SEQ ID NO: 194308; Nucleotides 1-582 of SEQ ID NO: 194309; Nucleotides 1-416 of SEQ ID NO: 194310; Nucleotides 1-3591 of SEQ ID NO: 194311; Nucleotides 1-875 of SEQ ID NO: 194312; Nucleotides 1-194 of SEQ ID NO: 194313; Nucleotides 1-2074 of SEQ ID NO: 194314; Nucleotides 1-1237 of SEQ ID NO: 194315; Nucleotides 1-4050 of SEQ ID NO: 194316; Nucleotides 1-1334 of SEQ ID NO: 194317; Nucleotides 1-1235 of SEQ ID NO: 194318; Nucleotides 1-17,964 of SEQ ID NO: 194319; Nucleotides 1-50,003 of SEQ ID NO: 194320; Nucleotides 1-486 of SEQ ID NO: 194321; Nucleotides 1-494 of SEQ ID NO: 194322; Nucleotides 1-1992 of SEQ ID NO: 194323; Nucleotides 1-1767 of SEQ ID NO: 194324; Nucleotides 1-1240 of SEQ ID NO: 194325; Nucleotides 1-3016 of SEQ ID NO: 194326; Nucleotides 1-1609 of SEQ ID NO: 194327; Nucleotides 1-312 of SEQ ID NO: 194328; Nucleotides 1-243 of SEQ ID NO: 194329; Nucleotides 1-802 of SEQ ID NO: 194330; Nucleotides 1-514 of SEQ ID NO: 194331; Nucleotides 1-936 of SEQ ID NO: 194332; Nucleotides 1-1075 of SEQ ID NO: 194333; Nucleotides 1-823 of SEQ ID NO: 194334; Nucleotides 1-979 of SEQ ID NO: 194335; Nucleotides 1-979 of SEQ ID NO: 194336; Nucleotides 1-288 of SEQ ID NO: 194337; Nucleotides 1-437 of SEQ ID NO: 194338; Nucleotides 1-278 of SEQ ID NO: 194339; Nucleotides 1-436 of SEQ ID NO: 194340; Nucleotides 1-1140 of SEQ ID NO: 194341; Nucleotides 1-2082 of SEQ ID NO: 194342; Nucleotides 1-380 of SEQ ID NO: 194343; Nucleotides 1-742 of SEQ ID NO: 194344; Nucleotides 1-4246 of SEQ ID NO: 194345.

In some or any embodiments, one or more of the murine RNA sequences of Table 3 may be excluded. In some or any embodiments, one or more of the human RNA sequences of Table 3 may be excluded. In some or any embodiments, one or more of the murine RNA sequences of Table 4 may be excluded. In some or any embodiments, one or more of the human RNA sequences of Table 4 may be excluded. In some or any embodiments, one or more of the murine RNA sequences of Table 5 may be excluded. In some or any embodiments, one or more of the human RNA sequences of Table 5 may be excluded.

In some or any of the embodiments of inhibitory nucleic acids described herein, or processes for designing or synthesizing them, the inhibitory nucleic acids will upregulate gene expression and may specifically bind or specifically hybridize or be complementary to a PRC2-binding RNA that is transcribed from the same strand as a protein-coding reference gene. The inhibitory nucleic acid may bind to a region of the PRC2-binding RNA that originates within or overlaps an intron, exon, intron-exon junction, 5' UTR, 3' UTR, a translation initiation region, or a translation termination region of a protein-coding sense-strand of a reference gene (refGene).

In some or any of the embodiments of inhibitory nucleic acids described herein, or processes for designing or synthesizing them, the inhibitory nucleic acids will upregulate gene expression and may specifically bind or specifically hybridize or be complementary to a PRC2-binding RNA that transcribed from the opposite strand (antisense-strand) compared to a protein-coding reference gene.

The inhibitory nucleic acids described herein may be modified, e.g. comprise a modified sugar moiety, a modified internucleoside linkage, a modified nucleotide and/or combinations thereof. In addition, the inhibitory nucleic acids can exhibit one or more of the following properties: do not induce substantial cleavage or degradation of the target RNA; do not cause substantially complete cleavage or degradation of the target RNA; do not activate the RNAse H pathway; do not activate RISC; do not recruit any Argonaute family protein; are not cleaved by Dicer; do not mediate alternative splicing; are not immune stimulatory; are nuclease resistant; have improved cell uptake compared to unmodified oligonucleotides; are not toxic to cells or mammals; may have improved endosomal exit; do interfere with interaction of lncRNA with PRC2, preferably the Ezh2 subunit but optionally the Suz12, Eed, RbAp46/48 subunits or accessory factors such as Jarid2; do decrease histone H3-lysine27 methylation and/or do upregulate gene expression.

In some or any of the embodiments of inhibitory nucleic acids described herein, or processes for designing or synthesizing them, the inhibitory nucleic acids may optionally exclude those that bind DNA of a promoter region, as described in Kuwabara et al., US 2005/0226848 or Li et al., US 2010/0210707 or Corey et al., U.S. Pat. No. 7,709,456 or Mattick et al., WO 2009/124341, or those that bind DNA of a 3' UTR region, as described in Corey et al., US 2010/0273863.

Inhibitory nucleic acids that are designed to interact with RNA to modulate gene expression are a distinct subset of base sequences from those that are designed to bind a DNA target (e.g., are complementary to the underlying genomic DNA sequence from which the RNA is transcribed).

Also described herein are methods for the use of Locked Nucleic Acids (LNA) molecules for targeting nuclear long noncoding RNA, an RNA subclass that has been less amenable to traditional knockdown techniques (Jepsen et al., Oligonucleotides, 14, 130-146 (2004); Khalil et al., PNAS 106(28)11675-11680 (2009)). As described herein, LNA molecules can be used to displace lncRNAs from cognate binding sequences (i.e. cognate binding partners), e.g., chromosomes, or PRC2, with fast kinetics.

Thus, in one aspect, the present invention provides locked nucleic acid (LNA) molecules that are complementary to and bind specifically to long noncoding RNAs (lncRNAs).

In another aspect, the invention features methods for dissociating (e.g., disrupting binding of or decreasing binding affinity for) a long noncoding RNA (lncRNA) from its cognate binding partner. The methods include contacting the lncRNA with a locked nucleic acid (LNA) molecule that is complementary to and binds specifically to the lncRNA.

In some embodiments, the lncRNA is a large intergenic non-coding RNA (lincRNA), a promoter associated short RNA (PASR), an endogenous antisense RNA, or an RNA that binds a chromatin modifier, e.g., a Polycomb complex, e.g., Polycomb repressive complex 2.

In some embodiments, the lncRNA is localized to the nucleus.

In some embodiments, the LNA molecule is complementary to a region of the lncRNA comprising a known RNA localization motif.

In some embodiments, the LNA molecule comprises at least one non-locked nucleotide. Such LNA molecules may have one or more locked nucleotides and one or more non-locked nucleotides. It is understood that the term "LNA" includes a nucleotide that comprises any constrained sugar that retains the desired properties of high affinity binding to complementary RNA, nuclease resistance, lack of immune stimulation, and rapid kinetics. Exemplary constrained sugars include those listed below.

Unless otherwise defined, all technical and scientific terms used herein have the same meaning as commonly understood by one of ordinary skill in the art to which this invention belongs. Methods and materials are described herein for use in the present invention; other, suitable methods and materials known in the art can also be used. The materials, methods, and examples are illustrative only and not intended to be limiting. All publications, patent applications, patents, sequences, database entries, and other references mentioned herein are incorporated by reference in their entirety. In case of conflict, the present specification, including definitions, will control.

Other features and advantages of the invention will be apparent from the following detailed description and figures, and from the claims.

REFERENCE TO SEQUENCE LISTING SUBMITTED ON A COMPACT DISC

This application includes a compact disc containing a sequence listing. The sequence listing is identified on the compact disc as follows.

| File Name | Date of Creation | Size |
|---|---|---|
| 00786-0775WO1SequenceListing.txt | Nov. 10, 2011 | 584 MB |

The entire content of the sequence listing is hereby incorporated by reference.

DESCRIPTION OF DRAWINGS

FIGS. 1A-1K show one embodiment of the RIP-seq methods as described herein, and analysis of pilot libraries.

FIG. 1A is an exemplary RIP-seq schematic.

FIG. 1B is a pair of images showing the results of Western blot analysis (right panel) of Ezh2 protein in wildtype (WT) and Ezh2−/− ES cells and Coomassie staining (left panel) demonstrating equal loading.

FIG. 1C is an image showing the results of a preparatory agarose gel for RIP product size selection.

FIG. 1D is a table showing pilot library statistics for WT and control libraries for an equivalent number of cells (column 2), reads after filtering using criteria shown in FIG. 7 (column 3), and distinct reads after removing duplicates and repetitive elements (column 4).

FIG. 1E is a table giving the CCs of indicated libraries in pairwise comparisons against the original WT library.

FIG. 1F is a line graph showing the cumulative frequency of WT reads mapping to elements with indicated genome copy numbers.

FIG. 1G is a pie chart showing the relative frequencies of various repeats in the WT library. Elements repeated >10 times per genome accounted for <20% of all reads. Simple repeats accounted for 85.714% and LINEs, SINES, LTRs, low-complexity repeats, and satellites represented 4.881%, 4.130%, 2.636%, 2.487%, and 0.002% (not shown on chart), respectively.

FIG. 1H is a graph showing alignments of distinct WT pilot reads to the mouse X-chromosome. The number of reads per 100-kb window for both unique and repetitive elements are plotted from centromere (CEN) to distal telomere (TELO). 100-kilobase windows are nonoverlapping and consecutive. Reads were normalized such that those mapping to 'n' locations were counted as $1/n^{th}$ of a read at each location. Chr, chromosome. Dark grey, forward strand; light grey, reverse strand.

FIG. 1I is a graph showing a zoom-in of the X-inactivation center listing pilot WT reads. The Ezh2−/− library is depleted of these reads. Freq≥3 reads shown. *, ncRNA.

FIG. 1J shows a pair of graphs. On the top is a graph showing alignments of distinct WT pilot reads to the mouse chromosome 12. The number of reads per 100-kb window for both unique and repetitive elements are plotted from centromere (CEN) to distal telomere (TELO). 100-kilobase windows are nonoverlapping and consecutive. Reads were normalized such that those mapping to 'n' locations were counted as 1/nth of a read at each location. Chr, chromosome. Dark grey, forward strand; light grey, reverse strand. On the bottom is a graph showing a zoom-in of imprinted domains listing pilot WT reads. The Ezh2−/− library is depleted of these reads. Freq≥3 reads shown. *, ncRNA.

FIG. 1K shows a pair of graphs. On the left is a graph showing alignments of distinct WT pilot reads to the mouse chromosome 12. The number of reads per 100-kb window for both unique and repetitive elements are plotted from centromere (CEN) to distal telomere (TELO). 100-kilobase windows are nonoverlapping and consecutive. Reads were normalized such that those mapping to 'n' locations were counted as 1/nth of a read at each location. Chr, chromosome. Dark grey, forward strand; light grey, reverse strand. On the right is a graph showing a zoom-in of imprinted domains listing pilot WT reads. The Ezh2−/− library is depleted of these reads. Freq ≥3 reads shown. *, ncRNA.

FIG. 1L is a table showing the number of reads (with freq ≥3) in each genetic category. Parentheses show the percent of distinct reads belonging to each category (e.g., 50.7% of reads map to ncRNA).

FIG. 1M is a table showing the number of transcription units hit by reads with freq ≥3. The total number transcripts in each category is indicated in column 2. Parentheses show the percent representation of each category in the PRC2 transcriptome (e.g., 13.7% of known Suz12 domains are represented in the PRC2 transcriptome).

FIGS. 2A-2D show data related to larger-scale sequencing to capture the PRC2 transcriptome.

FIG. 2A is a scatterplot map showing 39,003 transcripts from the UCSC joined transcriptome database by their RPKM values in the wildtype library (x-axis) and the null library (y-axis). A UCSC transcript that is neither represented in the WT or null library is plotted at (0,0). Smoothing was performed by the function, smoothScatter, in R. Darker shades correspond to a greater density of genes at a given point on the graph. The 3:1 WT/null enrichment line and the x=0.4 threshold are shown as dotted grey lines. Transcripts meeting the criteria of ≥3:1 RPKM enrichment and WT RPKM≥0.4 are deemed strong positives and are shown in red, in a pool marked "PRC2 transcriptome". Transcripts that fall below the cut-offs are considered background and are shown in orange. Tsix is off-chart (arrow) with (x,y) coordinates indicated.

FIG. 2B is a table showing characteristics of the PRC2 transcriptome. Numbers in parentheses indicate the total number of genes in each category (e.g., Of 793 tumor suppressors, 325 are found in the PRC2 transcriptome).

FIG. 2C is a graph showing the results of higher resolution analysis of the X-inactivation center. Distinct reads were smoothed with a sliding 200-bp window on the x-axis and their representations plotted on the y-axis.

FIG. 2D is a graph showing the results of metagene analysis; distinct reads from the PRC2 transcriptome are plotted as a function of distance from TSS.

FIG. 2E is a pair of graphs showing the frequency of all reads plotted as a function of distance from the TSS for WT (left) and Ezh2−/− (right) libraries. The x-axis shows the promoter region of all genes taken from the UCSC refGene database, with coordinates in base-pairs (bp) relative to the TSS. Forward strand reads are indicated in blue, reverse strand in red. Arrows indicate enrichment near TSS.

FIG. 4: Confirmation by native RIP/qRT-PCR and UV-crosslinked RIP.

FIG. 5A is an image showing a Coomassie-stained gel of human PRC2 and subunits. Different migrations reflect Flag-tagged versus untagged versions of each protein.

FIG. 5B is a schematic showing WT and mutant (Mut) versions of RepA (SEQ ID NO:193118 and 193119) and Hes1 (SEQ ID NO:193120 and 193121) as double stem-loop structures.

FIG. 5C is an image showing the results of RNA EMSA using purified PRC2 complex and end-labeled probes. Negative controls: DsI and DsII, RNA sequences from Xist outside of RepA. Double shifts indicate presence of multiple subcomplexes of PRC2.

FIG. 5D is an image showing the results of RNA EMSA using purified PRC2 subunits. The lanes were run on the same gel but separated in the image because a lane was cut out between each panel.

FIG. 5E is an image showing the results of Titration of 1-25 fmoles of Hes1-as RNA probe against 0.1-1.0 mg of EZH2.

FIG. 5F is a set of four images showing the results of RNA pulldown assays using purified PRC2 and indicated RNA probes loaded in equal moles. 25% of the IP fraction, 10% of flow-through, and 10% of RNA input are shown.

FIG. 6A is a map of Dlk1-Gtl2 and the positions of shRNAs and primer pairs used in RIP and ChIP. Dotted lines indicate that the transcripts may extend further.

FIG. 6B is a set of three bar graphs showing qRT-PCR of Gtl2, Dlk1, and Gtl2-as RNA levels after Gtl2 knockdown (1(D) (left bar in each graph) or scrambled KD (right bar). Pools of knockdown cells are used. RNA levels are normalized to Gapdh levels and compared to levels in scrambled knockdown controls (Scr). Experiments were performed in triplicates two times. One SD shown. P is calculated using a two-tailed student t-test between Gtl2 versus Scr KDs.

FIG. 6C is a pair of bar graphs showing qChIP of PRC2 association in KD cells. ChIP was carried out with α-Ezh2 (top) and a-H3K27me3 (bottom) antibodies, with normal rabbit IgG as control. qPCR levels are expressed as a percentage of input DNA. DMR, differentially methylated region. ICR, imprint control region. One SD shown. P, determined by two-tailed student t-tests of Gtl2 versus Scr KD.

FIG. 6D is a bar graph showing qRT-PCR of Ezh2 mRNA levels in Gtl2- and Scr-KD clones.

FIG. 6E is a bar graph showing qRT-PCR of Dlk1 expression in Ezh2−/− versus WT cells relative to Gtl2 expression. One is a bar graph showing SD shown.

FIGS. 7A-C show RIP-seq and bioinformatics analysis in the test and control samples.

FIG. 7A is a flow chart describing the RIP-seq and bioinformatics analysis in test and control samples.

FIG. 7B is an image showing that treating RIP products with RNAseA (10 ug/mL) and RNAseV1 (0.001 U/mL) destroyed products in the 200-2,000 nt size range (boxed), suggesting that the material pulled down was RNA. Bands in the <200 nt range are PCR primer dimers.

FIG. 7C is a set of three graphs showing the results of metagene analysis: The number of distinct reads plotted as a function of distance from the TSS for the WT, Ezh2−/−, and IgG pilot samples (plotted to the same scale).

FIGS. 15A-C show that LNA molecules Targeting Xist Repeat C abolish Xist RNA localization to Xi.

FIG. 15A is an alignment of 14 tandem mouse Repeat C (SEQ ID NOs: 193122-193135). Conserved nucleotides are indicated with an asterisk. The regions targeted by LNA molecules are indicated by a line.

FIG. 15B is a pair of graphs showing quantitation of the results of Xist RNA FISH at indicated timepoints after LNA molecule nucleofection. Results shown for LNA-C1, but LNA-C2 gives similar results.

FIG. 15C shows an alignment of mouse and human Repeat C regions targeted by the LNA molecules (left) (SEQ ID NOs: 193136-193139).

FIG. 17A is a schematic map of Xist exon/intron structure and locations of LNA molecules utilized.

FIG. 17B is a bar graph showing the results of qRT-PCR of Xist levels, normalized to Gapdh quantities.

FIG. 17C is an image of a Western blot with Ezh2 antibodies. Actin is used as a loading control.

FIG. 18A is a schematic representation of X-genes.

FIG. 18B is a bar graph showing Ezh2 ChIP analysis at X-genes.

FIG. 18C is a pair of bar graphs showing ChIP analysis of Ezh2 after LNA molecule nucleofection. Asterisks, P<0.05 by the Student t-Test.

FIG. 18D is a bar graph showing ChIP analysis of Ezh2 enrichment on the autosomal En1 promoter.

TABLE 1: IMPRINTED REGIONS HIT BY THE PRC2 TRANSCRIPTOME

Figure 1A:
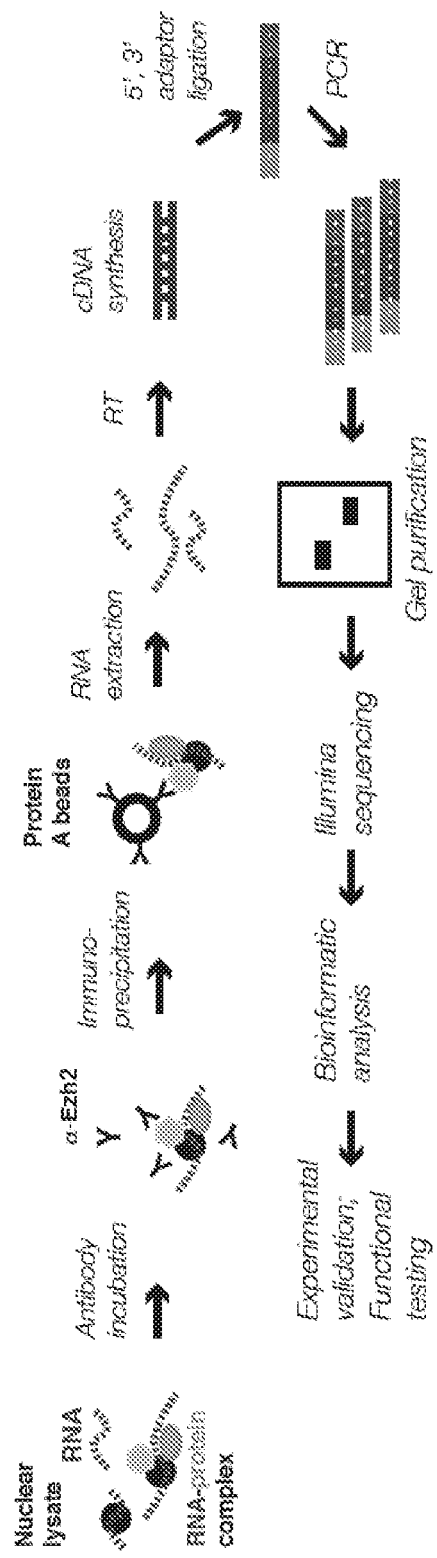

Intersection of the PRC2 transcriptome with imprinted gene coordinates (available online at geneimprint.com). The murine imprinted gene (i.e., an intersecting or nearby gene) targeted by the PRC2-binding transcript is shown in column 1. Column 1 also shows the chromosome strand of the murine imprinted gene ("+" sign indicates that the gene is transcribed from the top or plus strand, while "−" sign indicates that the PRC2-binding transcript is transcribed from the bottom or minus strand). The chromosome localization and nucleotide coordinates in mm9 of the PRC2-binding transcript are shown in column 2, as well as a "+" sign or "−" sign that indicates whether the PRC2-binding transcript is transcribed from the top strand (plus strand hit) or bottom strand (minus strand hit). Column 3 displays the SEQ ID NO: of the mouse PRC2-binding transcript (i.e., the nucleotide sequence transcribed from the mouse chromosomal coordinates and strand of column 2, converted to RNA by replacing T with U). Column 4 shows the corresponding human gene name for the murine imprinted gene of column 1, obtained from the Mouse Genome Database (MGD), Mouse Genome Informatics, The Jackson Laboratory, Bar Harbor, Me. World Wide Web (www.informatics.jax.org). Mouse-to-human LiftOver of the mouse chromosome coordinates in column 2, performed in the UCSC genome browser as described herein, generated the orthologous human chromosome coordinates which appear in Column 5. 50% conservation was used for LiftOver analysis. Additional human chromosome coordinates were generated by mapping of highly conserved or homologous regions from the mouse to human genome. Column 6 displays the SEQ ID NO: of the predicted human PRC2-binding transcript (i.e., the nucleotide sequence transcribed from the human chromosomal coordinates and strand of column 5, converted to RNA by replacing T with U). When the PRC2-interacting transcript is transcribed from the opposite strand compared to the imprinted reference gene in column 1, that implies that the PRC2-interacting RNA is complementary, or antisense-strand ("opposite strand") in orientation, to the reference imprinted gene. Note that the PRC2-binding transcript need not be the reference imprinted gene itself, but a distinct transcript that overlaps in position.

TABLE 2: THE PRC2 TRANSCRIPTOME

Shown are the 9,788 transcripts associated with PRC2 in mouse ES cells. The joined UCSC transcriptome was used to map reads in the WT library. UCSC transcripts hit by reads are shown in column 1 ("MTR" joined gene name). Column 2 shows the chromosome strand of the UCSC transcript ("+" sign indicates that the top or plus strand, while "−" sign indicates the bottom or minus strand). The chromosome localization and nucleotide coordinates in mm9 of the PRC2-binding transcript are shown in column 3, as well as a "+" sign or "−" sign that indicates whether the PRC2-binding transcript is transcribed from the top strand (plus strand hit) or bottom strand (minus strand hit). RPKM values of 0.4 or above were considered a "hit". Column 4 displays the SEQ ID NO: of the mouse PRC2-binding transcript (i.e., the nucleotide sequence transcribed from the mouse chromosomal coordinates and strand of column 3, converted to RNA by replacing T with U). Mouse-to-human LiftOver of the mouse chromosome coordinates in column 3, performed in the UCSC genome browser as described herein, generated the orthologous human chromosome coordinates which appear in column 5. Additional human chromosome coordinates were generated by mapping of highly conserved or homologous regions from the mouse to human genome. Column 6 displays the SEQ ID NO: of the predicted human PRC2-binding transcript (i.e., the nucleotide sequence transcribed from the human chromosomal coordinates and strand of column 5, converted to RNA by replacing T with U). 50% conservation was used for LiftOver analysis. Alignment of reads are reported based on the chromosomal strand the reads match, regardless of the orientation of the overlapping gene. A single hit to the opposite strand of the reference transcript implies that the PRC2-binding RNA is complementary, or antisense-strand ("opposite strand") in orientation, to the reference transcript. Any overlapping refGene targeted by the murine PRC2-binding transcript of column 2 (i.e., an intersecting or nearby gene), without regard to orientation, is shown in column 7.

TABLE 3: BIVALENT DOMAINS WITH AN ASSOCIATED PRC2-INTERACTING TRANSCRIPT

Intersection of the PRC2 transcriptome with ES-cell bivalent domains. mm8 coordinates from Mikkelsen et al. (2007) were converted to mm9 for this analysis. Column 1 displays the overlapping refGenes (i.e., an intersecting or nearby gene) targeted by the PRC2-binding transcript of column 2, regardless of strand orientation. Chromosome coordinates (mm9) of the PRC2-binding transcript are shown in column 2, as well as a "+" sign or "−" sign that indicates whether the PRC2-binding transcript is transcribed from the top (plus) or bottom (minus) strand. Column 3 displays the SEQ ID NO: of the mouse PRC2-binding RNA (i.e., the nucleotide sequence transcribed from the mouse chromosomal coordinates and strand of column 2, converted to RNA by replacing T with U). Mouse-to-human LiftOver of the mouse chromosome coordinates in column 2 (50% conservation was used for LiftOver analysis), performed in the UCSC genome browser as described herein, generated the orthologous human chromosome coordinates which appear in column 4. Additional human chromosome coordinates were generated by mapping of highly conserved or homologous regions from the mouse to human genome. Column 5 displays the SEQ ID NO: of the predicted human PRC2-binding RNA (i.e., the nucleotide sequence transcribed from the human chromosomal coordinates and strand of column 3, converted to RNA by replacing T with U).

TABLE 4: PRC2-BINDING SITES WITH AN ASSOCIATED PRC2-INTERACTING TRANSCRIPT

Intersection of the PRC2 transcriptome with known Suz12-binding sites in ES cells. mm8 coordinates from Boyer et al., 2006, were converted to mm9. Column 1 displays the overlapping refGenes (i.e., an intersecting or nearby gene) targeted by the murine PRC2-binding transcript of column 2, regardless of strand orientation. Chromosome coordinates of the PRC2-binding transcript are shown in column 2, as well as a "+" sign or "−" sign that indicates whether the PRC2-binding transcript is transcribed from the top (plus) or bottom (minus) strand. Column 3 displays the SEQ ID NO: of the mouse PRC2-binding transcript (i.e., the nucleotide sequence transcribed from the mouse chromosomal coordinates and strand of column 2, converted to RNA by replacing T with U). Mouse-to-human LiftOver of the mouse chromosome coordinates in column 2 (50% conservation was used for LiftOver analysis), performed in the UCSC genome browser as described herein, generated the orthologous human chromosome coordinates which appear in column 4. Additional human chromosome coordinates were generated by mapping of highly conserved or homologous regions from the mouse to human genome. Column 5 displays the SEQ ID NO: of the predicted corresponding human PRC2-binding transcript (i.e., the nucleotide sequence transcribed from the human chromosomal coordinates and strand of column 4, converted to RNA by replacing T with U).

TABLE 5: LINCRNA DOMAINS INTERSECTING WITH THE PRC2 TRANSCRIPTOME

Intersection of the PRC2 transcriptome with mouse lincRNA domains (Guttman et al., 2009). Coordinates were converted from mm6 to mm8 and then to mm9, as there is no direct LiftOver from mm6 to mm9. Hits can occur to either strand of the lincRNA domains. Chromosome coordinates of the PRC2-binding transcript are shown in column 1, as well as a "+" sign or "−" sign that indicates whether the PRC2-binding transcript is transcribed from the top (plus) or bottom (minus) strand. Column 2 displays the SEQ ID NO: of the mouse PRC2-binding RNA (i.e., the nucleotide sequence transcribed from the mouse chromosomal coordinates and strand of column 1, converted to RNA by replacing T with U). Mouse-to-human LiftOver of the mouse chromosome coordinates in column 1 (50% conservation was used for LiftOver analysis), performed in the UCSC genome browser as described herein, generated the orthologous human chromosome coordinates which appear in column 3. Additional human chromosome coordinates were generated by mapping of highly conserved or homologous regions from the mouse to human genome. Column 4 displays the SEQ ID NO: of the predicted corresponding human PRC2-binding transcript (i.e., the nucleotide sequence transcribed from the human chromosomal coordinates and strand of column 3, converted to RNA by replacing T with U). Overlapping refGenes targeted by the murine PRC2-binding transcript of column 1 (i.e., an intersecting or nearby gene) regardless of strand orientation, are shown in column 5.

TABLE 6: HITS TO THE PRC2 TRANSCRIPTOME WITHIN ONCOGENE LOCI

Intersection of the PRC2 transcriptome with known oncogene loci (available online at cbio.mskcc.org/CancerGenes). Human oncogene loci were mapped to mouse coordinates for this analysis by first merging coordinates on the same strand and chromosome of same named genes in the refGene, then intersecting identical names of the oncogenes with that of the genes in refGene without regard to capitalization. Column 1 shows the mouse gene name corresponding to the human oncogene of column 6 targeted by the PRC2-binding transcript. Corresponding mouse and human gene names were obtained from the Mouse Genome Database (MGD), Mouse Genome Informatics, The Jackson Laboratory, Bar Harbor, Me. (www.informatics.jax.org). Column 1 also shows the chromosome strand of the mouse oncogene ("+" sign indicates that the gene is transcribed from the top or plus strand, while "−" sign indicates that the gene is transcribed from the bottom or minus strand). The chromosome localization and nucleotide coordinates in mm9 of the PRC2-binding transcript are shown in column 2, as well as a "+" sign or "−" sign that indicates whether the PRC2-binding transcript is transcribed from the top (plus) or bottom (minus) strand. Column 3 displays the SEQ ID NO: of the mouse PRC2-binding transcript (i.e., the nucleotide sequence transcribed from the mouse chromosomal coordinates and strand of column 2, converted to RNA by replacing T with U). Mouse-to-human LiftOver of the mouse chromosome coordinates in column 2 (50% conservation was used for LiftOver analysis), performed in the UCSC genome browser as described herein, generated the orthologous human chromosome coordinates which appear in column 4. Additional human chromosome coordinates were generated by mapping of highly conserved or homologous regions from the mouse to human genome. Column 5 displays the SEQ ID NO: of the predicted corresponding human PRC2-binding transcript (i.e., the nucleotide sequence transcribed from the human chromosomal coordinates and strand of column 4, converted to RNA by replacing T with U). Column 6 shows the human refGene names of each murine oncogene (i.e., an intersecting or nearby gene) targeted by the murine PRC2-binding transcript of column 2. When the PRC2-binding transcript is on the opposite strand from the refGene, it implies that the PRC2-interacting RNA is complementary, or antisense-strand ("opposite strand") in orientation to the reference oncogene. Note that the PRC2-interacting transcript need not be the refGene itself, but a distinct transcript that overlaps in position with the refGene. The cancers associated with the oncogene are shown in column 7.

TABLE 7: HITS TO THE PRC2 TRANSCRIPTOME WITHIN TUMOR SUPPRESSOR LOCI

Intersection of the PRC2 transcriptome with known tumor suppressor loci (available online at cbio.mskcc.org/CancerGenes). Human tumor suppressor loci were mapped to mouse coordinates for this analysis in a similar manner to the oncogenes of Table 6. The table is organized as described in Table 6 legend. Column 1 shows the mouse tumor suppressor corresponding to the human tumor suppressor of column 6 targeted by the PRC2-binding transcript. Corresponding mouse and human gene names were obtained from the Mouse Genome Database (MGD), Mouse Genome Informatics, The Jackson Laboratory, Bar Harbor, Me. (www.informaticsjax.org). Column 1 also shows the chromosome strand of the mouse tumor suppressor ("+" sign indicates that the gene is transcribed from the top or plus strand, while "−" sign indicates that the gene is transcribed from the bottom or minus strand). The chromosome localization and nucleotide coordinates in mm9 of the PRC2-binding transcript are shown in column 2, as well as a "+" sign or "−" sign that indicates whether the PRC2-binding transcript is transcribed from the top (plus) or bottom (minus) strand. Column 3 displays the SEQ ID NO: of the mouse PRC2-binding RNA (i.e., the nucleotide sequence transcribed from the mouse chromosomal coordinates and strand of column 2, converted to RNA by replacing T with U). Mouse-to-human LiftOver of the mouse chromosome coordinates in column 2 (50% conservation was used for LiftOver analysis), performed in the UCSC genome browser as described herein, generated the orthologous human chromosome coordinates which appear in column 4. Additional human chromosome coordinates were generated by mapping of highly conserved or homologous regions from the mouse to human genome. Column 5 displays the SEQ ID NO: of the predicted corresponding human PRC2-binding transcript (i.e., the nucleotide sequence transcribed from the human chromosomal coordinates and strand of column 4, converted to RNA by replacing T with U). Column 6 shows the human refGene names of each tumor suppressor (i.e., an intersecting or nearby gene) targeted by the murine PRC2-binding transcript of column 2.

TABLE 8: INTERSECTION OF THE PRC2 TRANSCRIPTOME, AND PEAKS GENERATED BY OVERLAPPING READS IN APPENDIX I, WITH TARGET GENES

The sequence reads in Appendix I (obtained from sequencing cDNA according to Examples 1-2) represent regions protected from endogenous nucleases during the RIP procedure and thus represent regions of RNA that bind to PRC2. As noted above, Appendix I appears in U.S. Prov. Appln. No. 61/425,174 filed on Dec. 20, 2010, which is not attached hereto but is incorporated by reference herein in its entirety, These sequence reads of Appendix I that were enriched 3:1 in WT vs. null and showed a minimal RPKM value of 0.4 were overlapped to generate longer contiguous regions of sequence referred to herein as a "Peak." The corresponding nucleotide sequences of the mouse Peaks (converted to RNA by replacing T with U) appear in the sequence listing as SEQ ID NOS: 21583 to 124436, or 190717 to 190933, or 191088. Mouse-to-human LiftOver of the mouse chromosome coordinates and strand of these mouse Peaks was performed in the UCSC genome browser as described herein, to generate orthologous human chromosome coordinates. Each corresponding human Peak RNA sequence (i.e., the nucleotide sequence of the human chromosomal coordinates and strand, converted to RNA by replacing T with U) appear in the sequence listing as SEQ ID NOS: 124437 to 190716, or 190934 to 191086, or 191087.

These human Peaks and the human PRC2 transcriptome (i.e. human sequences of PRC2-binding transcripts referenced in Tables 1-7) were intersected with known genes from the NCBI refGene database to identify genes targeted by the PRC2-binding RNA (i.e. an intersecting or nearby gene). Similarly, the mouse Peaks and the mouse PRC2 transcriptome of Tables 1-7 were intersected with known genes from the NCBI refGene database to identify genes targeted by the PRC2-binding RNA (i.e. an intersecting or nearby gene).

Columns 1 and 2 displays the SEQ ID NO: of the sequence of all of (a) the human PRC2-binding transcripts, (b) the human Peak sequences within the PRC2-binding RNA, (c) the mouse PRC2-binding transcripts, and (d) the mouse Peak sequences within the PRC2-binding RNA, which target the NCBI gene (i.e., are intersecting or nearby) shown in Column 3. Column 3 shows the NCBI gene name and unique NCBI gene ID number (National Library of Medicine (US), National Center for Biotechnology Information; chapter 19, Entrez Gene: A Directory of Genes. www.ncbi.nlm.nih.gov/gene/). Human gene names appear as all capitals, while mouse gene names appear with only the first letter capitalized.

Column 1 displays SEQ ID NOs for "same strand" PRC2-binding RNA that is transcribed from the same strand as the reference NCBI gene (for example, if the NCBI gene is tran-scribed from the minus strand of the chromosome, then the PRC2-binding RNA is also transcribed from the minus strand). Column 2 displays SEQ ID NOs for "opposite strand" PRC2-binding RNA that is transcribed from the opposite strand, or antisense-strand, compared to the reference NCBI gene. SEQ ID NOs. from 1 to 21582 or 191089 to 192972 represent transcripts, while SEQ ID NOs. from 21583 to 191088 represent Peaks.

In columns 1 and 2, the degree of overlap between (a) the transcript or Peak coordinates and (b) the NCBI gene coordinates appears in square brackets. A positive number indicates the number of overlapping nucleotides between the two, and a negative number represents the size of the gap between the two (i.e. the number of nucleotides of distance between the two). For Peaks, an "F" within the square brackets indicates that the Peak coordinates fully overlap the gene coordinates. For transcripts, an "F" within the square brackets indicates that the transcript coordinates fully overlap the gene coordinates, or vice versa.

TABLE 9: CATEGORIES OF PRC2-BINDING RNA, GENES TARGETED BY THE RNA, AND USES IN TREATMENT OF DISEASE

Column 1 shows the NCBI gene name and unique gene ID. Column 2 are the categories of functional groups of genes, and the diseases, disorders or conditions that are associated with these genes and can be treated by modulating their expression. Column 3 is the description of the gene from NCBI.

APPENDIX I, of U.S. provisional application 61/425,174 filed on Dec. 20, 2010, the entirety of which is incorporated by reference herein, is a listing of the complete RIP-seq dataset, showing all of the reads in the dataset. Appendix I is not attached hereto. The sequence reads in Appendix I come directly off the Illumina GA-II genome analyzer and are in an orientation that is the reverse complement of the PRC2-binding transcript. Appendix I is a filtered subset of all of the reads after bioinformatic filtering removed adaptor/primer dimers, mitochondrial RNA, rRNA, homopolymers, reads with indeterminate nucleotides, and truncated reads (<15 nt).

DETAILED DESCRIPTION

The RIP-seq technology described herein was used to capture a genome-wide pool of long transcripts (>200 nt) that bind with the PRC2 complex, directly or indirectly. The PRC2 transcriptome described herein consists of ~10,000 RNAs in mouse ES cells, likely accounting for 5-25% of expressed sequences in mice, depending on the actual size of the total mouse transcriptome. Transcriptome characterization has identified classes of medically significant targets, including dozens of imprinted loci, hundreds of oncogene and tumor suppressor loci, and multiple stem-cell-related domains, some of which may be used as biomarkers and therapeutics targets in the future. Many if not all of the mouse PRC2-transcripts have direct counterparts in the human epigenome.

As demonstrated herein, at least a subset of RNAs directly interacts with Polycomb proteins in vivo and, in many cases, the interacting subunit is Ezh2. A recent study indicates that Suz12 also interacts with RNA (Kanhere et al., 2010). Differences between bacterially- and baculovirus-produced subunits could result in varying post-translational modifications with effects on binding properties. However, it is likely that multiple subunits of PRC2 can be regulated by RNA (especially Ezh2 and Suz12, both of which have nucleic-acid binding motifs), which could modulate binding between PRC2 subunits, binding affinities of PRC2 for chromatin, and/or Ezh2 catalytic rates. This scenario would amplify the number of potential mechanisms by which RNA regulates Polycomb. The present study suggests thousands of RNA cofactors for Ezh2, the bait used for RIP-seq, specifically as part of the PRC2 complex. To the present inventors' knowledge, Ezh2 is only present in Polycomb complexes, as biochemical purification using tagged Ezh2 identifies only Polycomb-related peptides (Li et al., 2010) and knocking out other subunits of PRC2 results in rapid degradation of Ezh2 (Pasini et al., 2004; Montgomery et al., 2005; Schoeftner et al., 2006).

Both cis and trans mechanisms may be utilized by RNAs in the PRC2 transcriptome. While it has been postulated that HOTAIR works in trans (Rinn et al., 2007; Gupta et al.), the large number of antisense transcripts in the transcriptome suggests that many, like Tsix, may function by directing PRC2 to overlapping or linked coding loci in cis. Provided herein is the example of a linked RNA, Gtl2, which binds and targets PRC2 to Dlk1 locus to direct H3K27 trimethylation in cis.

The evidence presented herein demonstrates that RNA cofactors are a general feature of Polycomb regulation and that inhibitory nucleic acids as described herein that target RNA in the PRC2 transcriptome can successfully up-regulate gene expression, presumably by inhibiting PRC2-associated repression. Genes in cis, in either antisense-strand orientation or same strand orientation, and extending 1 kb or more from the location of the PRC2-binding RNA, can be regulated. Regulation by RNA need not be specific to Polycomb proteins. RIP-seq technology can be utilized to identify RNA cofactors for other chromatin modifiers, and different cell types might have distinct transcriptomes consistent with their developmental profiles. Because chromatin modifiers such as PRC2 play a central role in maintaining stem cell pluripotency and in cancer, a genome-wide profile of regulatory RNAs will be a valuable resource in the quest to diagnose and treat disease.

RIP-Seq—Methods of Producing Long Non-Coding RNAs

Described herein are methods for producing libraries of lncRNAs. These methods were used to identify RNAs that bind the Ezh2 portion of the PRC2 complex, but does not exclude contacts with other PRC2 subunits or associated proteins. In some embodiments, the methods include the steps shown in FIG. 1A; one of skill in the art will appreciate that other techniques can be substituted for those shown.

In some embodiments, the methods include providing a sample comprising nuclear ribonucleic acids ("nRNAs"), e.g., a sample comprising nuclear lysate, e.g., comprising nRNAs bound to nuclear proteins; contacting the sample with an agent, e.g., an antibody, that binds specifically to a nuclear protein that is known or suspected to bind to nuclear ribonucleic acids. Some examples of nuclear proteins that are known or suspected to bind to nuclear ribonucleic acids include Ezh2 (Zhao et al., Science. 2008 Oct. 31; 322(5902): 750-6; Khalil et al., Proc Natl Acad Sci USA. 2009 Jul. 14; 106(28):11667-72. Epub 2009 Jul. 1); G9a (Nagano et al., Science. 2008 Dec. 12; 322(5908):1717-20. Epub 2008 Nov. 6); and Cbx7 (Yap et al., Mol Cell. 2010 Jun. 11; 38(5):662-74.)

In some embodiments, the methods are applied under conditions sufficient to form complexes between the agent and the protein, and include some or all of the following: isolating the complexes; synthesizing DNA complementary to the nRNAs to provide an initial population of cDNAs; PCR-amplifying, if necessary, using strand-specific primers; purifying the initial population of cDNAs to obtain a purified population of cDNAs that are at least 20 nucleotides (nt) in length; and high-throughput sequencing the purified population of cDNAs. Homopolymer reads are filtered, and reads matching the mitochondrial genome and ribosomal RNAs are excluded from all subsequent analyses. Reads that align to a reference genome with ≤1 mismatch are retained, excluding homopolymers, reads that align to the mitochondrial genome, and ribosomal RNAs. High probability PRC2-interacting transcripts are then called based on two criteria: (1) that the candidate transcript has a minimum read density in RPKM terms (number of reads per kilobase per million reads); and/or (2) that the candidate transcript is enriched in the wildtype library versus a suitable control library (such as a protein-null library or library made from an IgG pulldown done in parallel).

In general, to construct RIP-seq libraries, cell nuclei are prepared, treated with DNAse, and incubated with antibodies directed against a chromatin-associated factor of interest, along with a control IgG reaction in parallel. RNA-protein complexes are then immunoprecipitated with agarose beads, magnetic beads, or any other platform in solution or on a solid matrix (e.g., columns, microfluidic devices). RNAs are extracted using standard techniques. To capture all RNAs (not just polyA RNAs) and to preserve strand information, asymmetric primers are used to generate cDNA from the RNA template, in which the first adaptor (adaptor1) to make the first strand cDNA contains a random multimer sequence (such as random hexamers) at the 3' end. A reverse transcriptase is used to create the first strand. A distinct second adaptor (adaptor2) is used to create the second strand. One example is as follows: If Superscript II is used, it will add non-template CCC 3' overhangs, which can then be used to hybridize to a second adaptor containing GGG at the 3' end, which anneal to the non-template CCC overhangs. Other methods of creating second strands may be substituted. PCR using adaptor1- and adaptor2-specific primer pairs is then the performed to amplify the cDNAs and the products sequenced via standard methods of high throughput sequencing. Prior to sequencing, a size-selection step can be incorporated (if desired) in which RNAs or cDNAs of desired sizes are excised after separation by gel electrophoresis (e.g., on a NuSieve agarose gel or in an acrylamide gel) or other methods of purification, such as in a microfluidic device or in standard biochemical columns.

lncRNAs and lncRNA Libraries

The present invention includes the individual lncRNAs described herein, as well as libraries of lncRNAs produced by methods described herein. In some embodiments, the libraries are in solution, or are lyophilized. In some embodiments, the libraries are bound to a substrate, e.g., wherein each member of the library is bound to an individually addressable member, e.g., an individual area on an array (e.g., a microarray), or a bead. The PRC2-interacting RNA transcript, although non-coding, may include a protein-coding sequence of bases if it is a distinct transcript that overlaps in position with a protein-coding reference gene (e.g. the gene whose expression is modulated in cis).

In one embodiment, a lncRNA includes a nucleotide sequence that is at least about 85% or more homologous or identical to the entire length of a lncRNA sequence shown herein, e.g., in Table 2, 3, 4, or 5, or a fragment comprising at least 20 nt thereof (e.g., at least 25, 30, 35, 40, 50, 60, 70, 80, 90, or 100 nt thereof, e.g., at least 5%, 10%, 15%, 20%, 25%, 30%, 35%, 40%, 50% or more of the full length lncRNA). In some embodiments, the nucleotide sequence is at least about 90%, 91%, 92%, 93%, 94%, 95%, 96%, 97%, 98%, 99% or 100% homologous or identical to a lncRNA sequence shown herein. In some embodiments, the nucleotide sequence is at least about 85%, e.g., is at least about 90%, 91%, 92%, 93%, 94%, 95%, 96%, 97%, 98%, 99% or 100% homologous or identical to a lncRNA sequence described herein, in a fragment thereof or a region that is much more conserved, such as Repeat A, but has lower sequence identity outside that region.

Mouse-to-human LiftOver analysis and analysis in the UCSC genome browser of syntenic positions indicate the existence of similar transcripts in the human genome. This process and LiftOver chains are generally described in Kent et al., *Proc. Nat'l Acad. Sci.*, 100(20) 11484-11489 (2003). Given the geographic and sequence similarities between the mouse and human transcripts, we believe that a similar number of PRC2-interacting transcripts occur in the human system. For example, the Pvt1 transcript described below is well conserved in humans. Human PVT1 also occurs near the MYC gene and has a similar expression profile. Human PVT1 is frequently interrupted in Plasmacytomas and can also be disrupted in Burkitt's lymphoma. Mouse Gtl2 and Xist are also well conserved in the human system (GTL2/MEG3 and XIST). Thus, the data suggest that many if not all of the mouse PRC2-transcripts have direct counterparts in the human epigenome. Such direct counterparts in other species are termed "orthologous" herein.

LncRNAs may be functionally conserved without being highly conserved at the level of overall nucleotide identity. For example, mouse Xist shows only 76% overall nucleotide identity with human XIST using sliding 21-bp windows, or an overall sequence identity of only 60%. However, within specific functional domains, such as Repeat A, the degree of conservation can be >70% between different mammalian species. The crucial motif in Repeat A is the secondary structures formed by the repeat. A lncRNA interacting with PRC2 may therefore be similarly low in overall conservation but still have conservation in secondary structure within specific domains of the RNA, and thereby demonstrate functional conservation with respect to recruitment of PRC2.

Calculations of homology or sequence identity between sequences (the terms are used interchangeably herein) are performed as follows.

To determine the percent identity of two nucleic acid sequences, the sequences are aligned for optimal comparison purposes (e.g., gaps can be introduced in one or both of a first and a second amino acid or nucleic acid sequence for optimal alignment and non-homologous sequences can be disregarded for comparison purposes). The length of a reference sequence aligned for comparison purposes is at least 80% of the length of the reference sequence, and in some embodiments is at least 90% or 100%. The nucleotides at corresponding amino acid positions or nucleotide positions are then compared. When a position in the first sequence is occupied by the same nucleotide as the corresponding position in the second sequence, then the molecules are identical at that position (as used herein nucleic acid "identity" is equivalent to nucleic acid "homology"). The percent identity between the two sequences is a function of the number of identical positions shared by the sequences, taking into account the number of gaps, and the length of each gap, which need to be introduced for optimal alignment of the two sequences.

For purposes of the present invention, the comparison of sequences and determination of percent identity between two sequences can be accomplished using a Blossum 62 scoring matrix with a gap penalty of 12, a gap extend penalty of 4, and a frameshift gap penalty of 5.

There are several potential uses for the lncRNAs described herein in the PRC2 transcriptome: The RNAs themselves, or antagomirs and small molecules designed against them, can be utilized to modulate expression (either up or down) of Polycomb target genes.

In various related aspects, including with respect to the targeting of long ncRNAs by LNA molecule, long ncRNAs can include endogenous cellular RNAs that are greater than 60 nt in length, e.g., greater than 100 nt, e.g., greater than 200 nt, have no positive-strand open reading frames greater than 100 amino acids in length, are identified as lncRNAs by experimental evidence, and are distinct from known (smaller) functional-RNA classes (including but not limited to ribosomal, transfer, and small nuclear/nucleolar RNAs, siRNA, piRNA, and miRNA). See, e.g., Lipovich et al., "MacroRNA underdogs in a microRNA world: Evolutionary, regulatory, and biomedical significance of mammalian long non-protein-coding RNA" Biochimica et Biophysica Acta (2010) doi: 10.1016/j.bbagrm.2010.10.001; Ponting et al., Cell 136(4): 629-641 (2009), Jia et al., RNA 16 (8) (2010) 1478-1487, Dinger et al., Nucleic Acids Res. 37 1685 (2009) D122-D126 (database issue); and references cited therein. LncRNAs have also been referred to as long RNA, large RNA, macro RNA, intergenic RNA, and NonCoding Transcripts.

The methods described herein can be used to target nuclear-localized lncRNAs. Known classes of lncRNAs include large intergenic non-coding RNAs (lincRNAs, see, e.g., Guttman et al., Nature. 2009 Mar. 12; 458(7235):223-7. Epub 2009 Feb. 1, which describes over a thousand exemplary highly conserved large non-coding RNAs in mammals; and Khalil et al., PNAS 106(28)11675-11680 (2009)); promoter associated short RNAs (PASRs; see, e.g., Seila et al., Science. 2008 Dec. 19; 322(5909):1849-51. Epub 2008 Dec. 4; Kanhere et al., Molecular Cell 38, 675-688, (2010)); endogenous antisense RNAs (see, e.g., Numata et al., BMC Genomics. 10:392 (2009); Okada et al., Hum Mol Genet. 17(11):1631-40 (2008); Numata et al., Gene 392(1-2):134-141 (2007); and Røsok and Sioud, Nat Biotechnol. 22(1): 104-8 (2004)); and RNAs that bind chromatin modifiers such as PRC2 and LSD1 (see, e.g., Tsai et al., Science. 2010 Aug. 6; 329(5992):689-93. Epub 2010 Jul. 8; and Zhao et al., Science. 2008 Oct. 31; 322(5902):750-6).

Exemplary lncRNAs include XIST, TSIX, MALAT1, RNCR2, and HOTAIR. The sequences for more than 17,000 long human ncRNAs can be found in the NCode™ Long ncRNA Database on the Invitrogen website. Additional long ncRNAs can be identified using, e.g., manual published literature, Functional Annotation of Mouse (FANTOM3) project, Human Full-length cDNA Annotation Invitational (H-Invitational) project, antisense ncRNAs from cDNA and EST database for mouse and human using a computation pipeline (Zhang et al., Nucl. Acids Res. 35 (suppl 1): D156-D161 (2006); Engstrom et al., PLoS Genet. 2:e47 (2006)), human snoRNAs and scaRNAs derived from snoRNA-LBME-db, RNAz (Washietl et al. 2005), Noncoding RNA Search (Torarinsson, et al. 2006), and EvoFold (Pedersen et al. 2006).

Methods of Modulating Gene Expression

The lncRNAs described herein, including fragments thereof that are at least 20 nt in length, and inhibitory nucleic acids and small molecules targeting (e.g., complementary to) them, can be used to modulate gene expression in a cell, e.g., a cancer cell, a stem cell, or other normal cell types for gene or epigenetic therapy. The cells can be in vitro, including ex vivo, or in vivo (e.g., in a subject who has cancer, e.g., a tumor).

The methods described herein can be used for modulating expression of oncogenes and tumor suppressors in cells, e.g., cancer cells. For example, to decrease expression of an oncogene in a cell, the methods include introducing into the cell a long non-coding RNA, including a PRC2-binding fragment thereof, that regulates the oncogene as set forth in Table 6, imprinted genes in Table 1, and/or other growth-promoting genes in Table 2.

As another example, to increase expression of a tumor suppressor in a cell, the methods include introducing into the cell an inhibitory nucleic acid or small molecule that specifically binds, or is complementary, to a long non-coding RNA targeting a tumor suppressor as set forth in Table 7, imprinted genes in Table 1, and/or other growth-suppressing genes in Table 2 (e.g., Nkx2-1 or Titf-1, e.g., in subjects with cancer, e.g., lung adenocarcinoma patients). In some embodiments, the methods include introducing into the cell an inhibitory nucleic acid that specifically binds, or is complementary, to a long non-coding RNA targeting an imprinted gene as set forth in Table 1. A nucleic acid that binds "specifically" binds primarily to the target lncRNA or related lncRNAs to inhibit regulatory function of the lncRNA but not of other non-target RNAs. The specificity of the nucleic acid interaction thus refers to its function (e.g. inhibiting the PRC2-associated repression of gene expression) rather than its hybridization capacity. Inhibitory nucleic acids may exhibit nonspecific binding to other sites in the genome or other mRNAs, without interfering with binding of other regulatory proteins and without causing degradation of the non-specifically-bound RNA. Thus this nonspecific binding does not significantly affect function of other non-target RNAs and results in no significant adverse effects.

These methods can be used to treat cancer in a subject, by administering to the subject a composition (e.g., as described herein) comprising an lncRNA (e.g., a lncRNA that inhibits a cancer-promoting oncogene or imprinted gene) or a PRC2-binding fragment thereof and/or an inhibitory nucleic acid that binds to a long non-coding RNA (e.g., an inhibitory nucleic acid that binds to a lncRNA that inhibits a tumor suppressor or cancer-suppressing imprinted gene and/or other growth-suppressing genes in Table 2). Examples of genes involved in cancer and categories of cancer are shown in Table 9. Examples of cellular proliferative and/or differentiative disorders include cancer, e.g., carcinoma, sarcoma, metastatic disorders or hematopoietic neoplastic disorders, e.g., leukemias. A metastatic tumor can arise from a multitude of primary tumor types, including but not limited to those of prostate, colon, lung, breast and liver origin.

As used herein, treating includes "prophylactic treatment" which means reducing the incidence of or preventing (or reducing risk of) a sign or symptom of a disease in a patient at risk for the disease, and "therapeutic treatment", which means reducing signs or symptoms of a disease, reducing progression of a disease, reducing severity of a disease, in a patient diagnosed with the disease. With respect to cancer, treating includes inhibiting tumor cell proliferation, increasing tumor cell death or killing, inhibiting rate of tumor cell growth or metastasis, reducing size of tumors, reducing number of tumors, reducing number of metastases, increasing 1-year or 5-year survival rate.

As used herein, the terms "cancer", "hyperproliferative" and "neoplastic" refer to cells having the capacity for autonomous growth, i.e., an abnormal state or condition characterized by rapidly proliferating cell growth. Hyperproliferative and neoplastic disease states may be categorized as pathologic, i.e., characterizing or constituting a disease state, or may be categorized as non-pathologic, i.e., a deviation from normal but not associated with a disease state. The term is meant to include all types of cancerous growths or oncogenic processes, metastatic tissues or malignantly transformed cells, tissues, or organs, irrespective of histopathologic type or stage of invasiveness. "Pathologic hyperproliferative" cells occur in disease states characterized by malignant tumor growth. Examples of non-pathologic hyperproliferative cells include proliferation of cells associated with wound repair.

The terms "cancer" or "neoplasms" include malignancies of the various organ systems, such as affecting lung (e.g. small cell, non-small cell, squamous, adenocarcinoma), breast, thyroid, lymphoid, gastrointestinal, genito-urinary tract, kidney, bladder, liver (e.g. hepatocellular cancer), pancreas, ovary, cervix, endometrium, uterine, prostate, brain, as well as adenocarcinomas which include malignancies such as most colon cancers, colorectal cancer, renal-cell carcinoma, prostate cancer and/or testicular tumors, non-small cell carcinoma of the lung, cancer of the small intestine and cancer of the esophagus.

The term "carcinoma" is art recognized and refers to malignancies of epithelial or endocrine tissues including respiratory system carcinomas, gastrointestinal system carcinomas, genitourinary system carcinomas, testicular carcinomas, breast carcinomas, prostatic carcinomas, endocrine system carcinomas, and melanomas. In some embodiments, the disease is renal carcinoma or melanoma. Exemplary carcinomas include those forming from tissue of the cervix, lung, prostate, breast, head and neck, colon and ovary. The term also includes carcinosarcomas, e.g., which include malignant tumors composed of carcinomatous and sarcomatous tissues. An "adenocarcinoma" refers to a carcinoma derived from glandular tissue or in which the tumor cells form recognizable glandular structures.

The term "sarcoma" is art recognized and refers to malignant tumors of mesenchymal derivation.

Additional examples of proliferative disorders include hematopoietic neoplastic disorders. As used herein, the term "hematopoietic neoplastic disorders" includes diseases involving hyperplastic/neoplastic cells of hematopoietic origin, e.g., arising from myeloid, lymphoid or erythroid lineages, or precursor cells thereof. Preferably, the diseases arise from poorly differentiated acute leukemias, e.g., erythroblastic leukemia and acute megakaryoblastic leukemia. Additional exemplary myeloid disorders include, but are not limited to, acute promyeloid leukemia (APML), acute myelogenous leukemia (AML) and chronic myelogenous leukemia (CML) (reviewed in Vaickus, L. (1991) *Crit Rev. in Oncol./Hemotol.* 11:267-97); lymphoid malignancies include, but are not limited to acute lymphoblastic leukemia (ALL) which includes B-lineage ALL and T-lineage ALL, chronic lymphocytic leukemia (CLL), prolymphocytic leukemia (PLL), hairy cell leukemia (HLL) and Waldenstrom's macroglobulinemia (WM). Additional forms of malignant lymphomas include, but are not limited to non-Hodgkin lymphoma and variants thereof, peripheral T cell lymphomas, adult T cell leukemia/lymphoma (ATL), cutaneous T-cell lymphoma (CTCL), large granular lymphocytic leukemia (LGF), Hodgkin's disease and Reed-Sternberg disease.

In some embodiments, specific cancers that can be treated using the methods described herein are listed in Table 6 or 9, for example, and include, but are not limited to: breast, lung, prostate, CNS (e.g., glioma), salivary gland, prostate, ovarian, and leukemias (e.g., ALL, CML, or AML). Associations of these genes with a particular cancer are known in the art, e.g., as described in Futreal et al., Nat Rev Cancer. 2004; 4; 177-83 (see, e.g., Table 1, incorporated by reference herein); and The COSMIC (Catalogue of Somatic Mutations in Cancer) database and website, Bamford et al., Br J Cancer. 2004; 91; 355-8; see also Forbes et al., Curr Protoc Hum Genet. 2008; Chapter 10; Unit 10.11, and the COSMIC database, e.g., v.50 (Nov. 30, 2010). It is understood that reference to any particular type of cancer in, for example, Table 6 or 9 means that patients with other types of cancer, i.e., cancer in general, may be treated.

In addition, the methods described herein can be used for modulating (e.g., enhancing or decreasing) pluripotency of a stem cell and to direct stem cells down specific differentiation pathways to make endoderm, mesoderm, ectoderm, and their developmental derivatives. To increase, maintain, or enhance pluripotency, the methods include introducing into the cell an inhibitory nucleic acid that specifically binds to, or is complementary to, a long non-coding RNA as set forth in Table 3. To decrease pluripotency or enhance differentiation of a stem cell, the methods include introducing into the cell a long non-coding RNA as set forth in Table 3. Stem cells useful in the methods described herein include adult stem cells (e.g., adult stem cells obtained from the inner ear, bone marrow, mesenchyme, skin, fat, liver, muscle, or blood of a subject, e.g., the subject to be treated); embryonic stem cells, or stem cells obtained from a placenta or umbilical cord; progenitor cells (e.g., progenitor cells derived from the inner ear, bone marrow, mesenchyme, skin, fat, liver, muscle, or blood); and induced pluripotent stem cells (e.g., iPS cells).

In some embodiments, the methods described herein include administering a composition, e.g., a sterile composition, comprising an inhibitory nucleic acid that is complementary to an lncRNA described herein, e.g., as set forth in Table 1, 2, 3, 6, or 7, or Table 8. Inhibitory nucleic acids for use in practicing the methods described herein can be an antisense or small interfering RNA, including but not limited to an shRNA or siRNA. In some embodiments, the inhibitory nucleic acid is a modified nucleic acid polymer (e.g., a locked nucleic acid (LNA) molecule).

Inhibitory nucleic acids have been employed as therapeutic moieties in the treatment of disease states in animals, including humans. Inhibitory nucleic acids can be useful therapeutic modalities that can be configured to be useful in treatment regimes for the treatment of cells, tissues and animals, especially humans.

For therapeutics, an animal, preferably a human, suspected of having cancer is treated by administering an lncRNA or inhibitory nucleic acid in accordance with this invention. For example, in one non-limiting embodiment, the methods comprise the step of administering to the animal in need of treatment, a therapeutically effective amount of an lncRNA or inhibitory nucleic acid as described herein.

Inhibitory Nucleic Acids

Inhibitory nucleic acids useful in the present methods and compositions include antisense oligonucleotides, ribozymes, external guide sequence (EGS) oligonucleotides, siRNA compounds, single- or double-stranded RNA interference (RNAi) compounds such as siRNA compounds, molecules comprising modified bases, locked nucleic acid molecules (LNA molecules), antagomirs, peptide nucleic acid molecules (PNA molecules), and other oligomeric compounds or oligonucleotide mimetics which hybridize to at least a portion of the target nucleic acid and modulate its function. In some embodiments, the inhibitory nucleic acids include antisense RNA, antisense DNA, chimeric antisense oligonucleotides, antisense oligonucleotides comprising modified linkages, interference RNA (RNAi), short interfering RNA (siRNA); a micro, interfering RNA (miRNA); a small, temporal RNA (stRNA); or a short, hairpin RNA (shRNA); small RNA-induced gene activation (RNAa); small activating RNAs (saRNAs), or combinations thereof. See, e.g., WO 2010040112.

In some embodiments, the inhibitory nucleic acids are 10 to 50, 13 to 50, or 13 to 30 nucleotides in length. One having ordinary skill in the art will appreciate that this embodies oligonucleotides having antisense (complementary) portions of 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides in length, or any range therewithin. It is understood that non-complementary bases may be included in such inhibitory nucleic acids; for example, an inhibitory nucleic acid 30 nucleotides in length may have a portion of 15 bases that is complementary to the targeted RNA. In some embodiments, the oligonucleotides are 15 nucleotides in length. In some embodiments, the antisense or oligonucleotide compounds of the invention are 12 or 13 to 30 nucleotides in length. One having ordinary skill in the art will appreciate that this embodies inhibitory nucleic acids having antisense (complementary) portions of 12, 13, 14, 15, 16, 17, 18, 19, 20, 21, 22, 23, 24, 25, 26, 27, 28, 29 or 30 nucleotides in length, or any range therewithin.

Preferably the inhibitory nucleic acid comprises one or more modifications comprising: a modified sugar moiety, and/or a modified internucleoside linkage, and/or a modified nucleotide and/or combinations thereof. It is not necessary for all positions in a given oligonucleotide to be uniformly modified, and in fact more than one of the modifications described herein may be incorporated in a single oligonucleotide or even at within a single nucleoside within an oligonucleotide.

In some embodiments, the inhibitory nucleic acids are chimeric oligonucleotides that contain two or more chemically distinct regions, each made up of at least one nucleotide. These oligonucleotides typically contain at least one region of modified nucleotides that confers one or more beneficial properties (such as, for example, increased nuclease resistance, increased uptake into cells, increased binding affinity for the target) and a region that is a substrate for enzymes capable of cleaving RNA:DNA or RNA:RNA hybrids. Chimeric inhibitory nucleic acids of the invention may be formed as composite structures of two or more oligonucleotides, modified oligonucleotides, oligonucleosides and/or oligonucleotide mimetics as described above. Such compounds have also been referred to in the art as hybrids or gapmers. Representative United States patents that teach the preparation of such hybrid structures comprise, but are not limited to, U.S. Pat. Nos. 5,013,830; 5,149,797; 5,220,007; 5,256,775; 5,366,878; 5,403,711; 5,491,133; 5,565,350; 5,623,065; 5,652,355; 5,652,356; and 5,700,922, each of which is herein incorporated by reference.

In some embodiments, the inhibitory nucleic acid comprises at least one nucleotide modified at the 2' position of the sugar, most preferably a 2'-O-alkyl, 2'-O-alkyl-O-alkyl or 2'-fluoro-modified nucleotide. In other preferred embodiments, RNA modifications include 2'-fluoro, 2'-amino and 2' O-methyl modifications on the ribose of pyrimidines, abasic residues or an inverted base at the 3' end of the RNA. Such modifications are routinely incorporated into oligonucleotides and these oligonucleotides have been shown to have a higher Tm (i.e., higher target binding affinity) than; 2'-deoxyoligonucleotides against a given target.

A number of nucleotide and nucleoside modifications have been shown to make the oligonucleotide into which they are incorporated more resistant to nuclease digestion than the native oligodeoxynucleotide; these modified oligos survive intact for a longer time than unmodified oligonucleotides. Specific examples of modified oligonucleotides include those comprising modified backbones, for example, phosphorothioates, phosphotriesters, methyl phosphonates, short chain alkyl or cycloalkyl intersugar linkages or short chain heteroatomic or heterocyclic intersugar linkages. Most preferred are oligonucleotides with phosphorothioate backbones and those with heteroatom backbones, particularly CH2-NH—O—CH2, CH,~N(CH3)~O~CH2 (known as a methylene(methylimino) or MMI backbone], CH2-O—N (CH3)-CH2, CH2-N(CH3)-N (CH3)-CH2 and O—N (CH3)-CH2-CH2 backbones, wherein the native phosphodiester backbone is represented as O—P—O—CH,); amide backbones (see De Mesmaeker et al. Ace. Chem. Res. 1995, 28:366-374); morpholino backbone structures (see Summerton and Weller, U.S. Pat. No. 5,034,506); peptide nucleic acid (PNA) backbone (wherein the phosphodiester backbone of the oligonucleotide is replaced with a polyamide backbone, the nucleotides being bound directly or indirectly to the aza nitrogen atoms of the polyamide backbone, see Nielsen et al., Science 1991, 254, 1497). Phosphorus-containing linkages include, but are not limited to, phosphorothioates, chiral phosphorothioates, phosphorodithioates, phosphotriesters, aminoalkylphosphotriesters, methyl and other alkyl phosphonates comprising 3'alkylene phosphonates and chiral phosphonates, phosphinates, phosphoramidates comprising 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2; see U.S. Pat. Nos. 3,687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455, 233; 5,466,677; 5,476,925; 5,519,126; 5,536,821; 5,541,306; 5,550,111; 5,563, 253; 5,571,799; 5,587,361; and 5,625,050.

Morpholino-based oligomeric compounds are described in Dwaine A. Braasch and David R. Corey, Biochemistry, 2002, 41(14), 4503-4510); Genesis, volume 30, issue 3, 2001; Heasman, J., Dev. Biol., 2002, 243, 209-214; Nasevicius et al., Nat. Genet., 2000, 26, 216-220; Lacerra et al., Proc. Natl. Acad. Sci., 2000, 97, 9591-9596; and U.S. Pat. No. 5,034, 506, issued Jul. 23, 1991. In some embodiments, the morpholino-based oligomeric compound is a phosphorodiamidate morpholino oligomer (PMO) (e.g., as described in Iverson, Curr. Opin. Mol. Ther., 3:235-238, 2001; and Wang et al., J. Gene Med., 12:354-364, 2010; the disclosures of which are incorporated herein by reference in their entireties).

Cyclohexenyl nucleic acid oligonucleotide mimetics are described in Wang et al., J. Am. Chem. Soc., 2000, 122, 8595-8602.

Modified oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These comprise those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and CH2 component parts; see U.S. Pat. Nos. 5,034,506; 5,166,315; 5,185,444; 5,214,134; 5,216,141; 5,235,033; 5,264,562; 5,264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; and 5,677,439, each of which is herein incorporated by reference.

Modified oligonucleotides are also known that include oligonucleotides that are based on or constructed from arabinonucleotide or modified arabinonucleotide residues. Arabinonucleosides are stereoisomers of ribonucleosides, differing only in the configuration at the 2'-position of the sugar ring. In some embodiments, a 2'-arabino modification is 2'-F arabino. In some embodiments, the modified oligonucleotide is 2'-fluoro-D-arabinonucleic acid (FANA) (as described in, for example, Lon et al., Biochem., 41:3457-3467, 2002 and Min et al., Bioorg. Med. Chem. Lett., 12:2651-2654, 2002; the disclosures of which are incorporated herein by reference in their entireties). Similar modifications can also be made at other positions on the sugar, particularly the 3' position of the sugar on a 3' terminal nucleoside or in 2'-5' linked oligonucleotides and the 5' position of 5' terminal nucleotide.

PCT Publication No. WO 99/67378 discloses arabinonucleic acids (ANA) oligomers and their analogues for improved sequence specific inhibition of gene expression via association to complementary messenger RNA.

Other preferred modifications include ethylene-bridged nucleic acids (ENAs) (e.g., International Patent Publication No. WO 2005/042777, Morita et al., Nucleic Acid Res., Suppl 1:241-242, 2001; Surono et al., Hum. Gene Ther., 15:749-757, 2004; Koizumi, Curr. Opin. Mol. Ther., 8:144-149, 2006 and Horie et al., Nucleic Acids Symp. Ser (Oxf), 49:171-172, 2005; the disclosures of which are incorporated herein by reference in their entireties). Preferred ENAs include, but are not limited to, 2'-O,4'-C-ethylene-bridged nucleic acids.

Examples of LNAs are described in WO/2008/043753 and include compounds of the following formula.

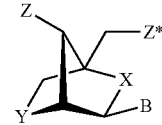

where X and Y are independently selected among the groups —O—,
—S—, —N(H)—, N(R)—, —CH2- or —CH— (if part of a double bond),
—CH$_2$—O—, —CH$_2$—S—, —CH$_2$—N(H)—, —CH$_2$—N(R)—, —CH$_2$—CH$_2$— or —CH$_2$—CH— (if part of a double bond),
—CH═CH—, where R is selected from hydrogen and C$_{1-4}$-alkyl; Z and Z* are independently selected among an internucleoside linkage, a terminal group or a protecting group; B constitutes a natural or non-natural nucleotide base moiety; and the asymmetric groups may be found in either orientation.

Preferably, the LNA used in the oligomer of the invention comprises at least one LNA unit according any of the formulas

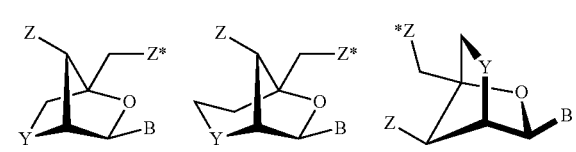

wherein Y is —O—, —S—, —NH—, or N(R$^H$); Z and Z* are independently selected among an internucleoside linkage, a terminal group or a protecting group; B constitutes a natural or non-natural nucleotide base moiety, and RH is selected from hydrogen and $C_{1-4}$-alkyl.

Preferably, the Locked Nucleic Acid (LNA) used in the oligomeric compound, such as an antisense oligonucleotide, of the invention comprises at least one nucleotide comprises a Locked Nucleic Acid (LNA) unit according any of the formulas shown in Scheme 2 of PCT/DK2006/000512.

Preferably, the LNA used in the oligomer of the invention comprises internucleoside linkages selected from —O—P(O)$_2$—O—, —O—P(O,S)—O—, —O—P(S)$_2$—O—, —S—P(O)$_2$—O—, —S—P(O,S)—O—, —S—P(S)$_2$—O—, —O—P(O)$_2$—S—, —O—P(O,S)—S—, —S—P(O)$_2$—S—, —O—PO(R$^H$)—O—, O—PO(OCH$_3$)—O—, —O—PO(NR$^H$)—O—, -0-PO(OCH$_2$CH$_2$S—R)—O—, —O—PO(BH$_3$)—O—, —O—PO(NHR$^H$)—O—, —O—P(O)$_2$—NR$^H$—, —NR$^H$—P(O)$_2$—O—, —NR$^H$—CO—O—, where R$^H$ is selected from hydrogen and $C_{1-4}$-alkyl.

Specifically preferred LNA units are shown in scheme 2:

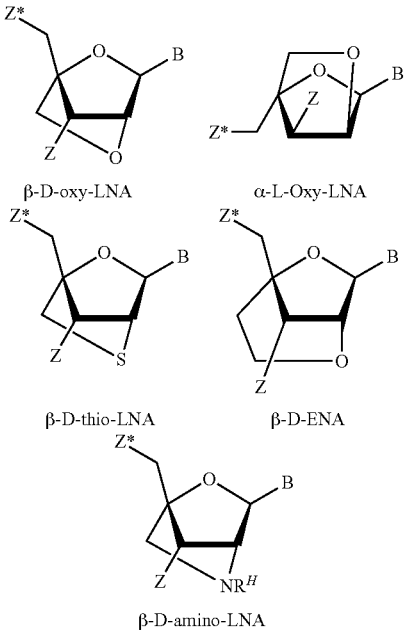

Scheme 2

β-D-oxy-LNA  α-L-Oxy-LNA
β-D-thio-LNA  β-D-ENA
β-D-amino-LNA

The term "thio-LNA" comprises a locked nucleotide in which at least one of X or Y in the general formula above is selected from S or —CH2-S—. Thio-LNA can be in both beta-D and alpha-L-configuration.

The term "amino-LNA" comprises a locked nucleotide in which at least one of X or Y in the general formula above is selected from —N(H)—, N(R)—, CH$_2$—N(H)—, and —CH$_2$—N(R)— where R is selected from hydrogen and $C_{1-4}$-alkyl. Amino-LNA can be in both beta-D and alpha-L-configuration.

The term "oxy-LNA" comprises a locked nucleotide in which at least one of X or Y in the general formula above represents —O— or —CH$_2$—O—. Oxy-LNA can be in both beta-D and alpha-L-configuration.

The term "ena-LNA" comprises a locked nucleotide in which Y in the general formula above is —CH$_2$—O— (where the oxygen atom of —CH$_2$—O— is attached to the 2'-position relative to the base B).

LNAs are described in additional detail below.

One or more substituted sugar moieties can also be included, e.g., one of the following at the 2' position: OH, SH, SCH$_3$, F, OCN, OCH$_3$OCH$_3$, OCH$_3$O(CH$_2$)nCH$_3$, O(CH$_2$)nNH$_2$ or O(CH$_2$)nCH$_3$ where n is from 1 to about 10; Ci to C10 lower alkyl, alkoxyalkoxy, substituted lower alkyl, alkaryl or aralkyl; Cl; Br; CN; CF3; OCF3; O-, S-, or N-alkyl; O-, S-, or N-alkenyl; SOCH3; SO2 CH3; ONO2; NO2; N3; NH2; heterocycloalkyl; heterocycloalkaryl; aminoalkylamino; polyalkylamino; substituted silyl; an RNA cleaving group; a reporter group; an intercalator; a group for improving the pharmacokinetic properties of an oligonucleotide; or a group for improving the pharmacodynamic properties of an oligonucleotide and other substituents having similar properties. A preferred modification includes 2'-methoxyethoxy[2'-0-CH$_2$CH$_2$OCH$_3$, also known as 2'-O-(2-methoxyethyl)] (Martin et al, Helv. Chim. Acta, 1995, 78, 486). Other preferred modifications include 2'-methoxy (2'-0-CH$_3$), 2'-propoxy (2'-OCH$_2$CH$_2$CH$_3$) and 2'-fluoro (2'-F). Similar modifications may also be made at other positions on the oligonucleotide, particularly the 3' position of the sugar on the 3' terminal nucleotide and the 5' position of 5' terminal nucleotide. Oligonucleotides may also have sugar mimetics such as cyclobutyls in place of the pentofuranosyl group.

Inhibitory nucleic acids can also include, additionally or alternatively, nucleobase (often referred to in the art simply as "base") modifications or substitutions. As used herein, "unmodified" or "natural" nucleobases include adenine (A), guanine (G), thymine (T), cytosine (C) and uracil (U). Modified nucleobases include nucleobases found only infrequently or transiently in natural nucleic acids, e.g., hypoxanthine, 6-methyladenine, 5-Me pyrimidines, particularly 5-methylcytosine (also referred to as 5-methyl-2' deoxycytosine and often referred to in the art as 5-Me-C), 5-hydroxymethylcytosine (HMC), glycosyl HMC and gentobiosyl HMC, isocytosine, pseudoisocytosine, as well as synthetic nucleobases, e.g., 2-aminoadenine, 2-(methylamino)adenine, 2-(imidazolylalkyl)adenine, 2-(aminoalkylamino)adenine or other heterosubstituted alkyladenines, 2-thiouracil, 2-thiothymine, 5-bromouracil, 5-hydroxymethyluracil, 5-propynyluracil, 8-azaguanine, 7-deazaguanine, N6 (6-aminohexyl)adenine, 6-aminopurine, 2-aminopurine, 2-chloro-6-aminopurine and 2,6-diaminopurine or other diaminopurines. See, e.g., Kornberg, "DNA Replication," W. H. Freeman & Co., San Francisco, 1980, pp 75-77; and Gebeyehu, G., et al. Nucl. Acids Res., 15:4513 (1987)). A "universal" base known in the art, e.g., inosine, can also be included. 5-Me-C substitutions have been shown to increase nucleic acid duplex stability by 0.6-1.2<0>C. (Sanghvi, in Crooke, and Lebleu, eds., Antisense Research and Applications, CRC Press, Boca Raton, 1993, pp. 276-278) and are presently preferred base substitutions.

It is not necessary for all positions in a given oligonucleotide to be uniformly modified, and in fact more than one of the modifications described herein may be incorporated in a single oligonucleotide or even at within a single nucleoside within an oligonucleotide.

In some embodiments, both a sugar and an internucleoside linkage, i.e., the backbone, of the nucleotide units are replaced with novel groups. The base units are maintained for hybridization with an appropriate nucleic acid target compound. One such oligomeric compound, an oligonucleotide mimetic that has been shown to have excellent hybridization properties, is referred to as a peptide nucleic acid (PNA). In PNA compounds, the sugar-backbone of an oligonucleotide is replaced with an amide containing backbone, for example, an aminoethylglycine backbone. The nucleobases are retained and are bound directly or indirectly to aza nitrogen atoms of the amide portion of the backbone. Representative United States patents that teach the preparation of PNA compounds include, but are not limited to, U.S. Pat. Nos. 5,539, 082; 5,714,331; and 5,719,262, each of which is herein incorporated by reference. Further teaching of PNA compounds can be found in Nielsen et al, Science, 1991, 254, 1497-1500.

Inhibitory nucleic acids can also include one or more nucleobase (often referred to in the art simply as "base") modifications or substitutions. As used herein, "unmodified" or "natural" nucleobases comprise the purine bases adenine (A) and guanine (G), and the pyrimidine bases thymine (T), cytosine (C) and uracil (U). Modified nucleobases comprise other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudo-uracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylquanine and 7-methyladenine, 8-azaguanine and 8-azaadenine, 7-deazaguanine and 7-deazaadenine and 3-deazaguanine and 3-deazaadenine.

Further, nucleobases comprise those disclosed in U.S. Pat. No. 3,687,808, those disclosed in "The Concise Encyclopedia of Polymer Science And Engineering", pages 858-859, Kroschwitz, ed. John Wiley & Sons, 1990; those disclosed by Englisch et al., Angewandle Chemie, International Edition, 1991, 30, page 613, and those disclosed by Sanghvi, Chapter 15, Antisense Research and Applications," pages 289-302, Crooke, and Lebleu, eds., CRC Press, 1993. Certain of these nucleobases are particularly useful for increasing the binding affinity of the oligomeric compounds of the invention. These include 5-substituted pyrimidines, 6-azapyrimidines and N-2, N-6 and 0-6 substituted purines, comprising 2-aminopropyladenine, 5-propynyluracil and 5-propynylcytosine. 5-methylcytosine substitutions have been shown to increase nucleic acid duplex stability by 0.6-1.2<0>C (Sanghvi, et al., eds, "Antisense Research and Applications," CRC Press, Boca Raton, 1993, pp. 276-278) and are presently preferred base substitutions, even more particularly when combined with 2'-O-methoxyethyl sugar modifications. Modified nucleobases are described in U.S. Pat. No. 3,687,808, as well as U.S. Pat. Nos. 4,845,205; 5,130,302; 5,134,066; 5,175, 273; 5,367,066; 5,432,272; 5,457,187; 5,459,255; 5,484,908; 5,502,177; 5,525,711; 5,552,540; 5,587,469; 5,596,091; 5,614,617; 5,750,692, and 5,681,941, each of which is herein incorporated by reference.

In some embodiments, the inhibitory nucleic acids are chemically linked to one or more moieties or conjugates that enhance the activity, cellular distribution, or cellular uptake of the oligonucleotide. For example, one or more inhibitory nucleic acids, of the same or different types, can be conjugated to each other; or inhibitory nucleic acids can be conjugated to targeting moieties with enhanced specificity for a cell type or tissue type. Such moieties include, but are not limited to, lipid moieties such as a cholesterol moiety (Letsinger et al., Proc. Natl. Acad. Sci. USA, 1989, 86, 6553-6556), cholic acid (Manoharan et al., Bioorg. Med. Chem. Let., 1994, 4, 1053-1060), a thioether, e.g., hexyl-S-tritylthiol (Manoharan et al, Ann. N. Y. Acad. Sci., 1992, 660, 306-309; Manoharan et al., Bioorg. Med. Chem. Let., 1993, 3, 2765-2770), a thiocholesterol (Oberhauser et al., Nucl. Acids Res., 1992, 20, 533-538), an aliphatic chain, e.g., dodecandiol or undecyl residues (Kabanov et al., FEBS Lett., 1990, 259, 327-330; Svinarchuk et al., Biochimie, 1993, 75, 49-54), a phospholipid, e.g., di-hexadecyl-rac-glycerol or triethylammonium 1,2-di-O-hexadecyl-rac-glycero-3-H-phosphonate (Manoharan et al., Tetrahedron Lett., 1995, 36, 3651-3654; Shea et al., Nucl. Acids Res., 1990, 18, 3777-3783), a polyamine or a polyethylene glycol chain (Mancharan et al., Nucleosides & Nucleotides, 1995, 14, 969-973), or adamantane acetic acid (Manoharan et al., Tetrahedron Lett., 1995, 36, 3651-3654), a palmityl moiety (Mishra et al., Biochim. Biophys. Acta, 1995, 1264, 229-237), or an octadecylamine or hexylaminocarbonyl-t oxycholesterol moiety (Crooke et al., J. Pharmacol. Exp. Ther., 1996, 277, 923-937). See also U.S. Pat. Nos. 4,828,979; 4,948,882; 5,218,105; 5,525,465; 5,541,313; 5,545,730; 5,552, 538; 5,578,717, 5,580,731; 5,580,731; 5,591,584; 5,109,124; 5,118,802; 5,138,045; 5,414,077; 5,486, 603; 5,512,439; 5,578,718; 5,608,046; 4,587,044; 4,605,735; 4,667,025; 4,762, 779; 4,789,737; 4,824,941; 4,835,263; 4,876,335; 4,904,582; 4,958,013; 5,082, 830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391, 723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599, 928 and 5,688,941, each of which is herein incorporated by reference.

These moieties or conjugates can include conjugate groups covalently bound to functional groups such as primary or secondary hydroxyl groups. Conjugate groups of the invention include intercalators, reporter molecules, polyamines, polyamides, polyethylene glycols, polyethers, groups that enhance the pharmacodynamic properties of oligomers, and groups that enhance the pharmacokinetic properties of oligomers. Typical conjugate groups include cholesterols, lipids, phospholipids, biotin, phenazine, folate, phenanthridine, anthraquinone, acridine, fluoresceins, rhodamines, coumarins, and dyes. Groups that enhance the pharmacodynamic properties, in the context of this invention, include groups that improve uptake, enhance resistance to degradation, and/or strengthen sequence-specific hybridization with the target nucleic acid. Groups that enhance the pharmacokinetic properties, in the context of this invention, include groups that improve uptake, distribution, metabolism or excretion of the compounds of the present invention. Representative conjugate groups are disclosed in International Patent Application No. PCT/US92/09196, filed Oct. 23, 1992, and U.S. Pat. No. 6,287,860, which are incorporated herein by reference. Conjugate moieties include, but are not limited to, lipid moieties such as a cholesterol moiety, cholic acid, a thioether, e.g., hexyl-5-tritylthiol, a thiocholesterol, an aliphatic chain, e.g., dodecandiol or undecyl residues, a phospholipid, e.g., di-hexadecyl-rac-glycerol or triethylammonium 1,2-di-O-hexadecyl-rac-glycero-3-H-phosphonate, a polyamine or a polyethylene glycol chain, or adamantane acetic acid, a palmityl moiety, or an octadecylamine or hexylamino-carbonyl-oxy cholesterol moiety. See, e.g., U.S. Pat. Nos. 4,828,979; 4,948, 882; 5,218,105; 5,525,465; 5,541,313; 5,545,730; 5,552,538; 5,578,717, 5,580,731; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391,723; 5,416,203, 5,451,463; 5,510,475;

5,512,667; 5,514,785; 5,565,552; 5,567,810; 5,574,142; 5,585,481; 5,587,371; 5,595,726; 5,597,696; 5,599,923; 5,599,928 and 5,688,941.

The inhibitory nucleic acids useful in the present methods are sufficiently complementary to the target lncRNA, e.g., hybridize sufficiently well and with sufficient biological functional specificity, to give the desired effect. "Complementary" refers to the capacity for pairing, through base stacking and specific hydrogen bonding, between two sequences comprising naturally or non-naturally occurring (e.g., modified as described above) bases (nucleosides) or analogs thereof. For example, if a base at one position of an inhibitory nucleic acid is capable of hydrogen bonding with a base at the corresponding position of a lncRNA, then the bases are considered to be complementary to each other at that position. 100% complementarity is not required. As noted above, inhibitory nucleic acids can comprise universal bases, or inert abasic spacers that provide no positive or negative contribution to hydrogen bonding. Base pairings may include both canonical Watson-Crick base pairing and non-Watson-Crick base pairing (e.g., Wobble base pairing and Hoogsteen base pairing). It is understood that for complementary base pairings, adenosine-type bases (A) are complementary to thymidine-type bases (T) or uracil-type bases (U), that cytosine-type bases (C) are complementary to guanosine-type bases (G), and that universal bases such as 3-nitropyrrole or 5-nitroindole can hybridize to and are considered complementary to any A, C, U, or T. Nichols et al., Nature, 1994; 369:492-493 and Loakes et al., Nucleic Acids Res., 1994; 22:4039-4043. Inosine (I) has also been considered in the art to be a universal base and is considered complementary to any A, C, U or T. See Watkins and SantaLucia, Nucl. Acids Research, 2005; 33 (19): 6258-6267.

In some embodiments, the location on a target lncRNA to which an inhibitory nucleic acids hybridizes is defined as a target region to which a protein binding partner binds. These regions can be identified by reviewing the data submitted herewith in Appendix I and identifying regions that are enriched in the dataset; these regions are likely to include the protein binding sequences. The identification of such regions, termed Peaks, is described in Example 8 below. Routine methods can be used to design an inhibitory nucleic acid that binds to this sequence with sufficient specificity. In some embodiments, the methods include using bioinformatics methods known in the art to identify regions of secondary structure, e.g., one, two, or more stem-loop structures, or pseudoknots, and selecting those regions to target with an inhibitory nucleic acid.

While the specific sequences of certain exemplary target segments are set forth herein, one of skill in the art will recognize that these serve to illustrate and describe particular embodiments within the scope of the present invention. Additional target segments are readily identifiable by one having ordinary skill in the art in view of this disclosure. Target segments 5-500 nucleotides in length comprising a stretch of at least five (5) consecutive nucleotides within the protein binding region, or immediately adjacent thereto, are considered to be suitable for targeting as well. Target segments can include sequences that comprise at least the 5 consecutive nucleotides from the 5'-terminus of one of the protein binding regions (the remaining nucleotides being a consecutive stretch of the same RNA beginning immediately upstream of the 5'-terminus of the binding segment and continuing until the inhibitory nucleic acid contains about 5 to about 100 nucleotides). Similarly preferred target segments are represented by RNA sequences that comprise at least the 5 consecutive nucleotides from the 3'-terminus of one of the illustrative preferred target segments (the remaining nucleotides being a consecutive stretch of the same lncRNA beginning immediately downstream of the 3'-terminus of the target segment and continuing until the inhibitory nucleic acid contains about 5 to about 100 nucleotides). One having skill in the art armed with the sequences provided herein will be able, without undue experimentation, to identify further preferred protein binding regions to target with complementary inhibitory nucleic acids.

In the context of the present disclosure, hybridization means base stacking and hydrogen bonding, which may be Watson-Crick, Hoogsteen or reversed Hoogsteen hydrogen bonding, between complementary nucleoside or nucleotide bases. For example, adenine and thymine are complementary nucleobases which pair through the formation of hydrogen bonds. Complementary, as the term is used in the art, refers to the capacity for precise pairing between two nucleotides. For example, if a nucleotide at a certain position of an oligonucleotide is capable of hydrogen bonding with a nucleotide at the same position of a lncRNA molecule, then the inhibitory nucleic acid and the lncRNA are considered to be complementary to each other at that position. The inhibitory nucleic acids and the lncRNA are complementary to each other when a sufficient number of corresponding positions in each molecule are occupied by nucleotides that can hydrogen bond with each other through their bases. Thus, "specifically hybridizable" and "complementary" are terms which are used to indicate a sufficient degree of complementarity or precise pairing such that stable and specific binding occurs between the inhibitory nucleic acid and the lncRNA target. For example, if a base at one position of an inhibitory nucleic acid is capable of hydrogen bonding with a base at the corresponding position of a lncRNA, then the bases are considered to be complementary to each other at that position. 100% complementarity is not required.

It is understood in the art that a complementary nucleic acid sequence need not be 100% complementary to that of its target nucleic acid to be specifically hybridizable. A complementary nucleic acid sequence for purposes of the present methods is specifically hybridizable when binding of the sequence to the target lncRNA molecule interferes with the normal function of the target lncRNA to cause a loss of activity (e g, inhibiting PRC2-associated repression with consequent up-regulation of gene expression) and there is a sufficient degree of complementarity to avoid non-specific binding of the sequence to non-target lncRNA sequences under conditions in which avoidance of non-specific binding is desired, e.g., under physiological conditions in the case of in vivo assays or therapeutic treatment, and in the case of in vitro assays, under conditions in which the assays are performed under suitable conditions of stringency. For example, stringent salt concentration will ordinarily be less than about 750 mM NaCl and 75 mM trisodium citrate, preferably less than about 500 mM NaCl and 50 mM trisodium citrate, and more preferably less than about 250 mM NaCl and 25 mM trisodium citrate. Low stringency hybridization can be obtained in the absence of organic solvent, e.g., formamide, while high stringency hybridization can be obtained in the presence of at least about 35% formamide, and more preferably at least about 50% formamide. Stringent temperature conditions will ordinarily include temperatures of at least about 30° C., more preferably of at least about 37° C., and most preferably of at least about 42° C. Varying additional parameters, such as hybridization time, the concentration of detergent, e.g., sodium dodecyl sulfate (SDS), and the inclusion or exclusion of carrier DNA, are well known to those skilled in the art. Various levels of stringency are accomplished by combining these various conditions as needed. In a preferred embodiment, hybridization will occur at 30° C. in 750 mM NaCl, 75 mM trisodium citrate, and 1% SDS. In a more preferred embodiment, hybridization will occur at 37° C. in 500 mM NaCl, 50 mM trisodium citrate, 1% SDS, 35% formamide, and 100 µg/ml denatured salmon sperm DNA (ssDNA). In a most preferred embodiment, hybridization will occur at 42° C. in 250 mM NaCl, 25 mM trisodium citrate, 1% SDS, 50% formamide, and 200 µg/ml ssDNA. Useful variations on these conditions will be readily apparent to those skilled in the art.

For most applications, washing steps that follow hybridization will also vary in stringency. Wash stringency conditions can be defined by salt concentration and by temperature. As above, wash stringency can be increased by decreasing salt concentration or by increasing temperature. For example, stringent salt concentration for the wash steps will preferably be less than about 30 mM NaCl and 3 mM trisodium citrate, and most preferably less than about 15 mM NaCl and 1.5 mM trisodium citrate. Stringent temperature conditions for the wash steps will ordinarily include a temperature of at least about 25° C., more preferably of at least about 42° C., and even more preferably of at least about 68° C. In a preferred embodiment, wash steps will occur at 25° C. in 30 mM NaCl, 3 mM trisodium citrate, and 0.1% SDS. In a more preferred embodiment, wash steps will occur at 42° C. in 15 mM NaCl, 1.5 mM trisodium citrate, and 0.1% SDS. In a more preferred embodiment, wash steps will occur at 68° C. in 15 mM NaCl, 1.5 mM trisodium citrate, and 0.1% SDS. Additional variations on these conditions will be readily apparent to those skilled in the art. Hybridization techniques are well known to those skilled in the art and are described, for example, in Benton and Davis (Science 196:180, 1977); Grunstein and Hogness (Proc. Natl. Acad. Sci., USA 72:3961, 1975); Ausubel et al. (Current Protocols in Molecular Biology, Wiley Interscience, New York, 2001); Berger and Kimmel (Guide to Molecular Cloning Techniques, 1987, Academic Press, New York); and Sambrook et al., Molecular Cloning: A Laboratory Manual, Cold Spring Harbor Laboratory Press, New York.

In general, the inhibitory nucleic acids useful in the methods described herein have at least 80% sequence complementarity to a target region within the target nucleic acid, e.g., 90%, 95%, or 100% sequence complementarity to the target region within an lncRNA. For example, an antisense compound in which 18 of 20 nucleobases of the antisense oligonucleotide are complementary, and would therefore specifically hybridize, to a target region would represent 90 percent complementarity. Percent complementarity of an inhibitory nucleic acid with a region of a target nucleic acid can be determined routinely using basic local alignment search tools (BLAST programs) (Altschul et al., J. Mol. Biol., 1990, 215, 403-410; Zhang and Madden, Genome Res., 1997, 7, 649-656). Antisense and other compounds of the invention that hybridize to an lncRNA are identified through routine experimentation. In general the inhibitory nucleic acids must retain specificity for their target, i.e., either do not directly bind to, or do not directly significantly affect expression levels of, transcripts other than the intended target.

Target-specific effects, with corresponding target-specific functional biological effects, are possible even when the inhibitory nucleic acid exhibits non-specific binding to a large number of non-target RNAs. For example, short 8 base long inhibitory nucleic acids that are fully complementary to a lncRNA may have multiple 100% matches to hundreds of sequences in the genome, yet may produce target-specific effects, e.g. upregulation of a specific target gene through inhibition of PRC2 activity. 8-base inhibitory nucleic acids have been reported to prevent exon skipping with with a high degree of specificity and reduced off-target effect. See Singh et al., RNA Biol., 2009; 6(3): 341-350. 8-base inhibitory nucleic acids have been reported to interfere with miRNA activity without significant off-target effects. See Obad et al., Nature Genetics, 2011; 43: 371-378.

For further disclosure regarding inhibitory nucleic acids, please see US2010/0317718 (antisense oligos); US2010/0249052 (double-stranded ribonucleic acid (dsRNA)); US2009/0181914 and US2010/0234451 (LNA molecules); US2007/0191294 (siRNA analogues); US2008/0249039 (modified siRNA); and WO2010/129746 and WO2010/040112 (inhibitory nucleic acids).

Antisense

In some embodiments, the inhibitory nucleic acids are antisense oligonucleotides. Antisense oligonucleotides are typically designed to block expression of a DNA or RNA target by binding to the target and halting expression at the level of transcription, translation, or splicing. Antisense oligonucleotides of the present invention are complementary nucleic acid sequences designed to hybridize under stringent conditions to an lncRNA in vitro, and are expected to inhibit the activity of PRC2 in vivo. Thus, oligonucleotides are chosen that are sufficiently complementary to the target, i.e., that hybridize sufficiently well and with sufficient biological functional specificity, to give the desired effect.

Modified Base, Including Locked Nucleic Acids (LNAs)

In some embodiments, the inhibitory nucleic acids used in the methods described herein comprise one or more modified bonds or bases. Modified bases include phosphorothioate, methylphosphonate, peptide nucleic acids, or locked nucleic acids (LNAs). Preferably, the modified nucleotides are part of locked nucleic acid molecules, including [alpha]-L-LNAs. LNAs include ribonucleic acid analogues wherein the ribose ring is "locked" by a methylene bridge between the 2'-oxygen and the 4'-carbon—i.e., oligonucleotides containing at least one LNA monomer, that is, one 2'-O,4'-C-methylene-β-D-ribofuranosyl nucleotide. LNA bases form standard Watson-Crick base pairs but the locked configuration increases the rate and stability of the basepairing reaction (Jepsen et al., Oligonucleotides, 14, 130-146 (2004)). LNAs also have increased affinity to base pair with RNA as compared to DNA. These properties render LNAs especially useful as probes for fluorescence in situ hybridization (FISH) and comparative genomic hybridization, as knockdown tools for miRNAs, and as antisense oligonucleotides to target mRNAs or other RNAs, e.g., lncRNAs as described herein.

The modified base/LNA molecules can include molecules comprising 10-30, e.g., 12-24, e.g., 12, 13, 14, 15, 16, 17, 18, 19, 20, 21, 22, 23, 24, 25, 26, 27, 28, 29, or 30 nucleotides in each strand, wherein one of the strands is substantially identical, e.g., at least 80% (or more, e.g., 85%, 90%, 95%, or 100%) identical, e.g., having 3, 2, 1, or 0 mismatched nucleotide(s), to a target region in the lncRNA. The modified base/LNA molecules can be chemically synthesized using methods known in the art.

The modified base/LNA molecules can be designed using any method known in the art; a number of algorithms are known, and are commercially available (e.g., on the internet, for example at exiqon.com). See, e.g., You et al., Nuc. Acids. Res. 34:e60 (2006); McTigue et al., Biochemistry 43:5388-405 (2004); and Levin et al., Nuc. Acids. Res. 34:e142 (2006). For example, "gene walk" methods, similar to those used to design antisense oligos, can be used to optimize the inhibitory activity of a modified base/LNA molecule; for example, a series of oligonucleotides of 10-30 nucleotides spanning the length of a target lncRNA can be prepared, followed by testing for activity. Optionally, gaps, e.g., of 5-10 nucleotides or more, can be left between the LNAs to reduce the number of oligonucleotides synthesized and tested. GC content is preferably between about 30-60%. General guidelines for designing modified base/LNA molecules are known in the art; for example, LNA sequences will bind very tightly to other LNA sequences, so it is preferable to avoid significant complementarity within an LNA molecule. Contiguous runs of three or more Gs or Cs, or more than four LNA residues, should be avoided where possible (for example, it may not be possible with very short (e.g., about 9-10 nt) oligonucleotides). In some embodiments, the LNAs are xylo-LNAs.

In some embodiments, the modified base/LNA molecules can be designed to target a specific region of the lncRNA. For example, a specific functional region can be targeted, e.g., a region comprising a known RNA localization motif (i.e., a region complementary to the target nucleic acid on which the lncRNA acts), or a region comprising a known protein binding region, e.g., a Polycomb (e.g., Polycomb Repressive Complex 2 (PRC2), comprised of H3K27 methylase EZH2, SUZ12, and EED)) or LSD1/CoREST/REST complex binding region (see, e.g., Tsai et al., Science. 2010 Aug. 6; 329 (5992):689-93. Epub 2010 Jul. 8; and Zhao et al., Science. 2008 Oct. 31; 322(5902):750-6). Sarma et al., "Locked nucleic acids (LNAs) reveal sequence requirements and kinetics of Xist RNA localization to the X chromosome." PNAS published ahead of print Dec. 6, 2010, doi:10.1073/pnas.1009785107. Alternatively or in addition, highly conserved regions can be targeted, e.g., regions identified by aligning sequences from disparate species such as primate (e.g., human) and rodent (e.g., mouse) and looking for regions with high degrees of identity. Percent identity can be determined routinely using basic local alignment search tools (BLAST programs) (Altschul et al., J. Mol. Biol., 1990, 215, 403-410; Zhang and Madden, Genome Res., 1997, 7, 649-656), e.g., using the default parameters.

For additional information regarding LNA molecules see U.S. Pat. Nos. 6,268,490; 6,734,291; 6,770,748; 6,794,499; 7,034,133; 7,053,207; 7,060,809; 7,084,125; and 7,572,582; and U.S. Pre-Grant Pub. Nos. 20100267018; 20100261175; and 20100035968; Koshkin et al. Tetrahedron 54, 3607-3630 (1998); Obika et al. Tetrahedron Lett. 39, 5401-5404 (1998); Jepsen et al., Oligonucleotides 14:130-146 (2004); Kauppinen et al., Drug Disc. Today 2(3):287-290 (2005); and Ponting et al., Cell 136(4):629-641 (2009), and references cited therein.

In a related aspect, the present disclosure demonstrates the ability of LNA molecules to displace a cis-acting nuclear long ncRNA with fast kinetics (e.g., RNA/PRC2 disassociation from the chromosome after 2, 5, 10 seconds up to 60 minutes as described herein)—a property that enables the modification and study of the function of long ncRNAs in ways not previously possible. Using 17 kb Xist RNA as a model, the present inventors showed that LNA molecules designed to specifically target the transcript leads to extremely rapid displacement of the RNA from the inactive X-chromosome. Interestingly, while the RNA is displaced, transcript stability is not affected. Targeting different Xist regions has allowed the identification of a localization domain and show that Polycomb repressive complex 2 (PRC2) is displaced together with Xist. Thus, PRC2 depends on RNA for both initial targeting to and stable association with chromatin. Time-course analysis of RNA relocalization suggests that Xist and PRC2 spread along X at the same time but does not reach saturating levels for 24 hours, providing a window of opportunity to reprogram the chromatin, if necessary.

It is remarkable that targeting a small region within a 17-kb RNA could produce such dramatic effects. The rapid effects suggest that the Xist RNA-protein complex may be anchored to the inactive X chromosome (Xi) chromatin via Repeat C. Alternatively, the LNA molecule's binding to Repeat C could change RNA conformation and interfere with a remote anchoring domain. While RNA displacement occurs with rapid kinetics, the recovery period is prolonged. Although full Xist clouds are restored within 8 hours, the full complement of PRC2 is not recovered for up to 24 hours. This implies that, during the spread of X-chromosome inactivation (XCI), synthesis of the RNA is not the rate-limiting step; rather, it is the recruitment of associated silencing proteins such as PRC2. The rapid displacement of Xist and the slow kinetics of recovery provided a large window of opportunity to investigate Xist's spreading pattern relative to that of PRC2. Time-course analysis during the recovery phase indicates that Xist RNA binds most strongly near the Xist locus at first but spreads to the rest of Xi at the same time. Similarly, PRC2 is recruited synchronously throughout the X. Interestingly, neither Xist nor PRC2 levels reach saturation immediately, as the coating of Xist is not complete until t=8 hr and binding of PRC2 does not peak until t=24 hr. Combined, this analysis implies that establishment of chromosome-wide silencing may be relatively slow.

As demonstrated herein, LNA molecules can be used as a valuable tool to manipulate and aid analysis of long nuclear ncRNAs. Advantages offered by an LNA molecule-based system are the relatively low costs, easy delivery, and rapid action. While other inhibitory nucleic acids may exhibit effects after longer periods of time, LNA molecules exhibit effects that are more rapid, e.g., a comparatively early onset of activity, are fully reversible after a recovery period following the synthesis of new lncRNA, and occur without causing substantial or substantially complete RNA cleavage or degradation. One or more of these design properties may be desired properties of the inhibitory nucleic acids of the invention. Additionally, LNA molecules make possible the systematic targeting of domains within much longer nuclear transcripts. Although a PNA-based system has been described earlier, the effects on Xi were apparent only after 24 hours (13). The LNA technology enables high-throughput screens for functional analysis of long non-coding RNAs and also provides a novel tool to manipulate chromatin states in vivo for therapeutic applications.

In various related aspects, the methods described herein include using LNA molecules to target lncRNAs for a number of uses, including as a research tool to probe the function of a specific lncRNA, e.g., in vitro or in vivo. The methods include selecting one or more desired lncRNAs, designing one or more LNA molecules that target the lncRNA, providing the designed LNA molecule, and administering the LNA molecule to a cell or animal. The methods can optionally include selecting a region of the lncRNA and designing one or more LNA molecules that target that region of the lncRNA.

Aberrant imprinted gene expression is implicated in several diseases including Long QT syndrome, Beckwith-Wiedemann, Prader-Willi, and Angelman syndromes, as well as behavioral disorders and carcinogenesis (see, e.g., Falls et al., Am. J. Pathol. 154:635-647 (1999); Lalande, Annu Rev Genet 30:173-195 (1996); Hall Annu Rev Med. 48:35-44 (1997)). LNA molecules can be created to treat such imprinted diseases. As one example, the long QT Syndrome can be caused by a K+ gated Calcium-channel encoded by Kcnq1. This gene is regulated by its antisense counterpart, the long noncoding RNA, Kcnq1ot1 (Pandey et al., Mol Cell. 2008 Oct. 24; 32(2):232-46). Disease arises when Kcnq1ot1 is aberrantly expressed. LNA molecules can be created to downregulate Kcnq1ot1, thereby restoring expression of Kcnq1. As another example, LNA molecules could inhibit LncRNA cofactors for polycomb complex chromatin modifiers to reverse the imprinted defect.

From a commercial and clinical perspective, the timepoints between about 1 to 24 hours potentially define a window for epigenetic reprogramming. The advantage of the LNA system is that it works quickly, with a defined half-life, and is therefore reversible upon degradation of LNAs, at the same time that it provides a discrete timeframe during which epigenetic manipulations can be made. By targeting nuclear long ncRNAs, LNA molecules or similar polymers, e.g., xylo-LNAs, might be utilized to manipulate the chromatin state of cells in culture or in vivo, by transiently eliminating the regulatory RNA and associated proteins long enough to alter the underlying locus for therapeutic purposes. In particular, LNA molecules or similar polymers that specifically bind to, or are complementary to, PRC2-binding lncRNA can prevent recruitment of PRC2 to a specific chromosomal locus, in a gene-specific fashion.

LNA molecules might also be administered in vivo to treat other human diseases, such as but not limited to cancer, neurological disorders, infections, inflammation, and myotonic dystrophy. For example, LNA molecules might be delivered to tumor cells to downregulate the biologic activity of a growth-promoting or oncogenic long nuclear ncRNA (e.g., Gtl2 or MALAT1 (Luo et al., Hepatology. 44(4):1012-24 (2006)), a lncRNA associated with metastasis and is frequently upregulated in cancers). Repressive lncRNAs downregulating tumor suppressors can also be targeted by LNA molecules to promote reexpression. For example, expression of the INK4b/ARF/INK4a tumor suppressor locus is controlled by Polycomb group proteins including PRC1 and PRC2 and repressed by the antisense noncoding RNA ANRIL (Yap et al., Mol Cell. 2010 Jun. 11; 38(5):662-74). ANRIL can be targeted by LNA molecules to promote reexpression of the INK4b/ARF/INK4a tumor suppressor. Some tcRNA may be positive regulators of oncogenes. Such "activating lncRNAs" have been described recently (e.g., Jpx (Tian et al., Cell. 143(3):390-403 (2010) and others (Ørom et al., Cell. 143(1): 46-58 (2010)). Therefore, LNA molecules could be directed at these activating lncRNAs to downregulate oncogenes. LNA molecules could also be delivered to inflammatory cells to downregulate regulatory lncRNA that modulate the inflammatory or immune response. (e.g., LincRNA-Cox2, see Guttman et al., Nature. 458(7235):223-7. Epub 2009 Feb. 1 (2009)).

In still other related aspects, the LNA molecules targeting lncRNAs described herein can be used to create animal or cell models of conditions associated with altered gene expression (e.g., as a result of altered epigenetics).

For example, it was first noticed about half a century ago that X-chromosome changes are often seen in female reproductive cancers. Some 70% of breast carcinomas lack a 'Barr body', the cytologic hallmark of the inactive X chromosome (Xi), and instead harbor two or more active Xs (Xa). Additional X's are also a risk factor for men, as XXY men (Klinefelter Syndrome) have a 20- to 50-fold increased risk of breast cancer in a BRCA1 background. The X is also known to harbor a number of oncogenes. Supernumerary Xa's correlate with a poor prognosis and stand as one of the most common cytogenetic abnormalities not only in reproductive cancers but also in leukemias, lymphomas, and germ cell tumors of both sexes. See, e.g., Liao et al., Cancer Invest 21, 641-58 (2003); Spatz et al., Nat Rev Cancer 4, 617-29 (2004); Barr et al., Proc Can Cancer Conf 2, 3-16 (1957); Borah et al., J Surg Oncol 13, 1-7 (1980); Camargo and Wang, Hum Genet 55, 81-5 (1980); Dutrillaux et al., Int J Cancer 38, 475-9 (1986); Ghosh and ShahCancer Genet Cytogenet 4, 269-74 (1981); Ghosh and Shah, Med Hypotheses 7, 1099-104 (1981); Ghosh et al., Acta Cytol 27, 202-3 (1983); Huang et al., Mol Cancer Ther 1, 769-76 (2002); Kawakami et al., Lancet 363, 40-2 (2004); Kawakami et al., J Urol 169, 1546-52 (2003); Kawakami et al., Oncogene 23, 6163-9 (2004); Moore and Barr, Br J Cancer 9, 246-52 (1955); Moore and Barr, Br J Cancer 11, 384-90 (1957); Moore et al., J Exp Zool 135, 101-25 (1957); Rosen et al, Ann Clin Lab Sci 7, 491-9 (1977); Sirchia et al., Cancer Res 65, 2139-46 (2005); Tavares, Lancet 268, 948-9 (1955); Tavares, Medico (Porto) 12, 97-100 (1961); Tavares, Acta Cytol 6, 90-4 (1962); Wang et al., Cancer Genet Cytogenet 46, 271-80 (1990); and Ganesan et al., Cold Spring Harb Symp Quant Biol 70, 93-7 (2005).

Some 60% of childhood acute lymphoblastic leukemias (ALL) also display extra X's; in chronic neutrophilic leukemia, the gain of X is sometimes the only obvious abnormality and is associated with progression to blast crisis (see, e.g., Heinonen and Mahlamaki, Cancer Genet Cytogenet 87, 123-6 (1996); Heinonen et al., Med Pediatr Oncol 32, 360-5 (1999); and Yamamoto et al., Cancer Genet Cytogenet 134, 84-7 (2002)). These observations are so far only correlative but together hint that the X may be an accomplice in carcinogenesis. Xist, therefore may be a tumor suppressor. Preliminary data obtained after deleting Xist in specific lineages in male and female mice shows that increased B cell proliferation occurs in a subset of mice (but not in controls; n=9). Without wishing to be bound by theory, one potential mechanism is that loss of Xist in cells leads X-reactivation or Xa duplication, resulting in an XaXa state in the cell. The consequent increased expression of X-oncogenes induces a precancerous state, and an accumulation of additional epigenetic/genetic changes (e.g., genome-wide changes then results in cancer. Thus, Xist may be a tumor suppressor.

An animal model of specific cancers (e.g., those cancers known in the art and described above that are associated with X-chromosome changes) could be created by using an XIST-LNA, e.g., the XIST LNAs described herein, to remove XIST in a cell or tissue and developmentally specific way.

The methods described herein may also be useful for creating animal or cell models of other conditions associated with aberrant imprinted gene expression, e.g., as noted above.

In various related aspects, the results described herein demonstrate the utility of LNA molecules for targeting long ncRNA, for example, to transiently disrupt chromatin for purposes of reprogramming chromatin states ex vivo. Because LNA molecules stably displace RNA for hours and chromatin does not rebuild for hours thereafter, LNA molecules create a window of opportunity to manipulate the epigenetic state of specific loci ex vivo, e.g., for reprogramming of hiPS and hESC prior to stem cell therapy. For example, Gtl2 controls expression of DLK1, which modulates the pluripotency of iPS cells. Low Gtl2 and high DLK1 is correlated with increased pluripotency and stability in human iPS cells. Thus, LNA molecules targeting Gtl2 can be used to inhibit differentiation and increase pluripotency and stability of iPS cells.

See also U.S. Ser. No. 61/412,862, which is incorporated by reference herein in its entirety.

Antagomirs

In some embodiments, the inhibitory nucleic acid is an antagomir. Antagomirs are chemically modified antisense oligonucleotides that can target an lncRNA. For example, an antagomir for use in the methods described herein can include a nucleotide sequence sufficiently complementary to hybridize to an lncRNA target sequence of about 12 to 25 nucleotides, preferably about 15 to 23 nucleotides.

In some embodiments, antagomirs include a cholesterol moiety, e.g., at the 3'-end. In some embodiments, antagomirs have various modifications for RNase protection and pharmacologic properties such as enhanced tissue and cellular uptake. For example, in addition to the modifications discussed above for antisense oligos, an antagomir can have one or more of complete or partial 2'-O-methylation of sugar and/or a phosphorothioate backbone. Phosphorothioate modifications provide protection against RNase or other nuclease activity and their lipophilicity contributes to enhanced tissue uptake. In some embodiments, the antagomir cam include six phosphorothioate backbone modifications; two phosphorothioates are located at the 5'-end and four at the 3'-end, but other patterns of phosphorothioate modification are also commonly employed and effective. See, e.g., Krutzfeldt et al., Nature 438, 685-689 (2005); Czech, N Engl J Med 2006; 354:1194-1195 (2006); Robertson et al., Silence. 1:10 (2010); Marquez and McCaffrey, Hum Gene Ther. 19(1):27-38 (2008); van Rooij et al., Circ Res. 103(9):919-928 (2008); and Liu et al., Int. J. Mol. Sci. 9:978-999 (2008). Krutzfeld et al. (2005) describe chemically engineered oligonucleotides, termed 'antagomirs', that are reported to be are efficient and specific silencers of endogenous miRNAs in mice.

In general, the design of an antagomir avoids target RNA degradation due to the modified sugars present in the molecule. The presence of an unbroken string of unmodified sugars supports RNAseH recruitment and enzymatic activity. Thus, typically the design of an antagomir will include bases that contain modified sugar (e.g., LNA), at the ends or interspersed with natural ribose or deoxyribose nucleobases.

Antagomirs useful in the present methods can also be modified with respect to their length or otherwise the number of nucleotides making up the antagomir. In some embodiments, the antagomirs must retain specificity for their target, i.e., must not directly bind to, or directly significantly affect expression levels of, transcripts other than the intended target. In some embodiments antagomirs may exhibit nonspecific binding that does not produce significant undesired biologic effect, e.g. the antagomirs do not affect expression levels of non-target transcripts or their association with regulatory proteins or regulatory RNAs.

Interfering RNA, Including siRNA/shRNA

In some embodiments, the inhibitory nucleic acid sequence that is complementary to an lncRNA can be an interfering RNA, including but not limited to a small interfering RNA ("siRNA") or a small hairpin RNA ("shRNA"). Methods for constructing interfering RNAs are well known in the art. For example, the interfering RNA can be assembled from two separate oligonucleotides, where one strand is the sense strand and the other is the antisense strand, wherein the antisense and sense strands are self-complementary (i.e., each strand comprises nucleotide sequence that is complementary to nucleotide sequence in the other strand; such as where the antisense strand and sense strand form a duplex or double stranded structure); the antisense strand comprises nucleotide sequence that is complementary to a nucleotide sequence in a target nucleic acid molecule or a portion thereof (i.e., an undesired gene) and the sense strand comprises nucleotide sequence corresponding to the target nucleic acid sequence or a portion thereof. Alternatively, interfering RNA is assembled from a single oligonucleotide, where the self-complementary sense and antisense regions are linked by means of nucleic acid based or non-nucleic acid-based linker(s). The interfering RNA can be a polynucleotide with a duplex, asymmetric duplex, hairpin or asymmetric hairpin secondary structure, having self-complementary sense and antisense regions, wherein the antisense region comprises a nucleotide sequence that is complementary to nucleotide sequence in a separate target nucleic acid molecule or a portion thereof and the sense region having nucleotide sequence corresponding to the target nucleic acid sequence or a portion thereof. The interfering can be a circular single-stranded polynucleotide having two or more loop structures and a stem comprising self-complementary sense and antisense regions, wherein the antisense region comprises nucleotide sequence that is complementary to nucleotide sequence in a target nucleic acid molecule or a portion thereof and the sense region having nucleotide sequence corresponding to the target nucleic acid sequence or a portion thereof, and wherein the circular polynucleotide can be processed either in vivo or in vitro to generate an active siRNA molecule capable of mediating RNA interference.

In some embodiments, the interfering RNA coding region encodes a self-complementary RNA molecule having a sense region, an antisense region and a loop region. Such an RNA molecule when expressed desirably forms a "hairpin" structure, and is referred to herein as an "shRNA." The loop region is generally between about 2 and about 10 nucleotides in length. In some embodiments, the loop region is from about 6 to about 9 nucleotides in length. In some embodiments, the sense region and the antisense region are between about 15 and about 20 nucleotides in length. Following post-transcriptional processing, the small hairpin RNA is converted into a siRNA by a cleavage event mediated by the enzyme Dicer, which is a member of the RNase III family. The siRNA is then capable of inhibiting the expression of a gene with which it shares homology. For details, see Brummelkamp et al., Science 296:550-553, (2002); Lee et al, Nature Biotechnol., 20, 500-505, (2002); Miyagishi and Taira, Nature Biotechnol 20:497-500, (2002); Paddison et al. Genes & Dev. 16:948-958, (2002); Paul, Nature Biotechnol, 20, 505-508, (2002); Sui, Proc. Natl. Acad. Sd. USA, 99(6), 5515-5520, (2002); Yu et al. Proc Natl Acad Sci USA 99:6047-6052, (2002).

The target RNA cleavage reaction guided by siRNAs is highly sequence specific. In general, siRNA containing a nucleotide sequences identical to a portion of the target nucleic acid are preferred for inhibition. However, 100% sequence identity between the siRNA and the target gene is not required to practice the present invention. Thus the invention has the advantage of being able to tolerate sequence variations that might be expected due to genetic mutation, strain polymorphism, or evolutionary divergence. For example, siRNA sequences with insertions, deletions, and single point mutations relative to the target sequence have also been found to be effective for inhibition. Alternatively, siRNA sequences with nucleotide analog substitutions or insertions can be effective for inhibition. In general the siRNAs must retain specificity for their target, i.e., must not directly bind to, or directly significantly affect expression levels of, transcripts other than the intended target.

Ribozymes

In some embodiments, the inhibitory nucleic acids are ribozymes. Trans-cleaving enzymatic nucleic acid molecules can also be used; they have shown promise as therapeutic agents for human disease (Usman & McSwiggen, 1995 Ann. Rep. Med. Chem. 30, 285-294; Christoffersen and Marr, 1995 J. Med. Chem. 38, 2023-2037). Enzymatic nucleic acid molecules can be designed to cleave specific lncRNA targets within the background of cellular RNA. Such a cleavage event renders the lncRNA non-functional.

In general, enzymatic nucleic acids with RNA cleaving activity act by first binding to a target RNA. Such binding occurs through the target binding portion of a enzymatic nucleic acid which is held in close proximity to an enzymatic portion of the molecule that acts to cleave the target RNA. Thus, the enzymatic nucleic acid first recognizes and then binds a target RNA through complementary base pairing, and once bound to the correct site, acts enzymatically to cut the target RNA. Strategic cleavage of such a target RNA will destroy its ability to direct synthesis of an encoded protein. After an enzymatic nucleic acid has bound and cleaved its RNA target, it is released from that RNA to search for another target and can repeatedly bind and cleave new targets.

Several approaches such as in vitro selection (evolution) strategies (Orgel, 1979, Proc. R. Soc. London, B 205, 435) have been used to evolve new nucleic acid catalysts capable of catalyzing a variety of reactions, such as cleavage and ligation of phosphodiester linkages and amide linkages, (Joyce, 1989, Gene, 82, 83-87; Beaudry et al., 1992, Science 257, 635-641; Joyce, 1992, Scientific American 267, 90-97; Breaker et al, 1994, TIBTECH 12, 268; Bartel et al, 1993, Science 261: 1411-1418; Szostak, 1993, TIBS 17, 89-93; Kumar et al, 1995, FASEB J., 9, 1183; Breaker, 1996, Curr. Op. Biotech., 1, 442). The development of ribozymes that are optimal for catalytic activity would contribute significantly to any strategy that employs RNA-cleaving ribozymes for the purpose of regulating gene expression. The hammerhead ribozyme, for example, functions with a catalytic rate (kcat) of about 1 $min^{-1}$ in the presence of saturating (10 MM) concentrations of $Mg^{2+}$ cofactor. An artificial "RNA ligase" ribozyme has been shown to catalyze the corresponding self-modification reaction with a rate of about 100 $min^{-1}$. In addition, it is known that certain modified hammerhead ribozymes that have substrate binding arms made of DNA catalyze RNA cleavage with multiple turn-over rates that approach 100 $min^{-1}$.

Making and Using Inhibitory Nucleic Acids

The nucleic acid sequences used to practice the methods described herein, whether RNA, cDNA, genomic DNA, vectors, viruses or hybrids thereof, can be isolated from a variety of sources, genetically engineered, amplified, and/or expressed/generated recombinantly. If desired, nucleic acid sequences of the invention can be inserted into delivery vectors and expressed from transcription units within the vectors. The recombinant vectors can be DNA plasmids or viral vectors. Generation of the vector construct can be accomplished using any suitable genetic engineering techniques well known in the art, including, without limitation, the standard techniques of PCR, oligonucleotide synthesis, restriction endonuclease digestion, ligation, transformation, plasmid purification, and DNA sequencing, for example as described in Sambrook et al. Molecular Cloning: A Laboratory Manual. (1989)), Coffin et al. (Retroviruses. (1997)) and "RNA Viruses: A Practical Approach" (Alan J. Cann, Ed., Oxford University Press, (2000)).

Preferably, inhibitory nucleic acids of the invention are synthesized chemically. Nucleic acid sequences used to practice this invention can be synthesized in vitro by well-known chemical synthesis techniques, as described in, e.g., Adams (1983) J. Am. Chem. Soc. 105:661; Belousov (1997) Nucleic Acids Res. 25:3440-3444; Frenkel (1995) Free Radic. Biol. Med. 19:373-380; Blommers (1994) Biochemistry 33:7886-7896; Narang (1979) Meth. Enzymol. 68:90; Brown (1979) Meth. Enzymol. 68:109; Beaucage (1981) Tetra. Lett. 22:1859; U.S. Pat. No. 4,458,066; WO/2008/043753 and WO/2008/049085, and the references cited therein.

Nucleic acid sequences of the invention can be stabilized against nucleolytic degradation such as by the incorporation of a modification, e.g., a nucleotide modification. For example, nucleic acid sequences of the invention includes a phosphorothioate at least the first, second, or third internucleotide linkage at the 5' or 3' end of the nucleotide sequence. As another example, the nucleic acid sequence can include a 2'-modified nucleotide, e.g., a 2'-deoxy, 2'-deoxy-2'-fluoro, 2'-O-methyl, 2'-O-methoxyethyl (2'-O-MOE), 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), or 2'-O—N-methylacetamido (2'-O-NMA). As another example, the nucleic acid sequence can include at least one 2'-O-methyl-modified nucleotide, and in some embodiments, all of the nucleotides include a 2'-O-methyl modification. In some embodiments, the nucleic acids are "locked," i.e., comprise nucleic acid analogues in which the ribose ring is "locked" by a methylene bridge connecting the 2'-O atom and the 4'-C atom (see, e.g., Kaupinnen et al., Drug Disc. Today 2(3):287-290 (2005); Koshkin et al., J. Am. Chem. Soc., 120(50): 13252-13253 (1998)). For additional modifications see US 20100004320, US 20090298916, and US 20090143326.

It is understood that any of the modified chemistries or formats of inhibitory nucleic acids described herein can be combined with each other, and that one, two, three, four, five, or more different types of modifications can be included within the same molecule.

Techniques for the manipulation of nucleic acids used to practice this invention, such as, e.g., subcloning, labeling probes (e.g., random-primer labeling using Klenow polymerase, nick translation, amplification), sequencing, hybridization and the like are well described in the scientific and patent literature, see, e.g., Sambrook et al., Molecular Cloning; A Laboratory Manual 3d ed. (2001); Current Protocols in Molecular Biology, Ausubel et al., eds. (John Wiley & Sons, Inc., New York 2010); Kriegler, Gene Transfer and Expression: A Laboratory Manual (1990); Laboratory Techniques In Biochemistry And Molecular Biology: Hybridization With Nucleic Acid Probes, Part I. Theory and Nucleic Acid Preparation, Tijssen, ed. Elsevier, N.Y. (1993).

Pharmaceutical Compositions

The methods described herein can include the administration of pharmaceutical compositions and formulations comprising inhibitory nucleic acid sequences designed to target an lncRNA.

In some embodiments, the compositions are formulated with a pharmaceutically acceptable carrier. The pharmaceutical compositions and formulations can be administered parenterally, topically, orally or by local administration, such as by aerosol or transdermally. The pharmaceutical compositions can be formulated in any way and can be administered in a variety of unit dosage forms depending upon the condition or disease and the degree of illness, the general medical condition of each patient, the resulting preferred method of administration and the like. Details on techniques for formulation and administration of pharmaceuticals are well described in the scientific and patent literature, see, e.g., Remington: The Science and Practice of Pharmacy, 21st ed., 2005.

The inhibitory nucleic acids can be administered alone or as a component of a pharmaceutical formulation (composition). The compounds may be formulated for administration, in any convenient way for use in human or veterinary medicine. Wetting agents, emulsifiers and lubricants, such as sodium lauryl sulfate and magnesium stearate, as well as coloring agents, release agents, coating agents, sweetening, flavoring and perfuming agents, preservatives and antioxidants can also be present in the compositions.

Formulations of the compositions of the invention include those suitable for intradermal, inhalation, oral/nasal, topical, parenteral, rectal, and/or intravaginal administration. The formulations may conveniently be presented in unit dosage form and may be prepared by any methods well known in the art of pharmacy. The amount of active ingredient (e.g., nucleic acid sequences of this invention) which can be combined with a carrier material to produce a single dosage form will vary depending upon the host being treated, the particular mode of administration, e.g., intradermal or inhalation. The amount of active ingredient which can be combined with a carrier material to produce a single dosage form will generally be that amount of the compound which produces a therapeutic effect, e.g., an antigen specific T cell or humoral response.

Pharmaceutical formulations of this invention can be prepared according to any method known to the art for the manufacture of pharmaceuticals. Such drugs can contain sweetening agents, flavoring agents, coloring agents and preserving agents. A formulation can be admixtured with non-toxic pharmaceutically acceptable excipients which are suitable for manufacture. Formulations may comprise one or more diluents, emulsifiers, preservatives, buffers, excipients, etc. and may be provided in such forms as liquids, powders, emulsions, lyophilized powders, sprays, creams, lotions, controlled release formulations, tablets, pills, gels, on patches, in implants, etc.

Pharmaceutical formulations for oral administration can be formulated using pharmaceutically acceptable carriers well known in the art in appropriate and suitable dosages. Such carriers enable the pharmaceuticals to be formulated in unit dosage forms as tablets, pills, powder, dragees, capsules, liquids, lozenges, gels, syrups, slurries, suspensions, etc., suitable for ingestion by the patient. Pharmaceutical preparations for oral use can be formulated as a solid excipient, optionally grinding a resulting mixture, and processing the mixture of granules, after adding suitable additional compounds, if desired, to obtain tablets or dragee cores. Suitable solid excipients are carbohydrate or protein fillers include, e.g., sugars, including lactose, sucrose, mannitol, or sorbitol; starch from corn, wheat, rice, potato, or other plants; cellulose such as methyl cellulose, hydroxypropylmethyl-cellulose, or sodium carboxy-methylcellulose; and gums including arabic and tragacanth; and proteins, e.g., gelatin and collagen. Disintegrating or solubilizing agents may be added, such as the cross-linked polyvinyl pyrrolidone, agar, alginic acid, or a salt thereof, such as sodium alginate. Push-fit capsules can contain active agents mixed with a filler or binders such as lactose or starches, lubricants such as talc or magnesium stearate, and, optionally, stabilizers. In soft capsules, the active agents can be dissolved or suspended in suitable liquids, such as fatty oils, liquid paraffin, or liquid polyethylene glycol with or without stabilizers.

Aqueous suspensions can contain an active agent (e.g., nucleic acid sequences of the invention) in admixture with excipients suitable for the manufacture of aqueous suspensions, e.g., for aqueous intradermal injections. Such excipients include a suspending agent, such as sodium carboxymethylcellulose, methylcellulose, hydroxypropylmethylcellulose, sodium alginate, polyvinylpyrrolidone, gum tragacanth and gum acacia, and dispersing or wetting agents such as a naturally occurring phosphatide (e.g., lecithin), a condensation product of an alkylene oxide with a fatty acid (e.g., polyoxyethylene stearate), a condensation product of ethylene oxide with a long chain aliphatic alcohol (e.g., heptadecaethyleneoxycetanol), a condensation product of ethylene oxide with a partial ester derived from a fatty acid and a hexitol (e.g., polyoxyethylene sorbitol mono-oleate), or a condensation product of ethylene oxide with a partial ester derived from fatty acid and a hexitol anhydride (e.g., polyoxyethylene sorbitan mono-oleate). The aqueous suspension can also contain one or more preservatives such as ethyl or n-propyl p-hydroxybenzoate, one or more coloring agents, one or more flavoring agents and one or more sweetening agents, such as sucrose, aspartame or saccharin. Formulations can be adjusted for osmolarity.

In some embodiments, oil-based pharmaceuticals are used for administration of nucleic acid sequences of the invention. Oil-based suspensions can be formulated by suspending an active agent in a vegetable oil, such as arachis oil, olive oil, sesame oil or coconut oil, or in a mineral oil such as liquid paraffin; or a mixture of these. See e.g., U.S. Pat. No. 5,716,928 describing using essential oils or essential oil components for increasing bioavailability and reducing inter- and intra-individual variability of orally administered hydrophobic pharmaceutical compounds (see also U.S. Pat. No. 5,858,401). The oil suspensions can contain a thickening agent, such as beeswax, hard paraffin or cetyl alcohol. Sweetening agents can be added to provide a palatable oral preparation, such as glycerol, sorbitol or sucrose. These formulations can be preserved by the addition of an antioxidant such as ascorbic acid. As an example of an injectable oil vehicle, see Minto (1997) J. Pharmacol. Exp. Ther. 281:93-102.

Pharmaceutical formulations can also be in the form of oil-in-water emulsions. The oily phase can be a vegetable oil or a mineral oil, described above, or a mixture of these. Suitable emulsifying agents include naturally-occurring gums, such as gum acacia and gum tragacanth, naturally occurring phosphatides, such as soybean lecithin, esters or partial esters derived from fatty acids and hexitol anhydrides, such as sorbitan mono-oleate, and condensation products of these partial esters with ethylene oxide, such as polyoxyethylene sorbitan mono-oleate. The emulsion can also contain sweetening agents and flavoring agents, as in the formulation of syrups and elixirs. Such formulations can also contain a demulcent, a preservative, or a coloring agent. In alternative embodiments, these injectable oil-in-water emulsions of the invention comprise a paraffin oil, a sorbitan monooleate, an ethoxylated sorbitan monooleate and/or an ethoxylated sorbitan trioleate.

The pharmaceutical compounds can also be administered by in intranasal, intraocular and intravaginal routes including suppositories, insufflation, powders and aerosol formulations (for examples of steroid inhalants, see e.g., Rohatagi (1995) J. Clin. Pharmacol. 35:1187-1193; Tjwa (1995) Ann. Allergy Asthma Immunol. 75:107-111). Suppositories formulations can be prepared by mixing the drug with a suitable non-irritating excipient which is solid at ordinary temperatures but liquid at body temperatures and will therefore melt in the body to release the drug. Such materials are cocoa butter and polyethylene glycols.

In some embodiments, the pharmaceutical compounds can be delivered transdermally, by a topical route, formulated as applicator sticks, solutions, suspensions, emulsions, gels, creams, ointments, pastes, jellies, paints, powders, and aerosols.

In some embodiments, the pharmaceutical compounds can also be delivered as microspheres for slow release in the body. For example, microspheres can be administered via intradermal injection of drug which slowly release subcutaneously; see Rao (1995) J. Biomater Sci. Polym. Ed. 7:623-645; as biodegradable and injectable gel formulations, see, e.g., Gao (1995) Pharm. Res. 12:857-863 (1995); or, as microspheres for oral administration, see, e.g., Eyles (1997) J. Pharm. Pharmacol. 49:669-674.

In some embodiments, the pharmaceutical compounds can be parenterally administered, such as by intravenous (IV) administration or administration into a body cavity or lumen of an organ. These formulations can comprise a solution of active agent dissolved in a pharmaceutically acceptable carrier. Acceptable vehicles and solvents that can be employed are water and Ringer's solution, an isotonic sodium chloride. In addition, sterile fixed oils can be employed as a solvent or suspending medium. For this purpose any bland fixed oil can be employed including synthetic mono- or diglycerides. In addition, fatty acids such as oleic acid can likewise be used in the preparation of injectables. These solutions are sterile and generally free of undesirable matter. These formulations may be sterilized by conventional, well known sterilization techniques. The formulations may contain pharmaceutically acceptable auxiliary substances as required to approximate physiological conditions such as pH adjusting and buffering agents, toxicity adjusting agents, e.g., sodium acetate, sodium chloride, potassium chloride, calcium chloride, sodium lactate and the like. The concentration of active agent in these formulations can vary widely, and will be selected primarily based on fluid volumes, viscosities, body weight, and the like, in accordance with the particular mode of administration selected and the patient's needs. For IV administration, the formulation can be a sterile injectable preparation, such as a sterile injectable aqueous or oleaginous suspension. This suspension can be formulated using those suitable dispersing or wetting agents and suspending agents. The sterile injectable preparation can also be a suspension in a nontoxic parenterally-acceptable diluent or solvent, such as a solution of 1,3-butanediol. The administration can be by bolus or continuous infusion (e.g., substantially uninterrupted introduction into a blood vessel for a specified period of time).

In some embodiments, the pharmaceutical compounds and formulations can be lyophilized. Stable lyophilized formulations comprising an inhibitory nucleic acid can be made by lyophilizing a solution comprising a pharmaceutical of the invention and a bulking agent, e.g., mannitol, trehalose, raffinose, and sucrose or mixtures thereof. A process for preparing a stable lyophilized formulation can include lyophilizing a solution about 2.5 mg/mL protein, about 15 mg/mL sucrose, about 19 mg/mL NaCl, and a sodium citrate buffer having a pH greater than 5.5 but less than 6.5. See, e.g., U.S. 20040028670.

The compositions and formulations can be delivered by the use of liposomes. By using liposomes, particularly where the liposome surface carries ligands specific for target cells, or are otherwise preferentially directed to a specific organ, one can focus the delivery of the active agent into target cells in vivo. See, e.g., U.S. Pat. Nos. 6,063,400; 6,007,839; Al-Muhammed (1996) J. Microencapsul. 13:293-306; Chonn (1995) Curr. Opin. Biotechnol. 6:698-708; Ostro (1989) Am. J. Hosp. Pharm. 46:1576-1587. As used in the present invention, the term "liposome" means a vesicle composed of amphiphilic lipids arranged in a bilayer or bilayers. Liposomes are unilamellar or multilamellar vesicles that have a membrane formed from a lipophilic material and an aqueous interior that contains the composition to be delivered. Cationic liposomes are positively charged liposomes that are believed to interact with negatively charged DNA molecules to form a stable complex. Liposomes that are pH-sensitive or negatively-charged are believed to entrap DNA rather than complex with it. Both cationic and noncationic liposomes have been used to deliver DNA to cells.

Liposomes can also include "sterically stabilized" liposomes, i.e., liposomes comprising one or more specialized lipids. When incorporated into liposomes, these specialized lipids result in liposomes with enhanced circulation lifetimes relative to liposomes lacking such specialized lipids. Examples of sterically stabilized liposomes are those in which part of the vesicle-forming lipid portion of the liposome comprises one or more glycolipids or is derivatized with one or more hydrophilic polymers, such as a polyethylene glycol (PEG) moiety. Liposomes and their uses are further described in U.S. Pat. No. 6,287,860.

The formulations of the invention can be administered for prophylactic and/or therapeutic treatments. In some embodiments, for therapeutic applications, compositions are administered to a subject who is need of reduced triglyceride levels, or who is at risk of or has a disorder described herein, in an amount sufficient to cure, alleviate or partially arrest the clinical manifestations of the disorder or its complications; this can be called a therapeutically effective amount. For example, in some embodiments, pharmaceutical compositions of the invention are administered in an amount sufficient to decrease serum levels of triglycerides in the subject.

The amount of pharmaceutical composition adequate to accomplish this is a therapeutically effective dose. The dosage schedule and amounts effective for this use, i.e., the dosing regimen, will depend upon a variety of factors, including the stage of the disease or condition, the severity of the disease or condition, the general state of the patient's health, the patient's physical status, age and the like. In calculating the dosage regimen for a patient, the mode of administration also is taken into consideration.

The dosage regimen also takes into consideration pharmacokinetics parameters well known in the art, i.e., the active agents' rate of absorption, bioavailability, metabolism, clearance, and the like (see, e.g., Hidalgo-Aragones (1996) J. Steroid Biochem. Mol. Biol. 58:611-617; Groning (1996) Pharmazie 51:337-341; Fotherby (1996) Contraception 54:59-69; Johnson (1995) J. Pharm. Sci. 84:1144-1146; Rohatagi (1995) Pharmazie 50:610-613; Brophy (1983) Eur. J. Clin. Pharmacol. 24:103-108; Remington: The Science and Practice of Pharmacy, 21st ed., 2005). The state of the art allows the clinician to determine the dosage regimen for each individual patient, active agent and disease or condition treated. Guidelines provided for similar compositions used as pharmaceuticals can be used as guidance to determine the dosage regiment, i.e., dose schedule and dosage levels, administered practicing the methods of the invention are correct and appropriate.

Single or multiple administrations of formulations can be given depending on for example: the dosage and frequency as required and tolerated by the patient, the degree and amount of therapeutic effect generated after each administration (e.g., effect on tumor size or growth), and the like. The formulations should provide a sufficient quantity of active agent to effectively treat, prevent or ameliorate conditions, diseases or symptoms.

In alternative embodiments, pharmaceutical formulations for oral administration are in a daily amount of between about 1 to 100 or more mg per kilogram of body weight per day. Lower dosages can be used, in contrast to administration orally, into the blood stream, into a body cavity or into a lumen of an organ. Substantially higher dosages can be used in topical or oral administration or administering by powders, spray or inhalation. Actual methods for preparing parenterally or non-parenterally administrable formulations will be known or apparent to those skilled in the art and are described in more detail in such publications as Remington: The Science and Practice of Pharmacy, 21st ed., 2005.

Various studies have reported successful mammalian dosing using complementary nucleic acid sequences. For example, Esau C., et al., (2006) Cell Metabolism, 3(2):87-98 reported dosing of normal mice with intraperitoneal doses of miR-122 antisense oligonucleotide ranging from 12.5 to 75 mg/kg twice weekly for 4 weeks. The mice appeared healthy and normal at the end of treatment, with no loss of body weight or reduced food intake. Plasma transaminase levels were in the normal range (AST ¾45, ALT ¾35) for all doses with the exception of the 75 mg/kg dose of miR-122 ASO, which showed a very mild increase in ALT and AST levels. They concluded that 50 mg/kg was an effective, non-toxic dose. Another study by Kriitzfeldt J., et al., (2005) Nature 438, 685-689, injected anatgomirs to silence miR-122 in mice using a total dose of 80, 160 or 240 mg per kg body weight. The highest dose resulted in a complete loss of miR-122 signal. In yet another study, locked nucleic acid molecules ("LNA molecules") were successfully applied in primates to silence miR-122. Elmen J., et al., (2008) Nature 452, 896-899, report that efficient silencing of miR-122 was achieved in primates by three doses of 10 mg kg-1 LNA-antimiR, leading to a long-lasting and reversible decrease in total plasma cholesterol without any evidence for LNA-associated toxicities or histopathological changes in the study animals.

In some embodiments, the methods described herein can include co-administration with other drugs or pharmaceuticals, e.g., compositions for providing cholesterol homeostasis. For example, the inhibitory nucleic acids can be co-administered with drugs for treating or reducing risk of a disorder described herein.

EXAMPLES

The invention is further described in the following examples, which do not limit the scope of the invention described in the claims.

Materials and Methods

The following materials and methods were used in the Examples 1-7 set forth below.

RIP-seq

RNA immunoprecipitation was performed (Zhao et al., 2008) using $10^7$ wildtype 16.7 (Lee and Lu, 1999) and Ezh2-/- (Shen et al., 2008) ES cells. To construct RIP-seq libraries, cell nuclei were isolated, nuclear lysates were prepared, treated with 400 U/ml DNAse, and incubated with anti-Ezh2 antibodies (Active Motif) or control IgG (Cell Signaling Technology). RNA-protein complexes were immunoprecipitated with protein A agarose beads and RNA extracted using Trizol (Invitrogen). To preserve strand information, template switching was used for the library construction (Cloonan et al., 2008). 20-150 ng RNA and Adaptor1 (5'-CTTTCCCTACACGACGCTCTTCCGATCT-3'; SEQ ID NO: 193050) were used for first-strand cDNA synthesis using Superscript II Reverse Transcription Kit (Invitrogen). Superscript II adds non-template CCC 3' overhangs, which were used to hybridize to Adaptor2-GGG template-switch primer (5'-CAAGCAGAAGACGGCATACGAGCTCTTC-CGATCTGGG-3'; SEQ ID NO: 193051). During $1^{st}$-strand cDNA synthesis, samples were incubated with adaptor1 at 20° C. for 10 min, followed by 37° C. for 10 min and 42° C. for 45 min. Denatured template switch primer was then added and each tube incubated for 30 min at 42° C., followed by 75° C. for 15 min. Resulting cDNAs were amplified by forward (5'-AATGATACGGCGACCACCGAGATCTA-CACTCTTTCCCTACACGACGCTCTTCC GATCT-3'; SEQ ID NO: 193052) and reverse (5'-CAAGCAGAAGACG-GCATACGAGCTCTTCCGATCT-3'; SEQ ID NO: 193053) Illumina primers. PCR was performed by Phusion polymerase (BioRad) as follows: 98° C. for 30 s, 20-24 cycles of [98° C. 10 s, 65° C. 30 s, 72° C. 30 s], and 72° C. for 5 min. PCR products were loaded on 3% NuSieve gel for size-selection and 200-1,200 by products were excised and extracted by QIAEX II Agarose Gel Extraction Kit (Qiagen). Minus-RT samples generally yielded no products. DNA concentrations were quantitated by PicoGreen. 5-10 ml of 2-20 nM cDNA samples were sequenced by the Sequencing Core Facility of the Dept. of Molecular Biology, MGH, on the Illumina GAIL Bioinformatic Analysis Complete RIP-seq datasets can be accessed through GEO via series GSE17064. Except as noted below, all analyses were performed using custom C++ programs. Image processing and base calling were performed using the Illumina pipeline. 3' adaptor sequences were detected by crossmatch and matches of ≥5 bases were trimmed, homopolymer reads filtered, and reads matching the mitochondrial genome and ribosomal RNAs excluded from all subsequent analyses. Remaining sequences were then aligned to the mm9 mouse reference genome using shortQueryLookup (Batzoglou et al., 2002). Alignments with ≤1 error were retained. Because library construction and sequencing generate sequence from the opposite strand of the PRC2-bound RNA, in all further analysis, we treated each read as if it were reverse-complemented. To determine the correlation coefficients comparing the original a-Ezh2 RIP-seq library to its technical and biological replicates and also to RIP-seq of the Ezh2-/- control line, we compared the number of reads per gene between two samples and, for each pair, we computed the Pearson correlation between the number of reads mapped to each refGene. That is, for each sample, we created a vector of counts of reads mapped to each refGene and computed the Pearson correlation between all pairs of vectors.

Locations of repetitive sequences in mm9 (RepeatMasker) were obtained from the UCSC Genome Browser database (Kent et al., The human genome browser at UCSC. Genome Res. 2002 June; 12(6):996-1006; Fujita et al., "The UCSC Genome Browser database: update 2011." Nucleic Acids Res. 2010 Oct. 18) The overlap of PRC2 transcriptome reads with these repeats was obtained by intersecting coordinates of RepeatMasker data with coordinates of read alignments. The UCSC transcriptome was used as general reference (available online at hgdownload.cse.ucsc.edu/goldenPath/mm9/database/transcriptome.txt.gz). To obtain a set of non-overlapping distinct transcribed regions, we sorted the UCSC transcriptome transcripts by start coordinate and merged overlapping transcripts on the same strand (joined UCSC transcriptome: 39,003 transcripts total). We then intersected read alignment coordinates with those of the merged UCSC transcripts to determine the number of UCSC transcripts present in the PRC2 transcriptome. Hits to the transcripts were converted to RPKM units, where the read count is 1/(n*K*M), and n is the number of alignments in the genome, K is the transcript length divided by 1,000, and M is the sequencing depth including only reads mapping to mm9 divided by 1,000,000 (Mortazavi et al., 2008). This normalization allows for comparisons between transcripts of differing lengths and between samples of differing sequencing depths. To generate promoter maps, promoter regions were defined as −10,000 to +2000 bases relative to TSS (obtained from refGene catalog, UCSC Genome Browser,). We plotted read counts overlapping promoter regions, except that the limit of 10 alignments was relaxed. For the chromosomal alignments in FIG. 1H and FIGS. 7-12, read numbers were computed for all non-overlapping consecutive 100 kb windows on each chromosome. Reads were normalized such that those mapping to n locations were counted as $1/n^{th}$ of a read at each location. Graphs were plotted using custom scripts written in R. To generate Tables 3-7, a list of all enriched transcripts were found by comparing the RPKM scores on each strand for all transcripts in the WT and Ezh2−/− samples. Then their coordinates were intersected with coordinates of the feature of interest. Features not in NCBI37/mm9 mouse assembly coordinates were converted to those coordinates using UCSC's LiftOver utility (The liftOver utility effectively maps one genome to another, allowing rapid identification of regions of interest between successive assemblies of the same species or between two distinct species; available online at genome.ucsc.edu/cgi-bin/hgLiftOver). Only features whose coordinates were convertible are shown.

RIP/qRT-PCR

Validation RIPs were performed as described (Zhao et al., 2008) using 5 ul of rabbit anti-mouse-Ezh2 antibodies (Active Motif) or normal rabbit IgG (Millipore). RIP was followed by quantitative, strand-specific RT-PCR using the ICY-CLER IQ™ Real-time detection system (BioRad). Gene-specific PCR primer pairs are:

```
Malat-1:
                                    SEQ ID NO: 193054
Forward 5'-GCCTTTTGTCACCTCACT-3';
                                    SEQ ID NO: 193055
Reverse 5'-CAAACTCACTGCAAGGTCTC-3';

Malat1-as:
                                    SEQ ID NO: 193056
Forward 5'-TACTGGGTCTGGATTCTCTG-3';
                                    SEQ ID NO: 193057
Reverse 5'-CAGTTCCGTGGTCTTTAGTG-3';

Foxn2-as:
                                    SEQ ID NO: 193058
Forward 5'-GGCTATGCTCATGCTGTAAC;
                                    SEQ ID NO: 193059
Reverse 5'-GTTACTGGCATCTTTCTCACA-3';

Ly6e-as:
                                    SEQ ID NO: 193060
Forward 5'-CCACACCGAGATTGAGATTG-3';
                                    SEQ ID NO: 193061
Reverse 5'-GCCAGGAGAAAGACCATTAC-3';

Bgn-as:
                                    SEQ ID NO: 193062
Forward 5'-TGTGAACCCTTTCCTGGA-3';
                                    SEQ ID NO: 193063
Reverse 5'-CTTCACAGGTCTCTAGCCA-3';

Gtl2:
                                    SEQ ID NO: 193064
Forward 5'-CGAGGACTTCACGCACAAC-3';
                                    SEQ ID NO: 193065
Reverse 5'-TTACAGTTGGAGGGTCCTGG-3';

Gtl2-as:
                                    SEQ ID NO: 193066
Forward 5'-CACCCTGAACATCCAACA-3';
                                    SEQ ID NO: 193067
Reverse 5'-CATCTGCTTTTCCTACCTGG-3';

Hapa1-upstream:
                                    SEQ ID NO: 193068
Forward 5'-GGTCCAAAATCGGCAGT-3';
                                    SEQ ID NO: 193069
Reverse 5'-GTCCTCAAATCCCTACCAGA-3';

Htr6-downstream:
                                    SEQ ID NO: 193070
Forward 5'-ACACGGTCGTGAAGCTAGGTA-3';
                                    SEQ ID NO: 193071
Reverse 5'-CAGTTGGAGTAGGCCATTCCC-3';

Nespas/TR019501:
                                    SEQ ID NO: 193072
Forward 5'-AGATGAGTCCAGGTGCTT-3';
                                    SEQ ID NO: 193073
Reverse 5'-CAAGTCCAGAGTAGCCAAC-3';
```

Xist-Forward 3F5 and -Reverse 2R primers have been described (Zhao et al., 2008). For strand-specific cDNA synthesis, the reverse primer was used, qPCR carried out with SYBR green (BioRad), and threshold crossings (Ct) recorded. Each value was normalized to input RNA levels.

Northern Blot Analysis

5 μg of poly(A+) RNA were isolated from 16.7 ES cells, separated by 0.8% agarose gel containing formaldehyde, blotted onto Hybond-XL (GE Healthcare), and hybridized to probe using Ultrahyb (Ambion) at 42° C. Probes were generated using STRIP-EZ PCR kit (Ambion) and amplified from genomic DNA with:

```
Malat1-AS-F,
                                    SEQ ID NO: 193074
5'-TGGGCTATTTTTCCTTACTGG-3';

Malat1-AS-R,
                                    SEQ ID NO: 193075
5'-GAGTCCCTTTGCTGTGCTG-3';

(Gtl2) Meg3-F,
                                    SEQ ID NO: 193076
5'-GCGATAAAGGAAGACACATGC-3';

Meg3-R,
                                    SEQ ID NO: 193077
5'-CCACTCCTTACTGGCTGCTC-3';

Meg3 ds-F3,
                                    SEQ ID NO: 193078
5'-ATGAAGTCCATGGTGACAGAC-3';

Meg3 ds-R2,
                                    SEQ ID NO: 193079
5'-ACGCTCTCGCATACACAATG-3';

Rtl1-F,
                                    SEQ ID NO: 193080
5'-GTTGGGGATGAAGATGTCGT-3';

Rtl1-R,
                                    SEQ ID NO: 193081
5'-GAGGCACAAGGGAAAATGAC-3';

Nespas ds-F,
                                    SEQ ID NO: 193082
5'-TGGACTTGCTACCCAAAAGG-3';

Nespas ds-R,
                                    SEQ ID NO: 193083
5'-CGATGTTGCCCAGTTATCAG-3';

Bgn-AS-F,
                                    SEQ ID NO: 193084
5'-CAACTGACCTCATAAGCAGCAC-3';
```

```
Bgn-AS-R,
                              SEQ ID NO: 193085
5'-AGGCTGCTTTCTGCTTCACA-3';

Htr6 up-F,
                              SEQ ID NO: 193086
5'-ATACTGAAGTGCCCGGAGTG-3';

Htr6 up-R,
                              SEQ ID NO: 193087
5'-CAGGGGACAGACATCAGTGAG-3';.
```

UV-Crosslink RIP

UV-crosslink IP was performed as described (Ule et al., 2005), except that transcripts in the RNA-protein complexes were not trimmed by RNAse treatment prior to RNA isolation in order to preserve full-length RNA for RT-PCR. Mouse ES cells were UV-irradiated at 254 nm, 400 mJ/cm$^2$ (using a Stratagene STRATALINKER), cell nuclei were lysed in RSB-TRITON buffer (10 mM Tris-HCl, 100 mM NaCl, 2.5 mM MgCl$_2$, 35 μg/mL digitonin, 0.5% triton X-100) with disruptive sonication. Nuclear lysates were pre-cleared with salmon sperm DNA/protein agarose beads for 1 hr at 4° C. and incubated with antibodies overnight. RNA/antibody complexes were then precipitated with Protein A DYNA-BEADS (Invitrogen), washed first in a low-stringency buffer (1×PBS [150 mM NaCl], 0.1% SDS, 0.5% deoxycholate, 0.5% NP-40), then washed twice in a high-stringency, high-salt buffer (5×PBS [750 mM NaCl], 0.1% SDS, 0.5% deoxycholate, 0.5% NP-40), and treated with proteinase K. RNA was extracted using TRIZOL (Invitrogen) and RT-qPCR was performed as described above.

Expression and Purification of Human PRC2 Components

For expression of human PRC2 subunits, N-terminal flagged-tagged EZH2 and SUZ12 in pFastBac1 were expressed in Sf9 cells (Francis et al., 2001). For expression of the whole PRC2 complex, flag-tagged EZH2 was coexpressed with untagged SUZ12, EED, and RBAP48. Extracts were made by four freeze-thaw cycles in BC300 buffer (20 mM HEPES pH 7.9, 300 mM KCl, 0.2 mM EDTA, 10% glycerol, 1 mM DTT, 0.2 mM PMSF, and complete protease inhibitors (Roche)) and bound to M2 beads for 4 h and washed with BC2000 before eluting in BC300 with 0.4 mg/ml flag peptide. EZH2 and PRC2 were adjusted to 100 mM KCl and loaded onto a HiTrap Heparin FF 1 ml column and eluted with a 100-1000 mM KCl gradient. Peak fractions were concentrated using Amicon ultra 10 kDa MWCO concentrators (Millipore) and loaded onto a Superose 6 column equilibrated with BC300. Peak fractions were collected and concentrated. For SUZ12, the flag elution was concentrated and loaded onto a Superdex 200 column equilibrated with BC300.

Electrophoretic Mobility Shifting Assays (EMSA)

RNA-EMSA is performed as previously described (Zhao et al., 2008). The 30 nt Hes-1 probe (~270 bp downstream of TSS in an antisense direction) was used for gel shifts. RNA probes were radiolabeled with [γ-33p]ATP using T4 polynucleotide kinase (Ambion). Purified PRC2 proteins (1 μg) were incubated with labeled probe for 1 hr at 4 C. RNA-protein complexes were separated on a 4% non-denaturing polyacrylamide gel in 0.5×TBE at 250 V at 4° C. for 1 h. Gels were dried and exposed to Kodak BioMax film.

RNA Pulldown Assays

We incorporated T7 promoter sequence into forward primers for PCR products of RepA, Xist exon 1, and truncated Gtl2. Full-length Gtl2 was cloned into pYX-ASC and XistE1 into pEF1/V5/HisB (Invitrogen). Specific primer sequences were:

```
RepA-F:
                              SEQ ID NO: 193088
TAATACGACTCACTATAGGGAGAcccatcggggccacggatacctg
tgtgtcc;

RepA-R:
                              SEQ ID NO: 193089
taataggtgaggtttcaatgatttacatcg;

Truncated-Gtl2-F:
                              SEQ ID NO: 193090
TAATACGACTCACTATAGGGAGATTCTGAGACACTGACCATGTGCCCA
GTGCACC;

Truncated-Gtl2-R:
                              SEQ ID NO: 193091
CGTCGTGGGTGGAGTCCTCGCGCTGGGCTTCC;

Xist E1-F:
                              SEQ ID NO: 193092
atgctctgtgtcctctatcaga;

Xist E1-R:
                              SEQ ID NO: 193093
gaagtcagtatggagggggt;
```

RNAs were then transcribed using the Mega Script T7 (Ambion), purified using Trizol, and slow-cooled to facilitate secondary structure formation. For pulldown assays, 3 μg of Flag-PRC2 or Flag-GFP and 5 pmol of RNA supplemented with 20U RNAsin were incubated for 30 min on ice. 10 μl of flag beads were added and incubated on a rotating wheel at 4° C. for 1 hr. Beads were washed 3 times with 200 μl buffer containing 150 mM KCl, 25 mM Tris pH 7.4, 5 mM EDTA, 0.5 mM DTT, 0.5% NP40 and 1 mM PMSF. RNA-protein complexes were eluted from flag beads by addition of 35 μl of 0.2M-glycine pH2.5. Eluates were neutralized by addition of $\frac{1}{10}^{th}$ volume of 1M Tris pH 8.0 and analyzed by gel electrophoresis.

Knockdown Analysis and qRT-PCR shRNA oligos were cloned into MISSION pLKO.1-puro (Sigma-Aldrich) vector and transfected into wild-type mouse ES cells by Lipofectamine 2000 (Invitrogen). After 10 days of puromycin selection, cells were collected and qRT-PCR was performed to confirm RNA knockdown. The corresponding scrambled sequence (MISSION Non-target shRNA) was used as a control (Scr). The shRNA oligos for Gtl2: (Top strand) 5'-CCG GGC AAG TGA GAG GAC ACA TAG GCT CGA GCC TAT GTG TCC TCT CAC TTG CTT TTT G-3; SEQ ID NO: 193094 (Bottom strand) 5'-AAT TCA AAA AGC AAG TGA GAG GAC ACA TAG GCT CGA GCC TAT GTG TCC TCT CAC TTG C-3; SEQ ID NO: 193095. qPCR primers for Gtl2 and Gtl2-as RNAs are as described above. Primers for Dlk1 RNAs: (Forward) 5'-ACG GGA AAT TCT GCG AAA TA-3; SEQ ID NO: 193096 (Reverse) 5'-CTT TCC AGA GAA CCC AGG TG-3; SEQ ID NO: 193097. Another Gtl2 shRNA was purchased from Open Biosystems (V2MM_97929) Ezh2 levels after knockdown with this shRNA were tested by qPCR (Zhao et al., 2008). After testing multiple clones, we concluded that Gtl2 could be knocked down in early passage clones (50-70%), but knockdown clones were difficult to maintain in culture long-term.

DNA ChIP and Real-Time PCR

ChIP was performed as described (Zhao et al., 2008). 5 μl of α-Ezh2 antibodies (Active Motif 39103), normal rabbit IgG (Upstate 12-370), and α-H3K27me3 (Upstate) were used per IP. Real-time PCR for ChIP DNA was performed at the Gtl2-proximal DMR with prGtl2F/prGtl2R, at the Gtl2-distal DMR with DMR-F/DMR-R, at the Dlk1 promoter with prDlk1F/prDlk1R, and at the Gapdh promoter with prGAPDH-F/prGAPDH-R. Primer sequences are as follows:

proximal-DMR
SEQ ID NO: 193098
5'-CATTACCACAGGGACCCCATTTT;

proximal-DMR
SEQ ID NO: 193099
5'-GATACGGGGAATTTGGCATTGTT;

prDlk1F
SEQ ID NO: 193100
5'-CTGTCTGCATTTGACGGTGAAC;

prDlk1R
SEQ ID NO: 193101
5'-CTCCTCTCGCAGGTACCACAGT;

distal-DMR-F
SEQ ID NO: 193102
5'-GCCGTAAAGATGACCACA;

distal-DMR-R
SEQ ID NO: 193103
5'-GGAGAAACCCCTAAGCTGTA;

prGAPDH-F
SEQ ID NO: 193104
5'-AGCATCCCTAGACCCGTACAGT;

prGAPDH-R
SEQ ID NO: 193105
5'-GGGTTCCTATAAATACGGACTGC;

prActin-F
SEQ ID NO: 193106
5'-GCA GGC CTA GTA ACC GAG ACA;

prActin-R
SEQ ID NO: 193107
5'-AGT TTT GGC GAT GGG TGC T;

The following materials and methods were used in Examples 10-15 set forth below.

LNA Nucleofection—

$2\times10^6$ SV40T transformed MEFs were resuspended in 100 µl of Mef nucleofector solution (Lonza). Cy3-labeled LNA molecules were added to a final concentration of 2 µM. The cells were transfected using the T-20 program. 2 ml of culture medium was added to the cells and 100 µl of this suspension was plated on one gelatinized 10 well slide per timepoint. LNA sequences were designed using Exiqon software (available at exiqon.com). Modified LNA bases were strategically introduced to maximize target affinity (Tm) while minimizing self-hybridization score. The LNA molecule sequences (from 5' to 3') were as follows:

LNA-Scr,
SEQ ID NO: 193108
GTGTAACACGTCTATACGCCCA;

LNA-C1,
SEQ ID NO: 193109
CACTGCATTTTAGCA;

LNA-C2,
SEQ ID NO: 193110
AAGTCAGTATGGAG;

LNA-B,
SEQ ID NO: 193111
AGGGGCTGGGGCTGG;

LNA-E,
SEQ ID NO: 193112
ATAGACACACAAAGCA;

LNA-F,
SEQ ID NO: 193113
AAAGCCCGCCAA;

LNA-4978,
SEQ ID NO: 193114
GCTAAATGCACACAGGG;

LNA-5205,
SEQ ID NO: 193115
CAGTGCAGAGGTTTTT;

LNA-726,
SEQ ID NO: 193116
TGCAATAACTCACAAAACCA;

LNA-3',
SEQ ID NO: 193117
ACCCACCCATCCACCCACCC;

Real Time PCR—

Total RNA was extracted after nucleofection using Trizol (Invitrogen). Reverse transcriptase reaction was performed using the Superscript II kit and real time PCR performed on cDNA samples using icycler SYBR green chemistry (Biorad).

ChIP—

Cells were fixed at various time points after nucleofection in 1% formaldehyde solution. Fixation was stopped by addition of glycine to 0.125M and ChIP was performed as described earlier (28) and quantitated by qPCR.

Antibodies—

The antibodies for various epitopes were purchased as follows: H3K27me3, Active Motif 39535 Ezh2, Active Motif 39639 and BD Pharmingen 612666. For Immunostaining, H3K27me3 antibodies were used at 1:100 dilution and Ezh2 antibodies (BD Pharmingen) at 1:500. Alexa-Fluor secondary antibodies were from Invitrogen. For Western blots, Ezh2 antibodies (BD Pharmingen) were used at 1:2000 dilution. Actin antibody (Sigma A2066) was used at 1:5000 dilution.

DNA FISH, RNA FISH, and Immunostaining—

Cells were grown on gelatinized glass slides or cytospun. RNA FISH, DNA FISH, serial RNA-DNA FISH, immunostaining, and immunoFISH were performed as described (24). Xist RNA FISH was performed using nick-translated pSx9-3 probe or an Xist riboprobe cocktail. pSx9-3 was used as probe for Xist DNA FISH. For metaphase spreads, colchicine was added to cells for 1 hr. Cells were trypsinized and resuspended in 3 ml of 0.056M KCl for 30 minutes at room temperature, centrifuged and resuspended in methanol:acetic acid (3:1) fixative. After several changes of fixative, cells were dropped on a chilled slide and processed for RNA or DNA FISH.

Example 1

Capturing the PRC2 Transcriptome by RIP-Seq

Native RNA immunoprecipitations (RIP) previously identified RepA, Xist, and Tsix as PRC2-interacting RNAs (Zhao et al., 2008). Here, we developed a method of capturing the genome-wide pool bound to PRC2 by combining native RIP (Zhao et al., 2008) and RNA-seq (Cloonan et al., 2008) (this method is referred to herein as "RIP-seq;" see an exemplary FIG. 1A). Nuclear RNAs immunoprecipitated by α-Ezh2 antibodies were isolated from mouse ES cells (Lee and Lu, 1999) and an Ezh2−/− control (Shen et al., 2008) (FIG. 1B), cDNAs created using strand-specific adaptors, and those from 200-1,200 nt were purified and subjected to Illumina sequencing (FIG. 1C).

In pilot experiments, we performed RIP on $10^7$ ES cells and included several control RIPs to assess the specificity of α-Ezh2 pulldowns. In the wildtype pulldown and its technical and biological replicates, α-Ezh2 antibodies precipitated 70-170 ng of RNA from 107 ES cells and yielded a cDNA smear of >200 nt (FIG. 1C, FIG. 7A). Treatment with RNAses eliminated products in this size range (FIG. 7B) and -RT samples yielded no products, suggesting that the immunoprecipitated material was indeed RNA. There was ~10-fold less RNA in the Ezh2-/- pulldown (~14 ng) and when wildtype cells were immunoprecipitated by IgG (~24 ng). A 500-fold enrichment over a mock RIP control (no cells) was also observed. In the >200 nt size range, control RIPs (null cells, IgG pulldowns, mock) were even further depleted of RNA, as these samples were dominated by adaptor and primer dimers. We computationally filtered out adaptor/primer dimers, rRNA, mitochondrial RNA, reads with <18 nt or indeterminate nucleotides, and homopolymer runs in excess of 15 bases (FIG. 7). From an equivalent number of cells, control RIPs were significantly depleted of reads (FIG. 7D). In wildtype libraries, 231,880-1.2 million reads remained after filtering. By contrast, only 4,888 to 73,691 reads remained in controls (FIG. 1D, columns 2 and 3). The overwhelming majority of transcripts in the controls were of spurious nature (adaptor/primer dimers, homopolymers, etc.). Therefore, wildtype RIPs exhibited substantial RNA enrichment and greater degrees of RNA complexity in comparison to control RIPs.

Approximately half of all reads in the wildtype libraries was represented three times or more. Even after removing duplicates to avoid potential PCR artifacts, the wildtype library contained 301,427 distinct reads (technical and biological replicates with 98,704 and 87,128, respectively), whereas control samples yielded only 1,050 (IgG) and 17,424 (null)(FIG. 1D). The wildtype libraries were highly similar among each other, with correlation coefficients (CC) of 0.71-0.90, as compared to 0.27-0.01 when compared against Ezh2-/- and IgG controls, respectively (FIG. 1E). Reads mapping to repetitive elements of >10 copies/genome accounted for <20% of total wildtype reads (FIG. 1F), with simple repeats being most common and accounting for 85.714%, whereas LINEs, SINES, and LTRs were relatively under-represented (FIG. 1G). Because reads with ≤10 alignments have greatest representation, we hereafter focus analysis on these reads (a cutoff of ≤10 retains genes with low-copy genomic duplications).

Figures 1H, 1I:
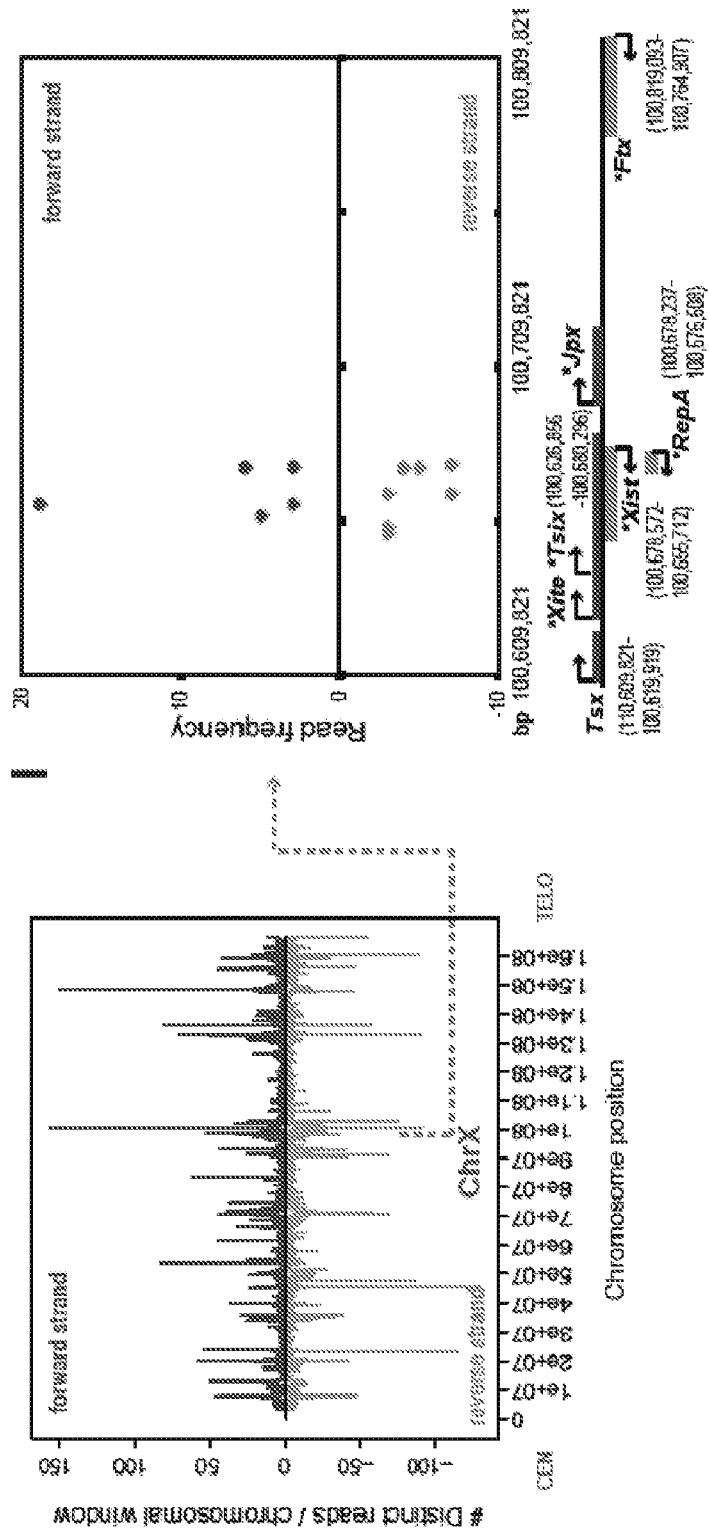
Figure 1J:
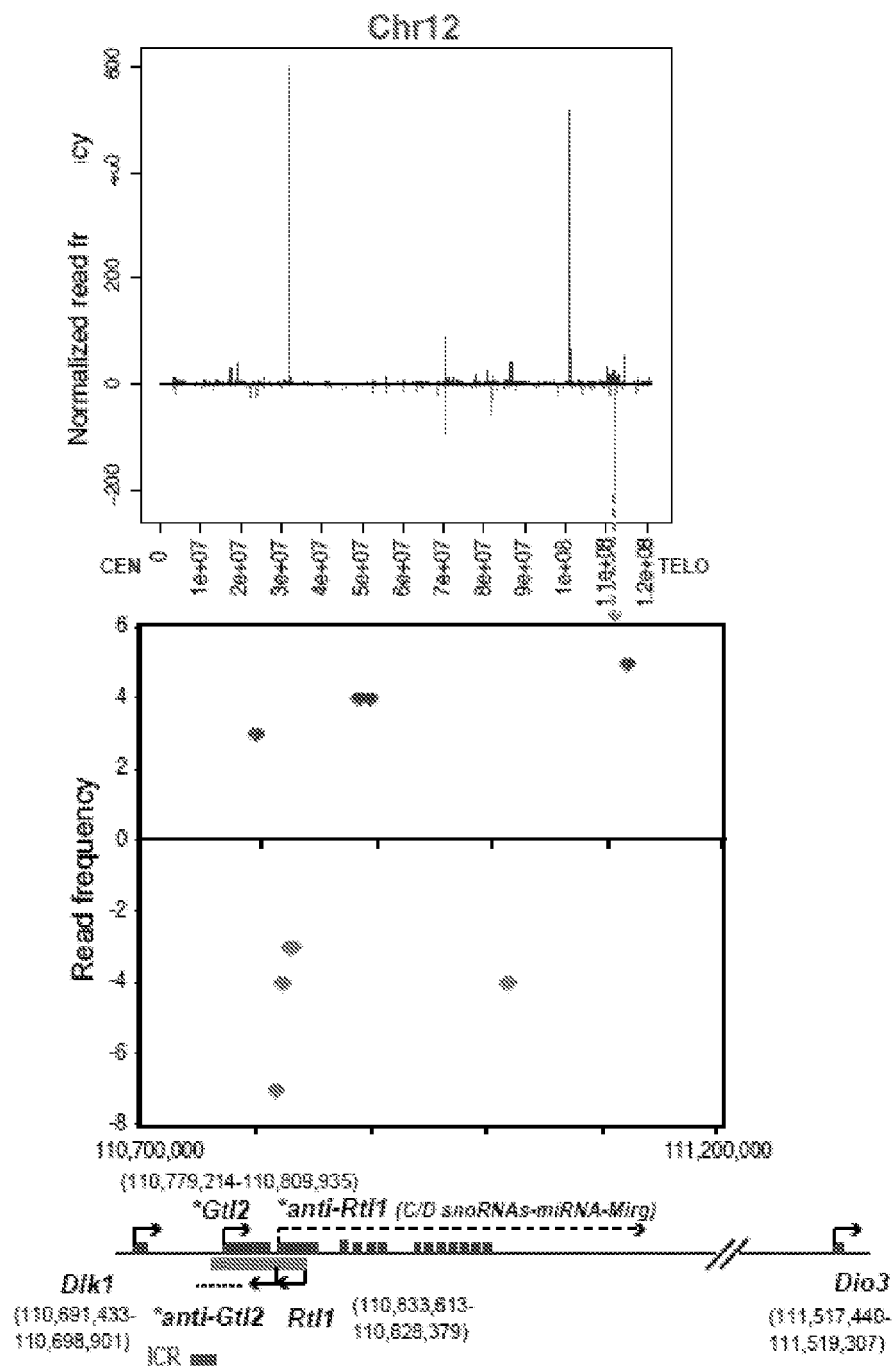
Figures 1K, 1L, 1M:
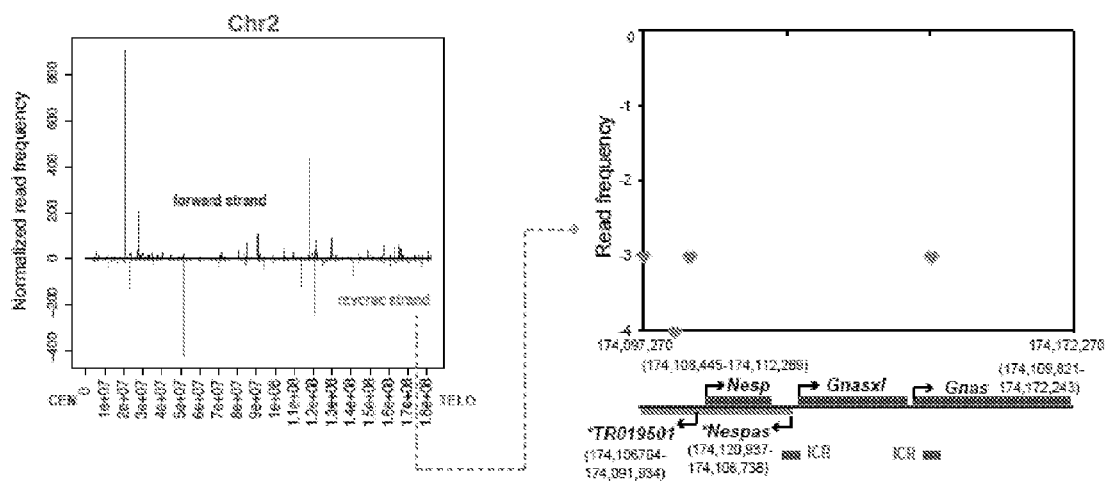

We next examined their genome distribution by plotting distinct reads as a function of chromosome position (FIGS. 8-12). The alignments showed that PRC2-associated RNAs occurred on every chromosome in the wildtype libraries. Alignments for IgG and Ezh2-/- controls demonstrated few and sporadic reads. Therefore, our RIP-seq produced a specific and reproducible profile for the PRC2 transcriptome. A large number of wildtype reads hits the X-chromosome (FIG. 1H), and a zoom of the X-inactivation center showed that our positive controls—Tsix, RepA, and Xist RNAs—were each represented dozens of times (FIG. 1I). The high sensitivity of our RIP-seq detection was suggested by representation of RepA and Xist, which are in aggregate expressed at <10 copies/ES cell (Zhao et al., 2008). On the other hand, no hits occurred within other noncoding RNAs of the X-inactivation center. Thus, the RIP-seq technique was both sensitive and specific.

Example 2

The PRC2 Transcriptome

To obtain saturating coverage, we scaled up sequencing and obtained 31.9 million reads for the original wildtype sample and 36.4 million for its biological replicate. After removing duplicates and filtering as shown in FIG. 7A, 1,030,708 and 852,635 distinct reads of alignment ≤10 remained for each library, respectively. These reads were then combined with pilot wildtype reads for subsequent analyses (henceforth, WT library) and all analyses were performed using the Ezh2-/- library as control.

Figure 2A:
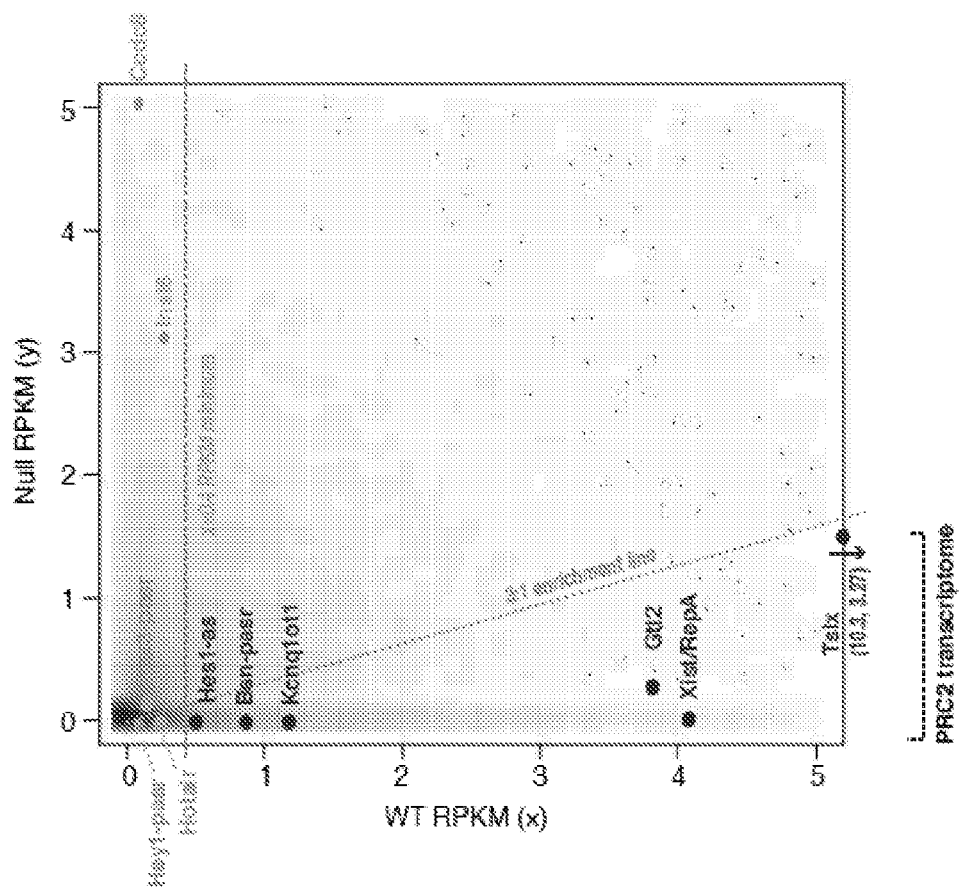

To determine a threshold for calling transcripts a member of the "PRC2 transcriptome", we designed a strategy based on (i) the number of distinct reads per transcript, on the principle that bona fide PRC2-interacting transcripts should have higher read densities than background, and (ii) the relative representation in the WT versus null libraries, reasoning that bona fide positives should be enriched in the WT. We calculated genic representations using "reads per kilobase per million reads" (RPKM) as a means of normalizing for gene length and depth of sequencing (Mortazavi et al., 2008), and then mapped all 39,003 transcripts in the UCSC joined transcriptome to a scatterplot by their WT RPKM (x-axis) and their null RPKM (y-axis) values (FIG. 2A). Transcripts with zero or near-zero representation in both libraries accounted for the vast majority of datapoints [blue cloud at (0,0)]. Transcripts with nonzero x-values and a zero y-value indicated a population represented only in WT pulldowns (FIG. 2A, y=0 line).

We established a density minimum by using control transcripts as calibration points. Xist/RepA scored an RPKM of 4.19, implying 126 distinct reads per million. Tsix scored 10.35, and Bsn-pasr (~300-nt Bsn-promoter associated transcript (Kanhere et al., 2010)) scored 0.95. The imprinted antisense transcript, Kcnq1ot1, has been proposed to interact with PRC2, though whether it does so directly is not known (Pandey et al., 2008). Kcnq1ot1 scored 1.17. For negative controls, we used transcripts that a priori should not be in the WT library. For example, Hotair is expressed later in development only in caudal tissues (Rinn et al., 2007). It scored 0.25, implying only a single representation per million. Two other promoter-associated RNAs, Hey1-pasr and Pax3-pasr (Kanhere et al., 2010), are <200 nt and fell outside of our size-selection scheme. They scored 0.28 and 0.11, respectively, suggesting <<1 distinct reads per million. Cytoplasmically localized protein-coding mRNAs that are not expected to be PRC2-interacting also showed low RPKM [Ins16 0.27, Ccdc8 0.22]. We consider these low representations background. On the basis of the calibration points, we set the RPKM minimum at x=0.40, which falls between values for positive and negative controls.

To determine an appropriate enrichment threshold, we examined WT/null RPKM ratios for the same calibrators. Xist/RepA scored 4.18/0, implying hundreds to thousands of representations in the WT library but none in the null. Tsix scored 10.35/3.27, Bsn-pasr 0.95/0, and Kcnq1ot1 1.17/0. The negative controls scored low ratios, with Pax3-pasr at 0.11/0.26, Hey1-pasr 0.28/0, Hotair 0.25/0, Ins16 0.27/3.09, and Ccdc8 0.22/5.04. On this basis, we set the enrichment cutoff at 3:1. The combined criteria for transcript inclusion [RPKM(WT)≥0.4, RPKM(WT)/RPKM(null)≥3.0] are expected to eliminate false positives and subtract background based on direct comparisons between WT and null libraries using an established set of controls.

By these criteria, we estimate the PRC2 transcriptome at 9,788 RNAs (Table 2). Some 4,446 transcripts in the joined UCSC transcriptome (39,003 transcripts) were included in our PRC2 transcriptome (FIG. 2B). Another 3,106 UCSC transcripts were hit but only on the reverse strand, implying the existence of 3,106 previously unannotated antisense RNAs. Some 1,118 UCSC transcripts were hit in both directions, implying the existence of 2,236 additional distinct transcripts. 19% of reads did not have a hit in the UCSC database. These "orphan reads" suggest that the transcriptome may include other novel transcripts. Therefore, 9,788 represents a lower bound on the actual PRC2 transcriptome in ES cells. Because the total mouse transcriptome is believed to be anywhere from 40,000 to 200,000, the PRC2 transcriptome comprises 5-25% of all mouse transcripts, depending on the actual size of the total transcriptome.

Example 3

Epigenetic Features

Figure 2C:
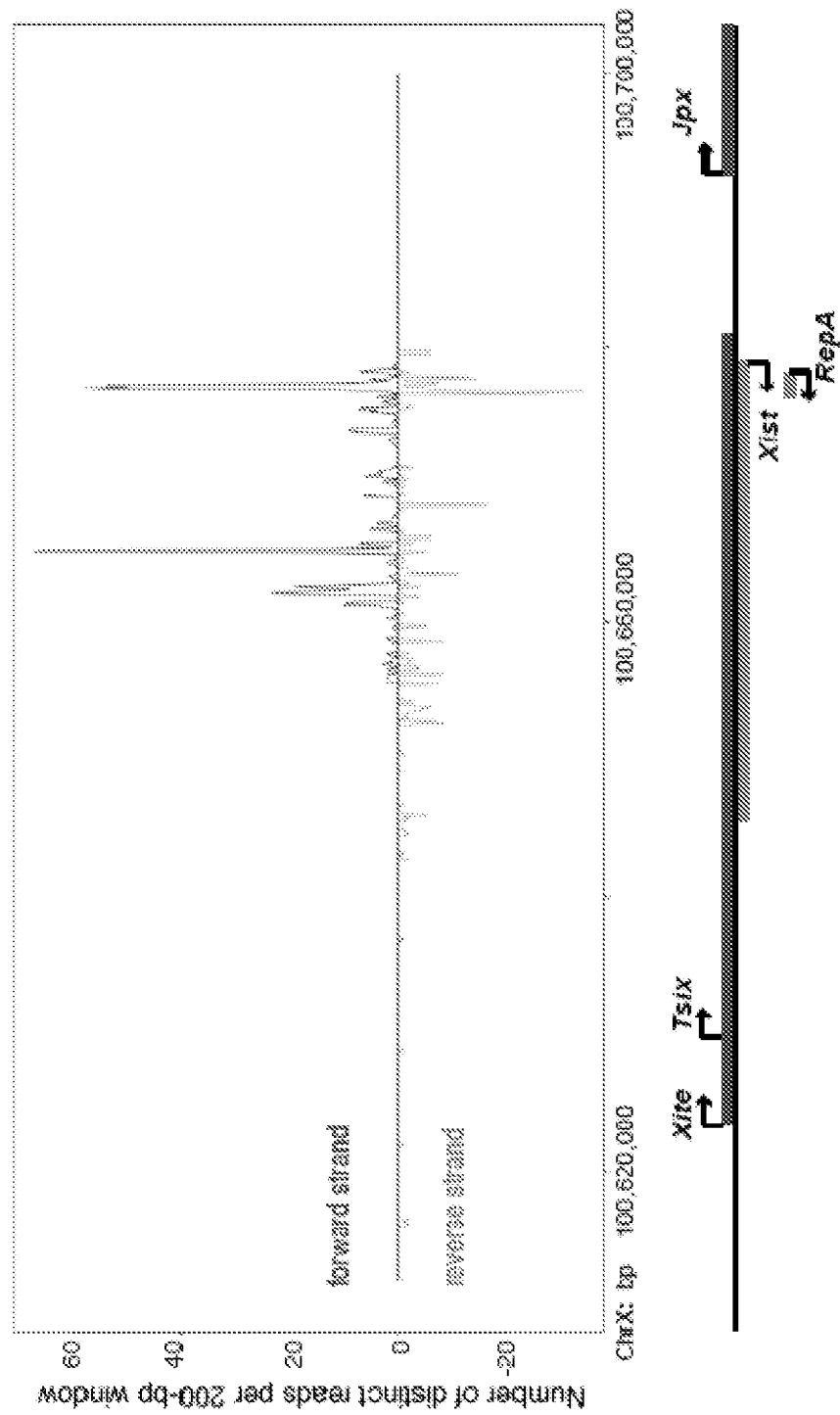
Figure 2D:
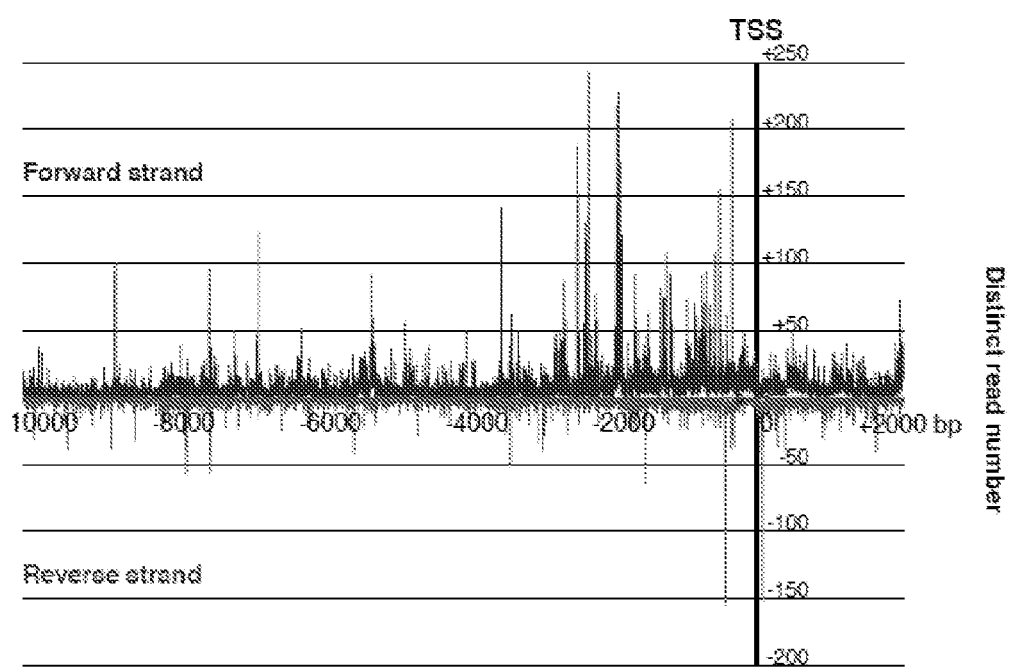
Figure 2F:
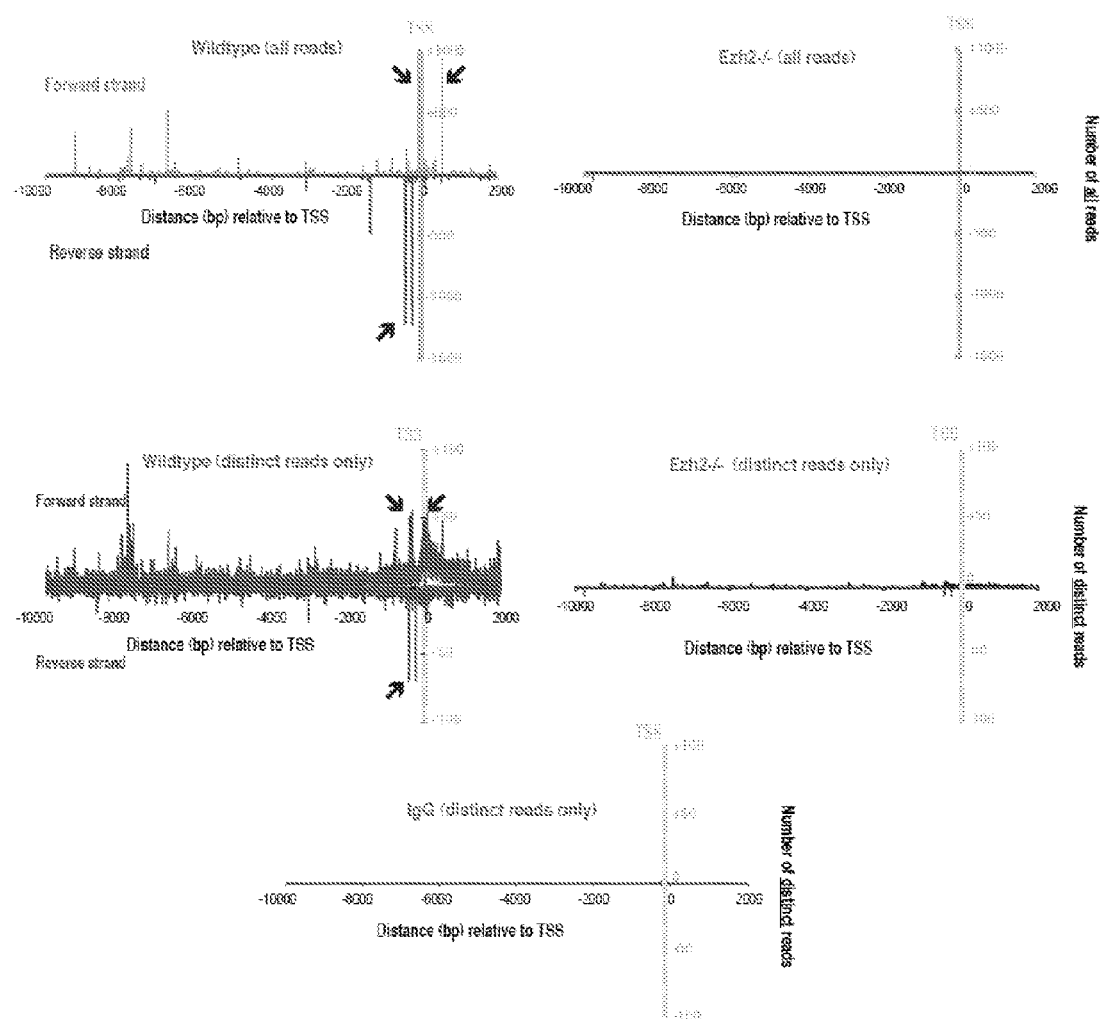
FIG. 2F is a set of three graphs showing the distinct reads (duplicates removed) plotted as a function of distance from the TSS for the WT, Ezh2−/−, and IgG samples. Arrows indicate enrichment near TSS.

We examined specific epigenetic features (FIG. 2B, Tables I, 3 to 7). Interestingly, the RepA region within Xist and the 3' end of Tsix were represented many times (FIG. 2C), a region consistent with the proposed Ezh2 footprint (Zhao et al., 2008). In a metagene analysis, we queried the relationship of transcripts to transcription start sites (TSS) by plotting read numbers as a function of distance (FIG. 2D). On the forward strand, enrichment was observed at −2.0 to +0.001 kb; on the reverse strand, peaks were discernible at −0.5 to +0.1 kb. The enrichment occurred above background (null, IgG controls) (FIG. 7C). TSS association is notable given the existence of short transcripts at promoters (Kapranov et al., 2007; Core et al., 2008; Seila et al., 2008; Taft et al., 2009), PRC2's preferred occupancy near promoters (Boyer et al., 2006; Lee et al., 2006; Schwartz et al., 2006; Ku et al., 2008), and identification of several TSS-associated RNAs which bind PRC2 (Kanhere et al., 2010).

We next asked how much of the PRC2 transcriptome intersects PRC2-binding sites (Boyer et al., 2006; Lee et al., 2006) and bivalent domains in ES cells (Bernstein et al., 2006a; Mikkelsen et al., 2007; Ku et al., 2008). Notably, 562 of 2,704 bivalent domains (21%) and 330 of 1,800 Suz12-binding sites (18%) were hit by at least one RNA (FIG. 2B, Table 3,4), raising the possibility that RNA may be involved in recruiting or retaining Polycomb complexes in a subset of binding sites and control stem cell fate. Sites which do not intersect our transcriptome may recruit PRC2 using other mechanisms.

We also queried the extent of overlap with a group of intergenic ncRNA dubbed "lincRNA" (Guttman et al., 2009). Intersecting 2,127 mouse lincRNA with our 9,788 transcripts revealed an overlap of 216 (FIG. 2B, Table 5), indicating that lincRNA account for ~2% of the PRC2 transcriptome. Of human lincRNA, 260 may have potential to associate with PRC2 (Khalil et al., 2009). To ask whether the 260 human lincRNA overlap with the 216 mouse lincRNA in our PRC2 transcriptome, we mapped syntenic coordinates in the mouse by LiftOver (available on the world wide web at genome.ucsc.edu/cgi-bin/hgLiftOver) but found no recognizable homology between the two subsets. Thus, our transcriptome represents a large and distinct set of PRC2-interacting RNAs.

Because misregulation of Polycomb proteins is often associated with cancer, we intersected PRC2-interacting RNAs with oncogene and tumor suppressor loci (Sparmann and van Lohuizen, 2006; Bernardi and Pandolfi, 2007; Miremadi et al., 2007; Rajasekhar and Begemann, 2007; Simon and Lange, 2008). Intriguingly, of 441 oncogenes and 793 tumor suppressors (available on the world wide web at cbio.mskcc.org/CancerGenes), 182 (41%) and 325 (41%) respectively have at least one PRC2-interacting transcript of either orientation (FIG. 2B, Tables 6, 7), suggesting that RNA may play a role in misregulating Polycomb recruitment in cancer. Notable examples include c-Myc, Brca1, Klf4, and Dnmt1.

Figure 3A:
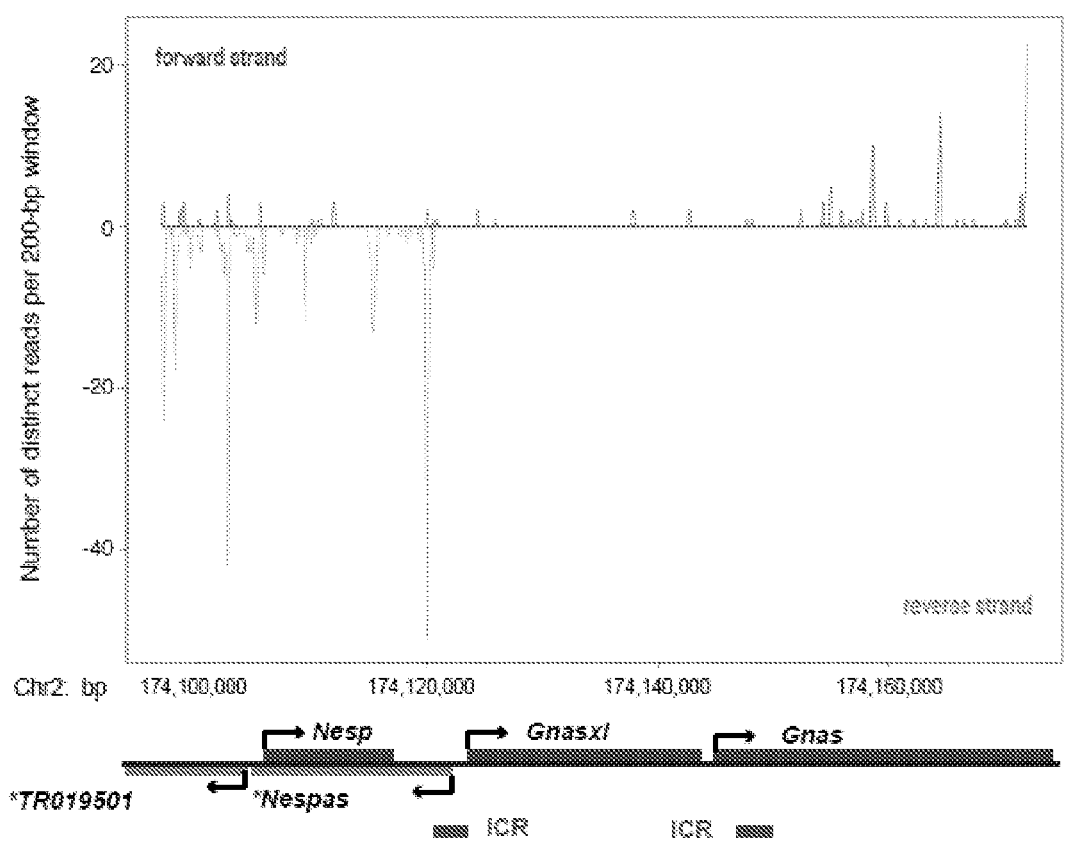
FIGS. 3A-B are read density plots for Nesp/Gnas (A) and Dlk1/Gtl2 (B) imprinted clusters. Distinct reads are smoothed with sliding consecutive 200-bp or 2-kb windows on the x-axis and their representations plotted on the y-axis. *, ncRNA. Chr, chromosome. Dark grey, forward strand; light grey, reverse strand. The Ezh2−/− library is depleted of these reads.
Figure 3B:
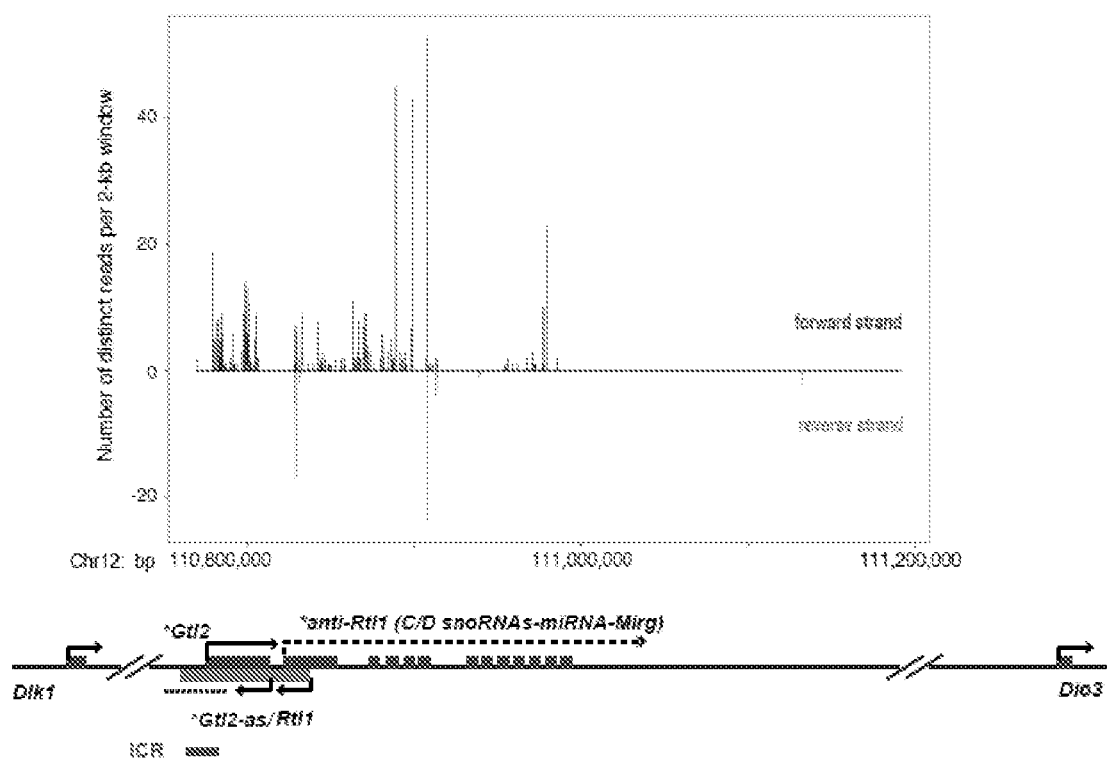

Finally, like X-chromosome inactivation, genomic imprinting must be regulated in cis. Imprinted genes are controlled by a cis-acting 'imprinting control region' (ICR) that dictates parent-specific expression (Edwards and Ferguson-Smith, 2007; Thorvaldsen and Bartolomei, 2007). Interestingly, ICRs are generally associated with long transcripts (Williamson et al., 2006; Pandey et al., 2008; Wan and Bartolomei, 2008), many of which were found in the PRC2 transcriptome (FIG. 2B, Table 2). They include H19, Gtl2, Kcnq1ot1, and Nespas. Multiple hits occurred in Nespas RNA/TR019501 (FIG. 3A), an antisense RNA from the primary ICR thought to regulate the Nesp/Gnas cluster (Coombes et al., 2003; Williamson et al., 2006). Also hit repeatedly was Gtl2 (FIG. 3B), the locus believed to control Dlk1 imprinting (Edwards et al., 2008), along with anti-Rtl1 and an antisense counterpart of Gtl2 (here dubbed Gtl2-as). Hits within ICR-associated long transcripts hint that RNA may regulate imprinted clusters by targeting PRC2.

Example 4

Validation of RNA-PRC2 Interactions

Figure 4A:
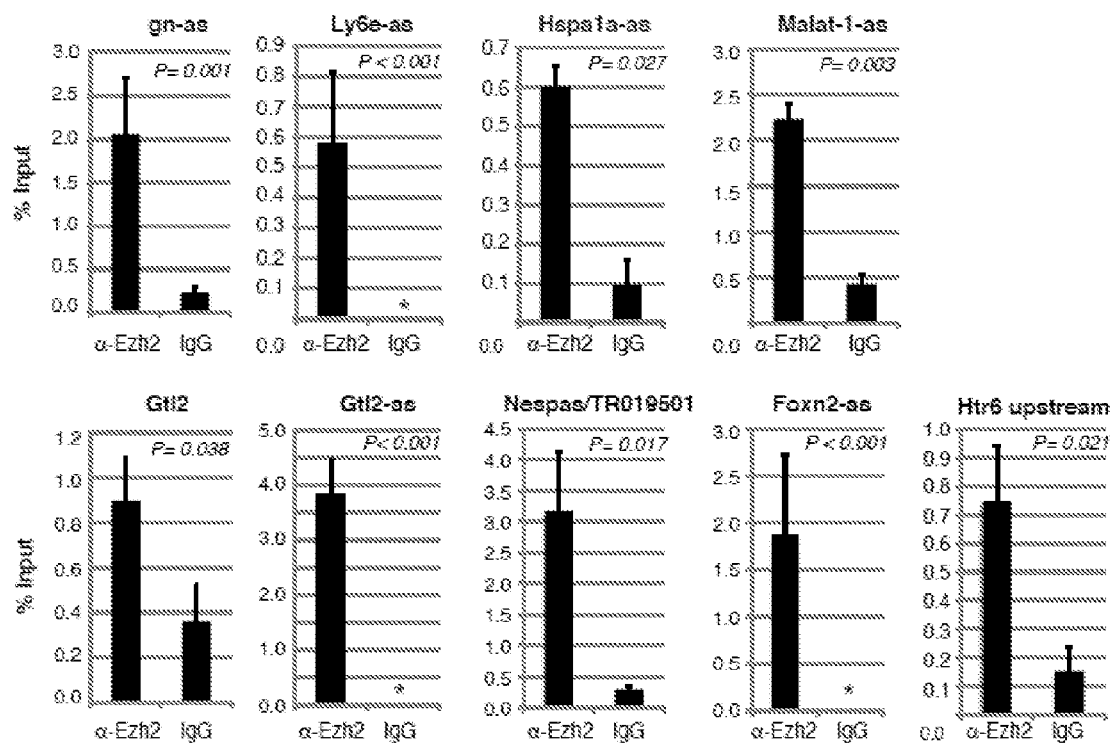
FIG. 4A is a set of nine bar graphs showing the results of qRT-PCR to compare a-Ezh2 and IgG pulldowns. The experiments were performed 2-3 times in triplicate. Error bar=1 standard deviation (SD). P was calculated using the two-tailed student t-test. Asterisks, undetectable levels.
Figure 4B:
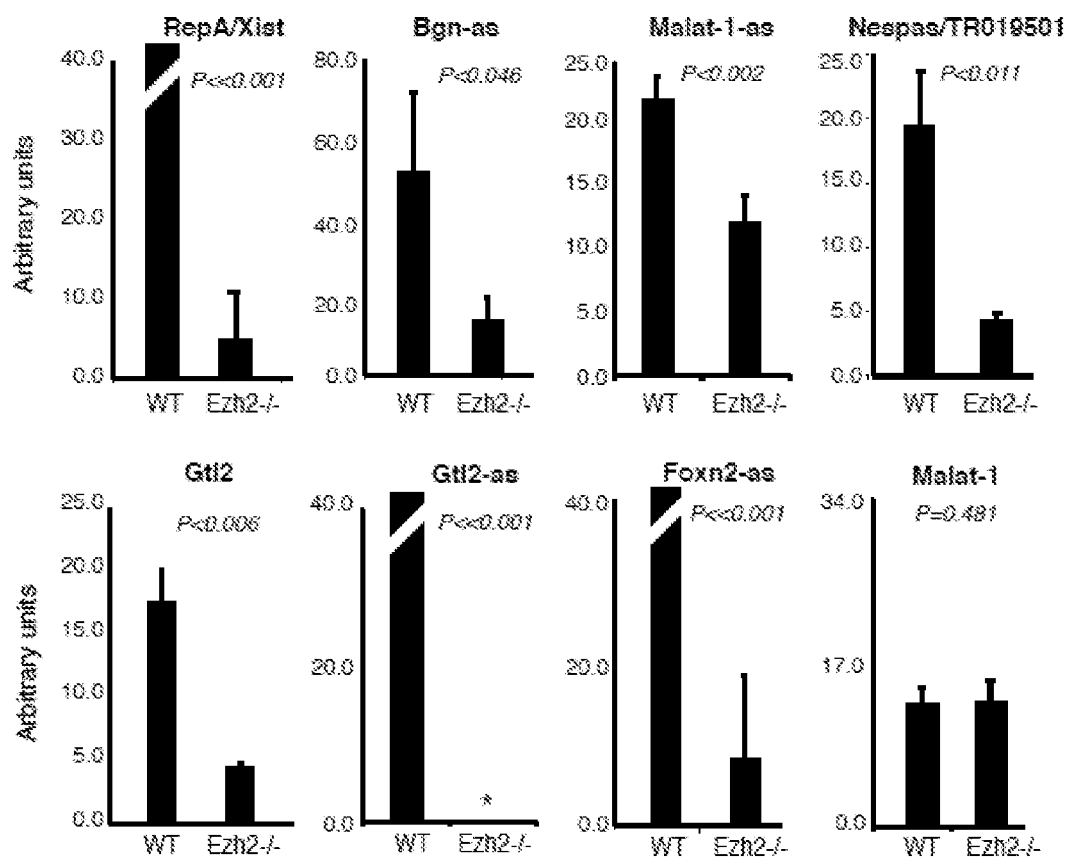
FIG. 4B is a set of eight bar graphs showing the results of qRT-PCR after native a-Ezh2 RIP of wildtype and null ES cells, each normalized to IgG RIP values. Values for Xist, Gtl2-as, and Foxn2-as were off-chart. Experiments were performed 2-4 times in triplicate. 1 SD shown. P is calculated using the paired, two-tailed student t-test. Asterisks, undetectable RNA levels.
Figure 4C:
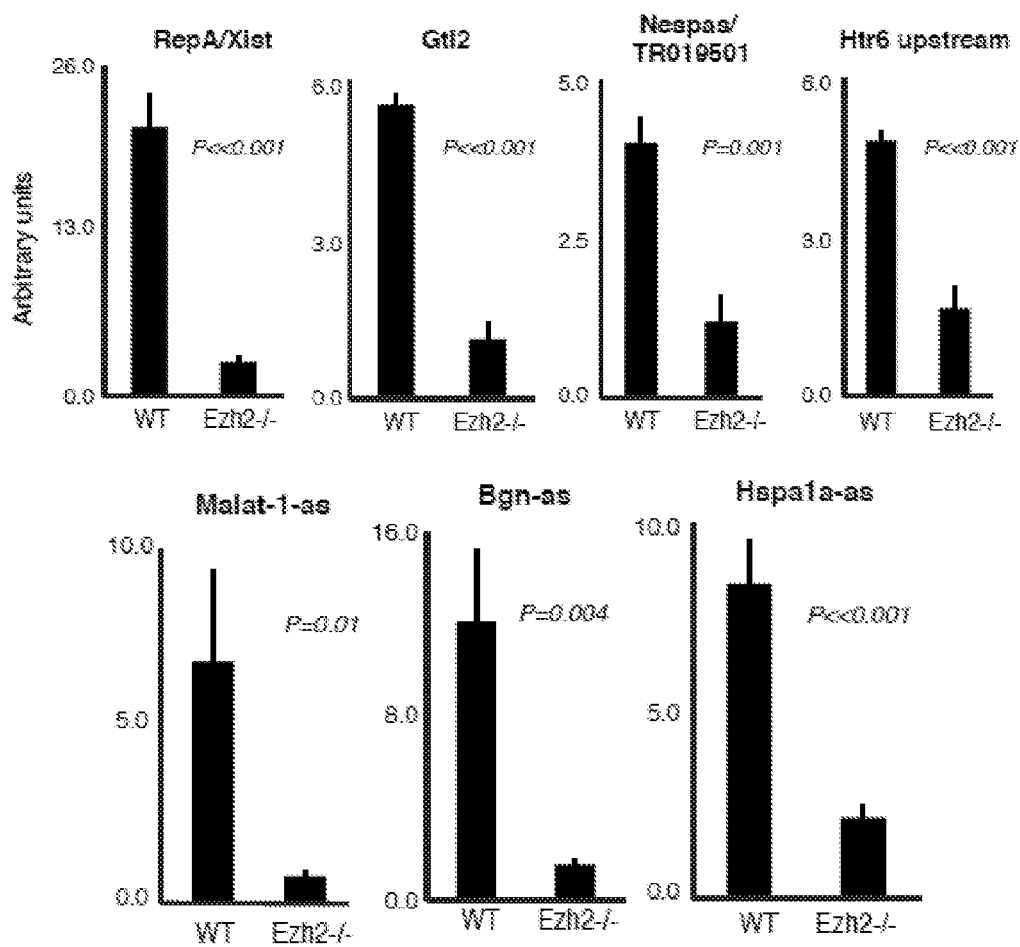
FIG. 4C is a set of seven bar graphs showing the results of Confirmation of native RIP by UV-crosslinked RIP. Each experiment was performed 2-4 times in triplicate, normalized to IgG pulldowns, and compared to that of Ezh2−/− controls using the t-test (P). 1 SD shown.

We next validated RNA-protein interactions by several approaches. First, we performed RIP-qPCR and found that candidate RNAs had significant enrichment in the α-Ezh2 relative to IgG pulldowns (FIG. 4A). Strong positive pulldowns were observed for the imprinted Gtl2, its antisense partner Gtl2-as/Rtl1, and Nespas/TR019501. A number of previously unknown antisense transcripts or RNAs linked to disease loci was also enriched, including Hspa1a-as (antisense to Hsp70), Malat-1-as (antisense to Malat-1), Bgn-as (antisense to Bgn), Ly6e-as (antisense to lymphocyte antigen 6 complex locus E), Foxn2-as (antisense to Foxn2), and an RNA upstream of Htr6 serotonin receptor. Second, we compared the amount of RNA pulled down by α-Ezh2 in WT versus Ezh2−/− ES cells (FIG. 4B). In every case, the RNA was significantly more enriched in WT. By contrast, the negative control Malat-1 sense transcript showed no enrichment. Third, we performed UV-crosslink RIP, an alternative method of testing RNA-protein interactions in vivo based on the ability of UV to covalently link RNA to protein at near-zero Angstroms (Ule et al., 2005). Because crosslinking occurs only at short range and complexes are isolated with disruptive sonication and high-salt washes, this method better detects direct RNA-protein interactions and may avoid reassociation artifacts during RNA isolation. Enrichment of candidate RNAs was similarly observed using this method (FIG. 4C). Combined, these data support the specificity of RIP-seq and suggest direct interactions between RNA and Ezh2

Figure 4E:
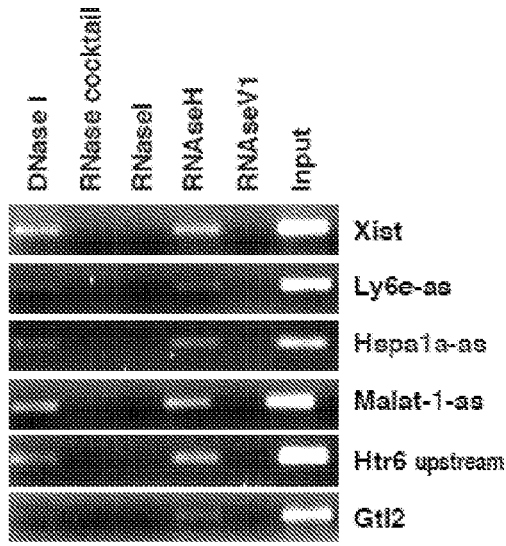
FIG. 4E is an image showing the results of Native RIP with RNAse pretreatment, followed by qRT-PCR quantification.
Figure 4D:
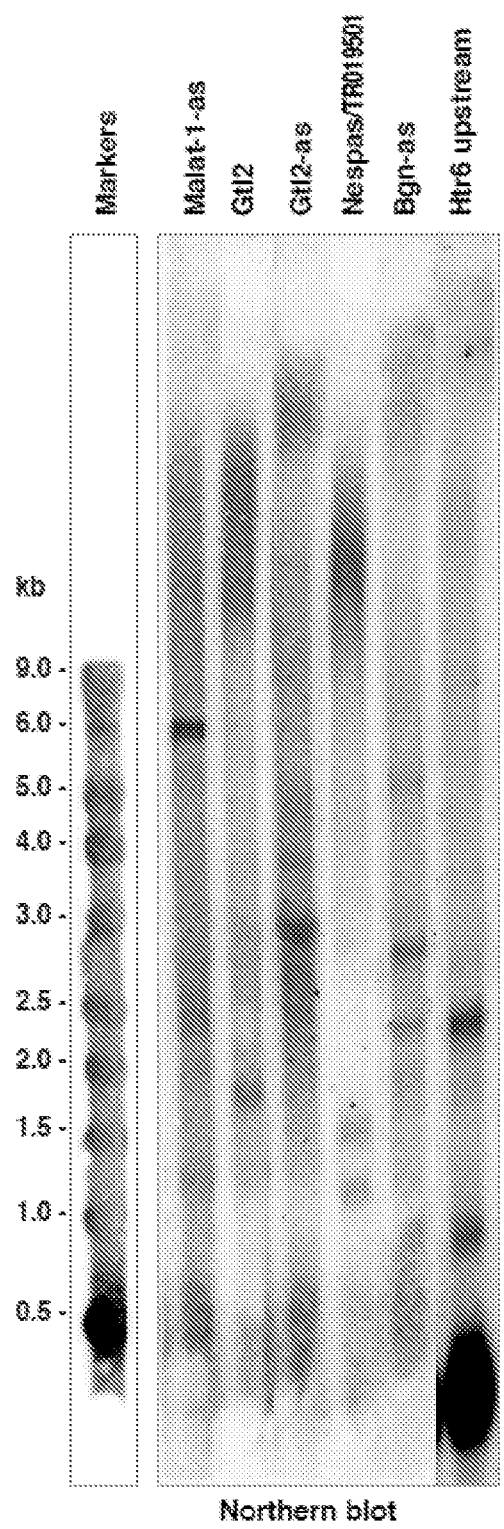
FIG. 4D is an image showing the results of Northern blot analysis of indicated RNA species.

Nearly half of the transcripts identified by RIP-seq were previously unannotated (FIG. 2B). To verify their existence, we performed Northern analysis and found discrete transcripts in ES cells (FIG. 4D). To confirm the nature of nucleic acids precipitated by α-Ezh2, we pretreated nuclear extracts with RNases of different substrate specificities. Digesting with single-stranded RNase (RNase I) and double-stranded RNase (RNAse V1) abolished RNA pulldown, whereas digesting with RNase H (which degrades the RNA strand in RNA:DNA hybrids) and DNase I had no effect (FIG. 4E). Thus, the RNAs in complex with PRC2 have single- and double-stranded character.

Example 5

Direct Binding of RNA to PRC2

Figure 5A:
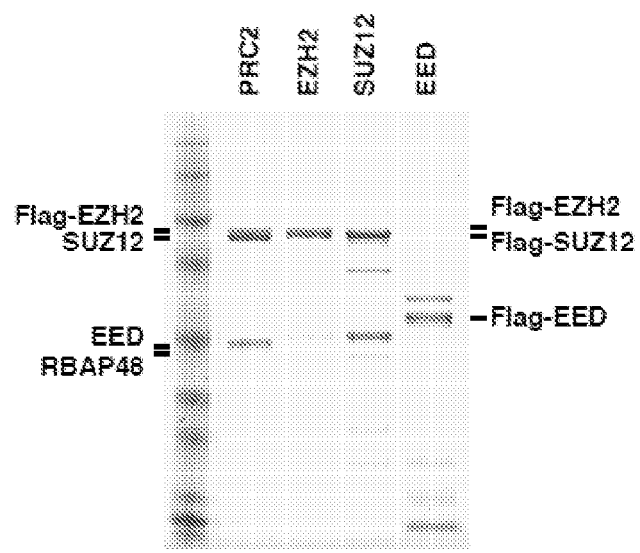
FIGS. 5A-F show the results of biochemical analysis demonstrating direct interactions between RNA and PRC2.
Figure 5B:
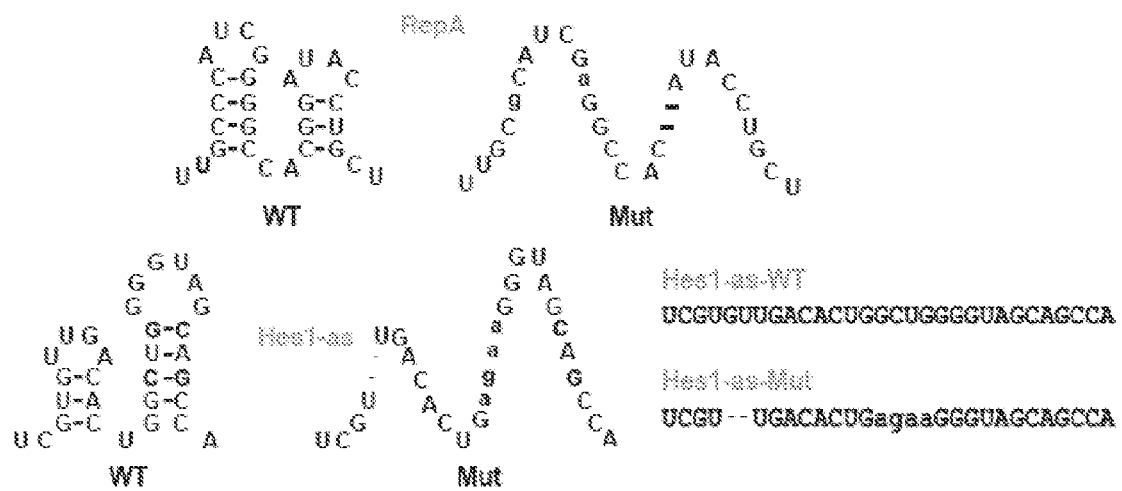
Figure 5C:
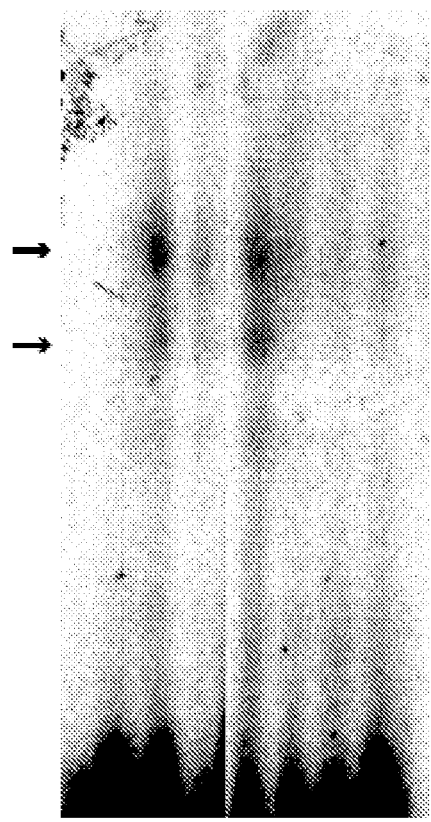
Figure 5D:
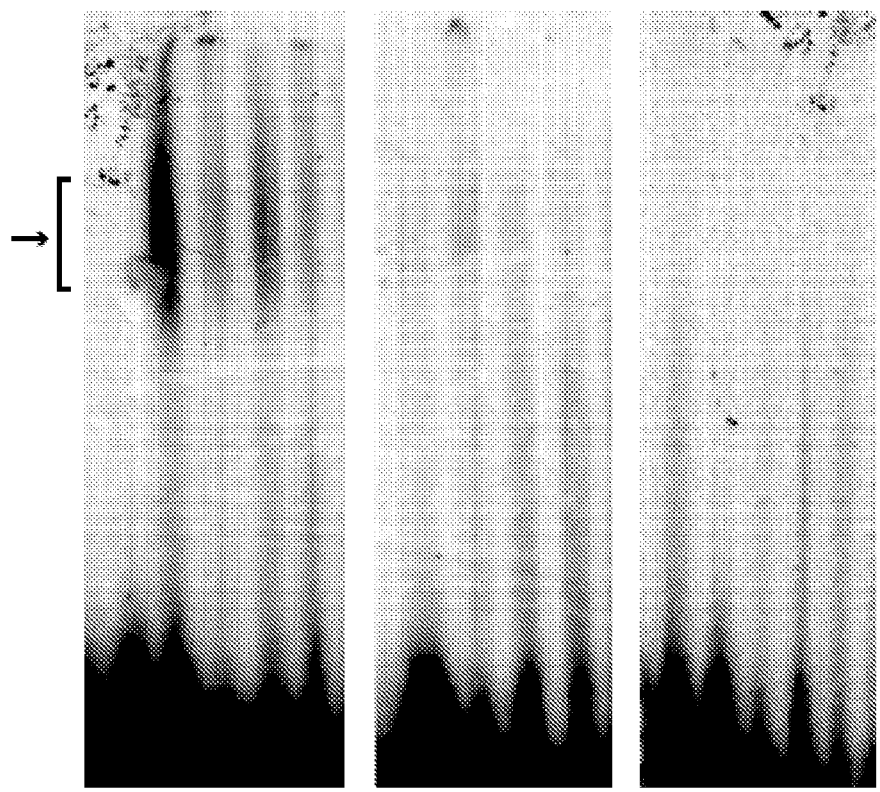
Figure 5E:
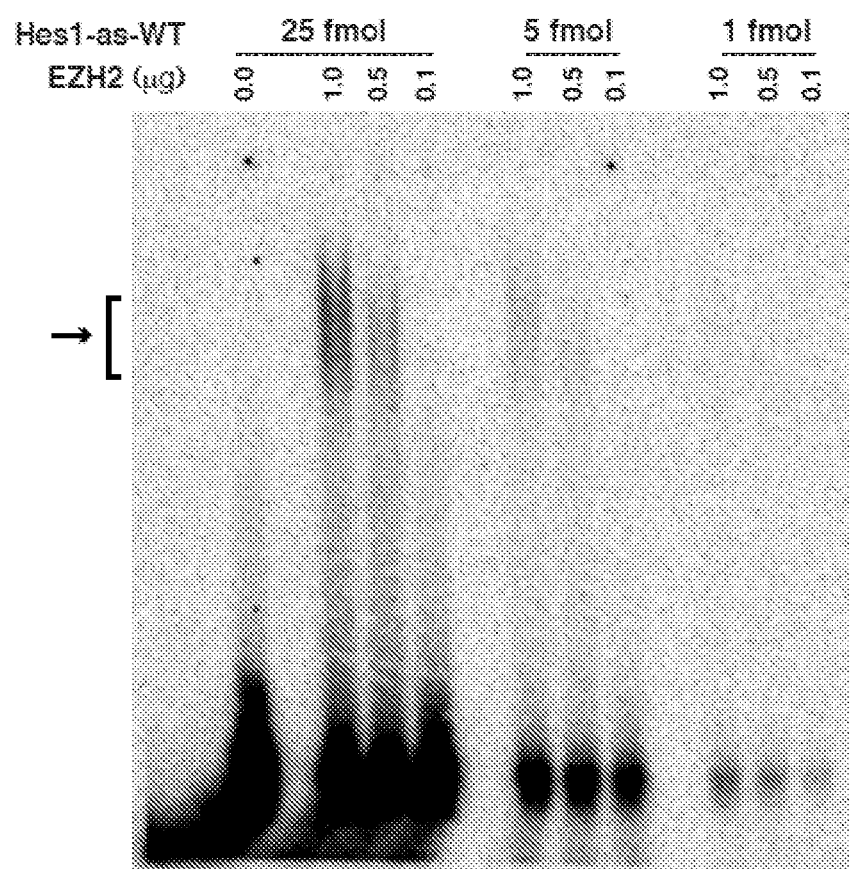

We next addressed whether RNA directly binds PRC2 by in vitro biochemical analyses using purified recombinant human PRC2 subunits, EED, EZH2, SUZ12, and RBAP48 (FIG. 5A). The newly identified antisense RNA for Hes1 (a transcription factor in the Notch signaling pathway (Axelson, 2004)) contains a double stem-loop structure, a motif also found in RepA (Zhao et al., 2008)(FIG. 5B). In an RNA electrophoretic mobility shift assay (EMSA), both the 28-nt RepA and 30-nt Hes1-as probes were shifted by PRC2, whereas RNAs derived from other regions of Xist (DsI, DSII) were not. Mutating the stem-loop structures reduced PRC2 binding. To determine which subunit of PRC2 binds Hes1-as, we performed EMSA using specific subunits (FIG. 5A, D, E). EZH2 strongly shifted wildtype but not mutated Hes1-as RNA, whereas neither SUZ12 nor EED shifted Hes1-as. The RNA-protein shift was always more discrete when whole PRC2 was used, suggesting that other subunits stabilize the interaction. These results show that Hes1-as RNA directly and specifically interacts with PRC2 and Ezh2 is the RNA-binding subunit.

Figure 5F:
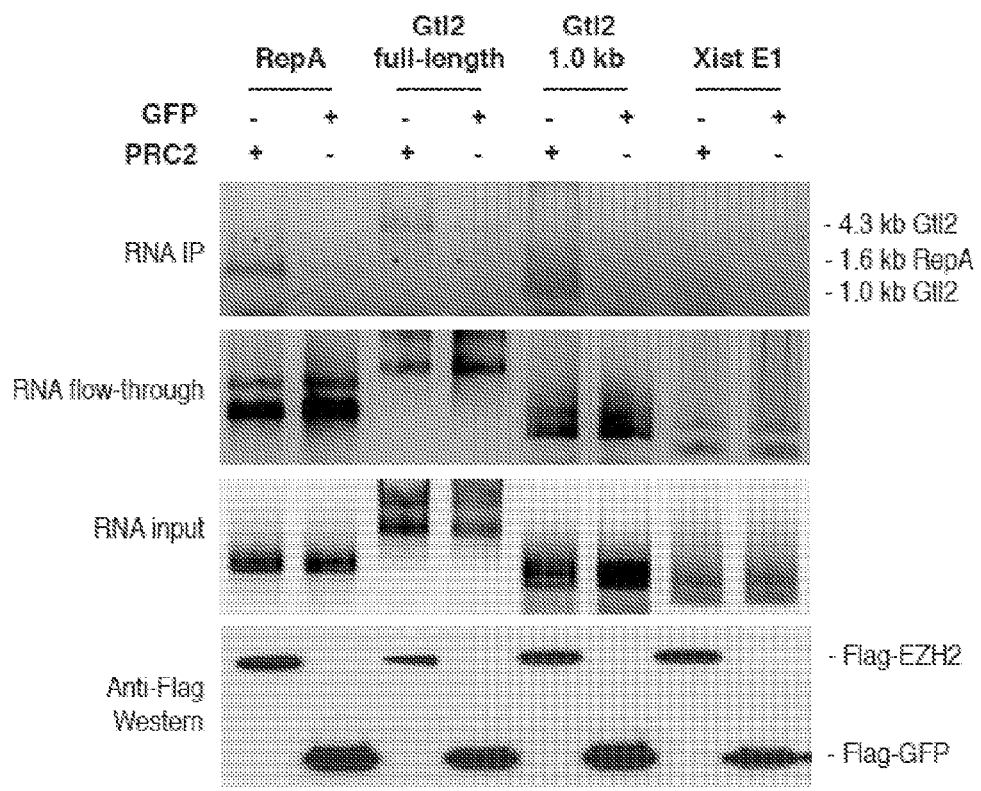

We also examined Gtl2 RNA. Because Gtl2 is 1.7-4.3 kb and too large to test by EMSA, we performed RNA pulldown assays (FIG. 5F). We in vitro-transcribed Gtl2, a truncated form (1.0-kb from the 5' end), RepA, and Xist exon 1 (negative control), and tested equal molar amounts of each RNA in pulldown assays using Flag-PRC2 or Flag-GFP proteins. Both full-length and truncated Gtl2 RNAs were consistently enriched in PRC2 pulldowns. RepA RNA was also enriched, whereas Xist exon 1 was not. These results demonstrated that Gtl2 RNA—most likely its proximal 1.0 kb—directly and specifically binds PRC2.

Example 6

Gtl2-PRC2 Interactions Regulate Gene Expression at Dlk1-Gtl2

Figure 6A:
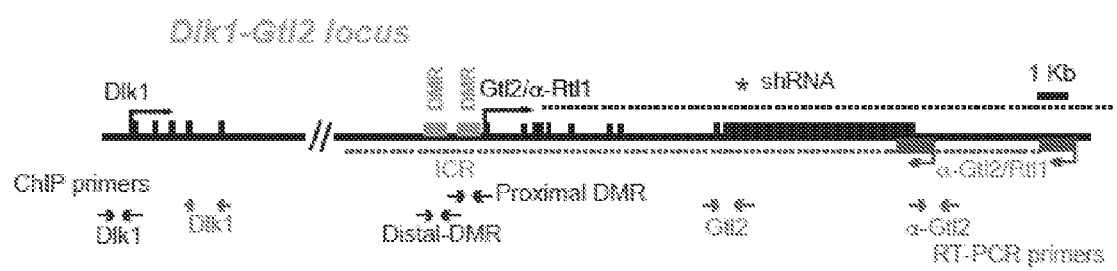
FIGS. 6A-E show that Gtl2 controls Dlk1 by targeting PRC2.
Figure 6B:
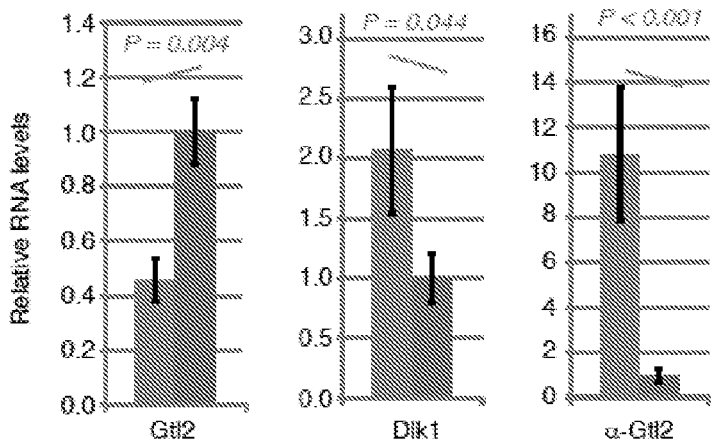

To investigate whether RIP-seq succeeded in discovering new functions, we focused on Gtl2-PRC2 interactions at Dlk1-Gtl2, the imprinted disease locus linked to the sheep Callipyge (gluteal hypertrophy), murine growth dysregulation, and human cancers (Edwards et al., 2008; Takahashi et al., 2009). The maternally expressed Gtl2 is associated with the ICR (FIG. 6A) and has been proposed to regulate paternally expressed Dlk1 (Lin et al., 2003; Takahashi et al., 2009), but the mechanism of action is currently unknown. To determine if the Gtl2 transcript per se regulates Dlk1, we knocked down Gtl2 in ES cells and observed a 2-fold upregulation of Dlk1, consistent with the idea that Dlk1 changed from mono- to bi-allelic expression (FIG. 6B). Gtl2-as was also upregulated. Because shRNAs target RNA for degradation post-transcriptionally, these experiments demonstrate that Gtl2 functions as RNA.

Figure 6C:
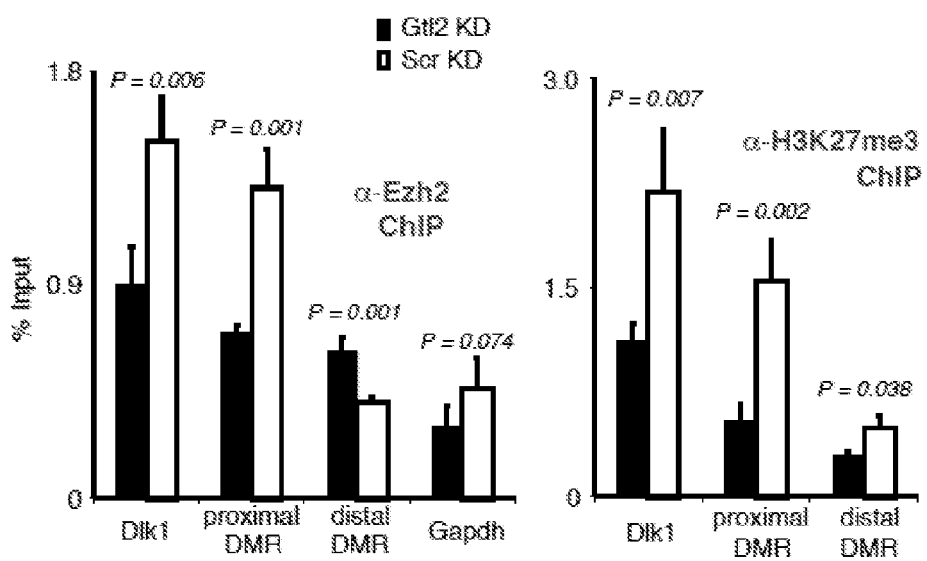
Figure 6D:
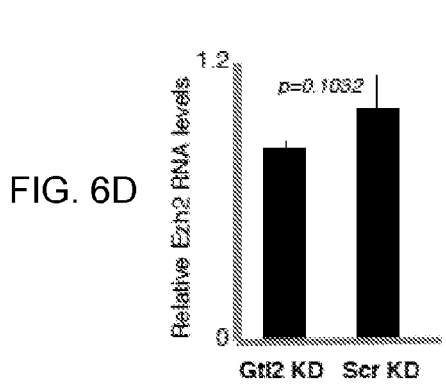
Figure 6E:
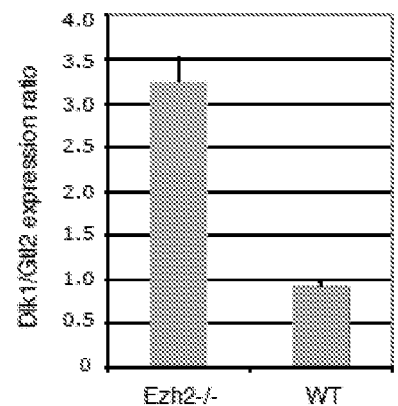
Figure 8A:
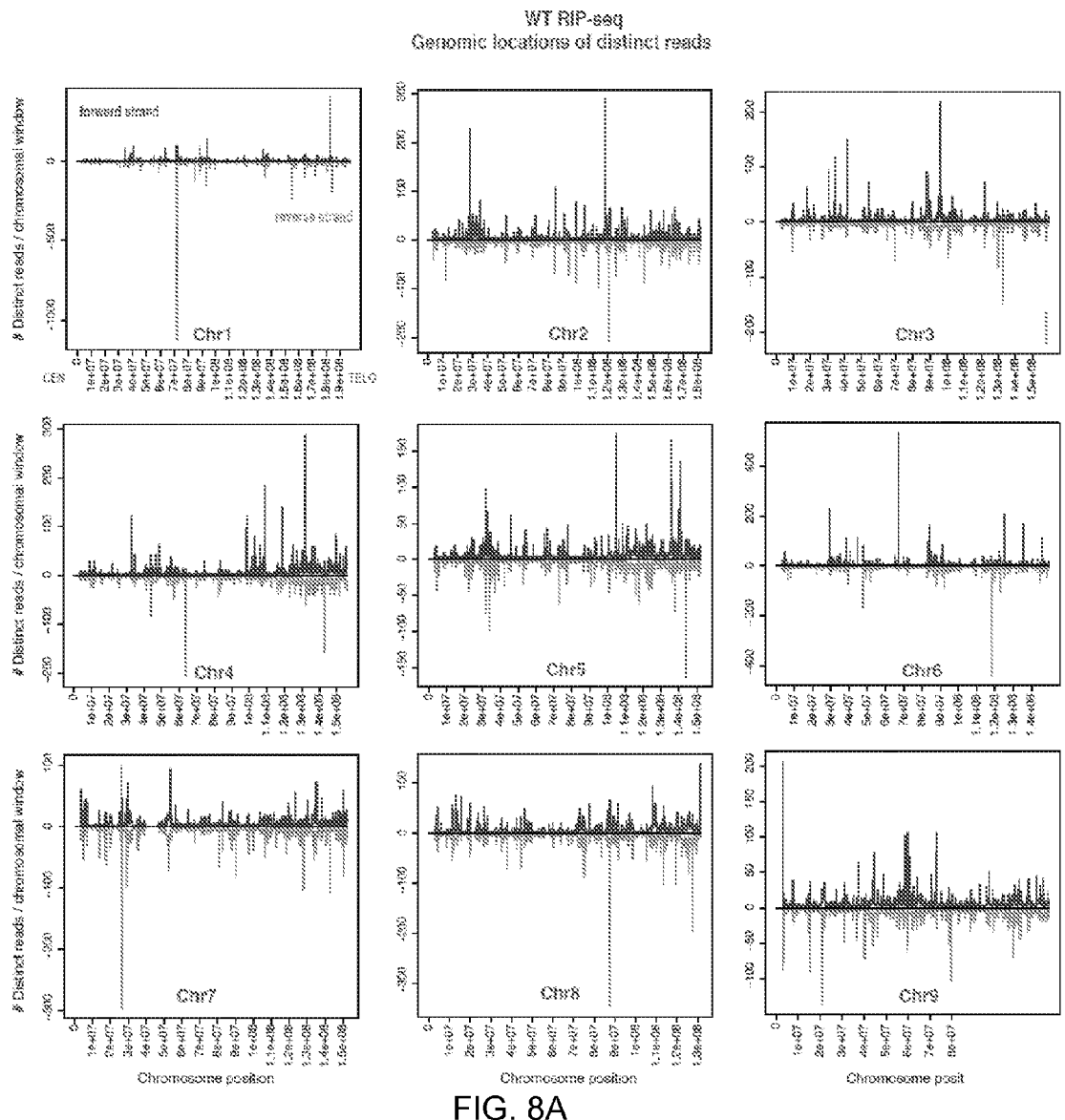
FIGS. 8A-C show chromosome ideograms for the wildtype transcriptome plotted with duplicates removed. Shown are alignments of all pilot reads after removing duplicates in the wildtype transcriptome to the mouse genome. The number of reads per 100-kb window for both unique and repetitive elements are plotted as a function of distance (in bp) from centromere (CEN) to distal telomere (TELO). 100-kilobase windows are nonoverlapping and consecutive. Reads were normalized such that those mapping to 'n' locations were counted as $1/n^{th}$ of a read at each location, and further normalized to account for the greatly reduced complexity of the control libraries relative to the IP samples. Chr, chromosome. Dark grey, forward strand; light grey, reverse strand.
Figure 8B:
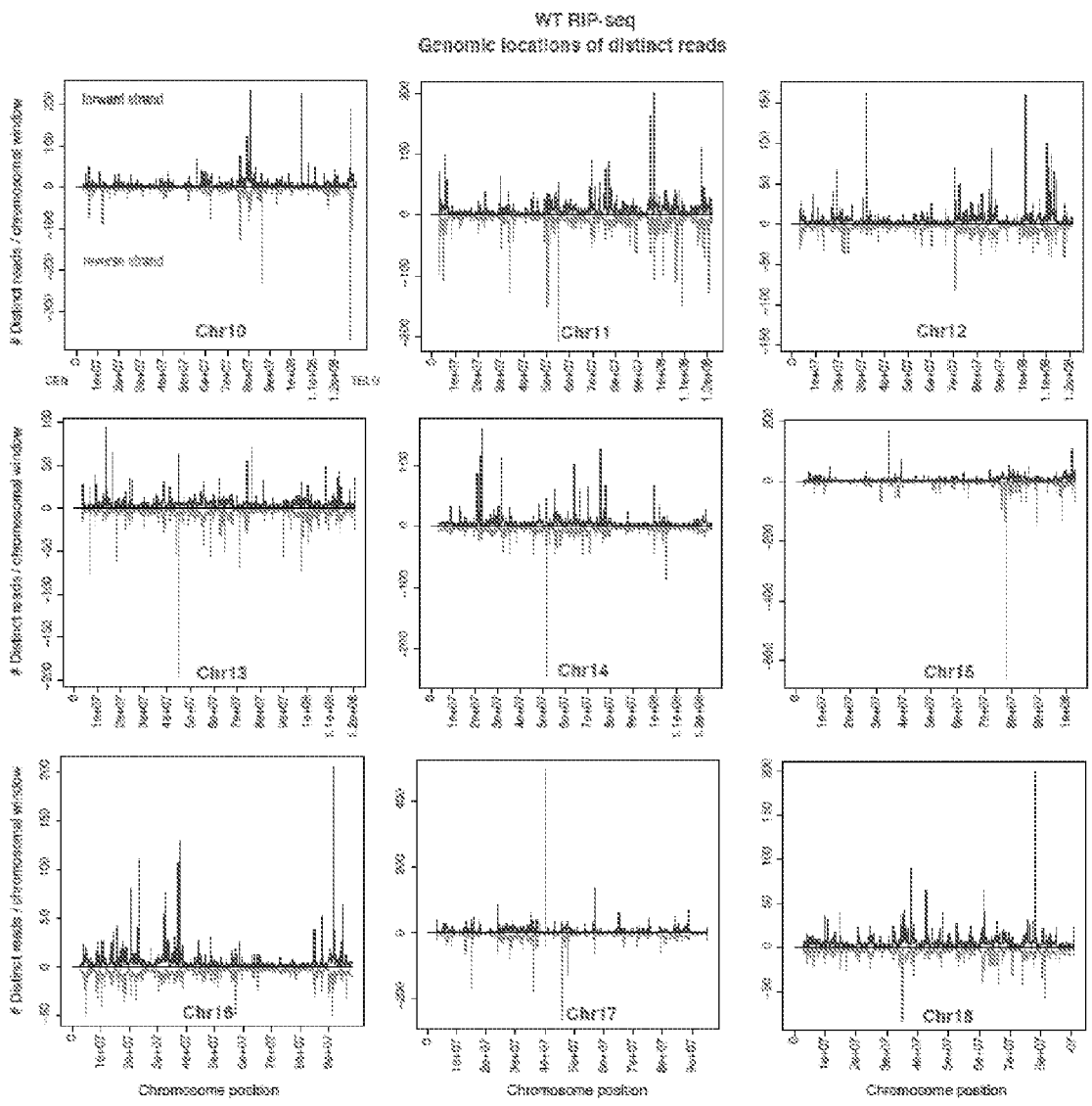
Figure 8C:
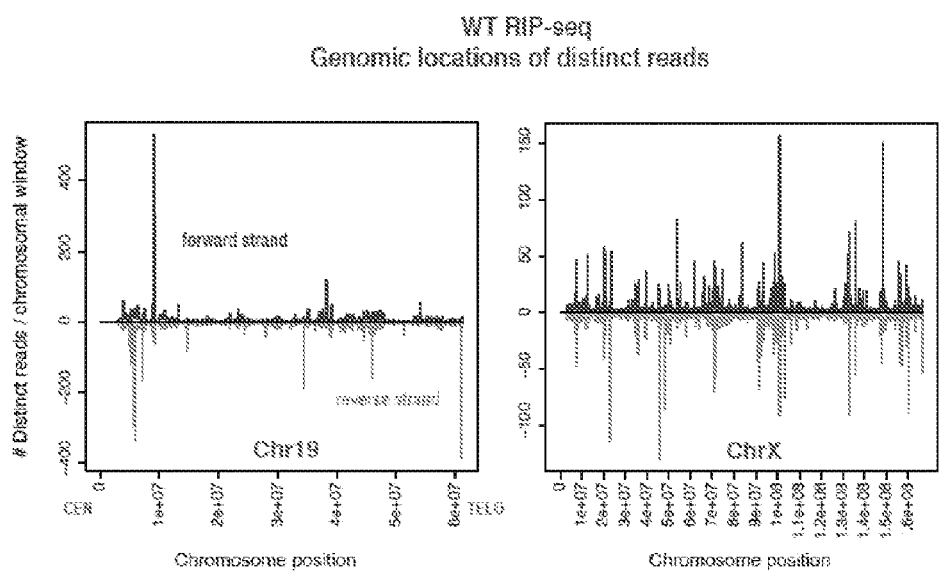
Figure 9A:
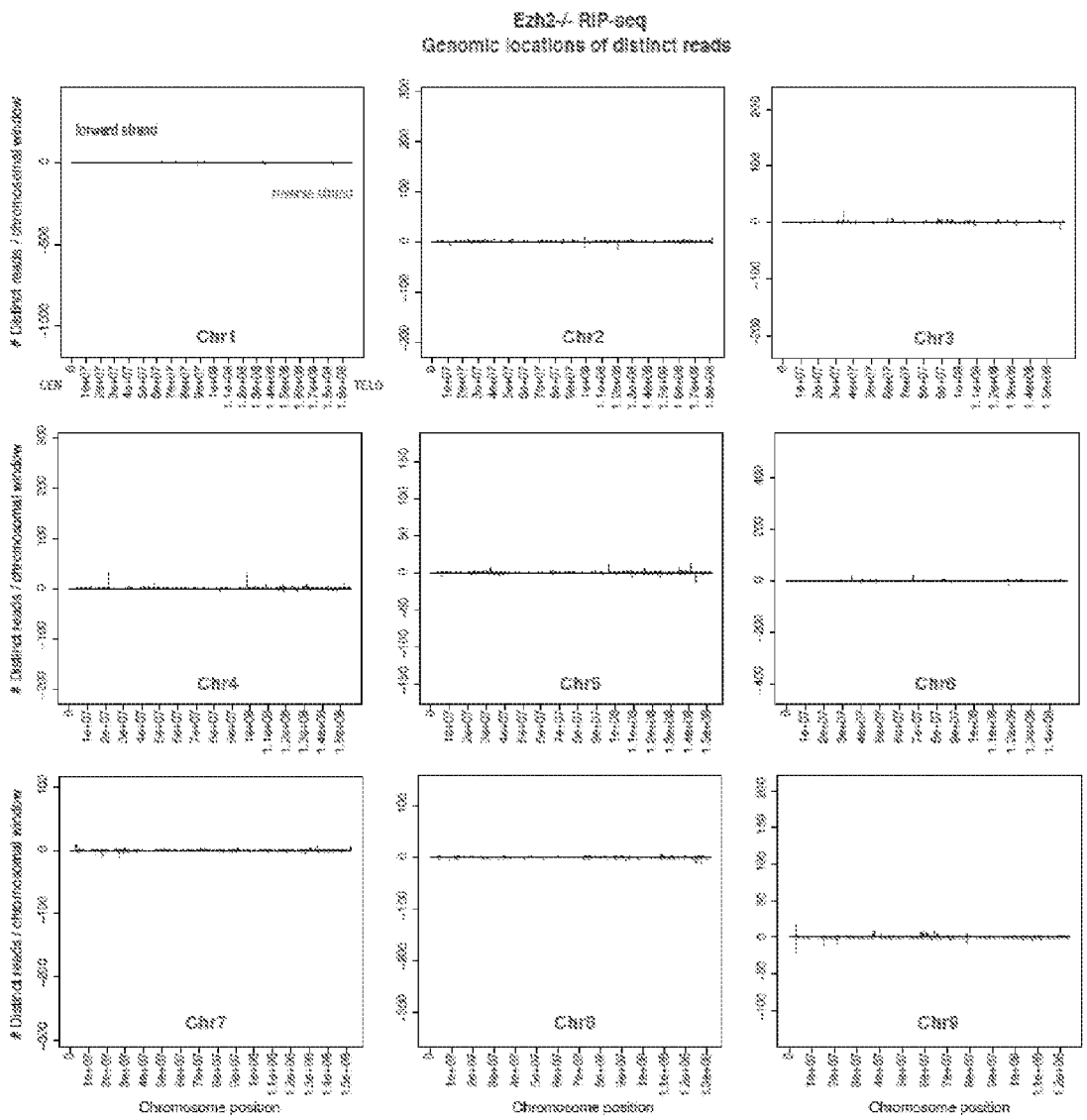
FIGS. 9A-C show chromosome ideograms for the Ezh2−/− control library plotted with duplicates removed. The analysis was carried out as described in FIG. 8 legend. Note that the graphs are plotted at scales identical to those for the wildtype library.
Figure 9B:
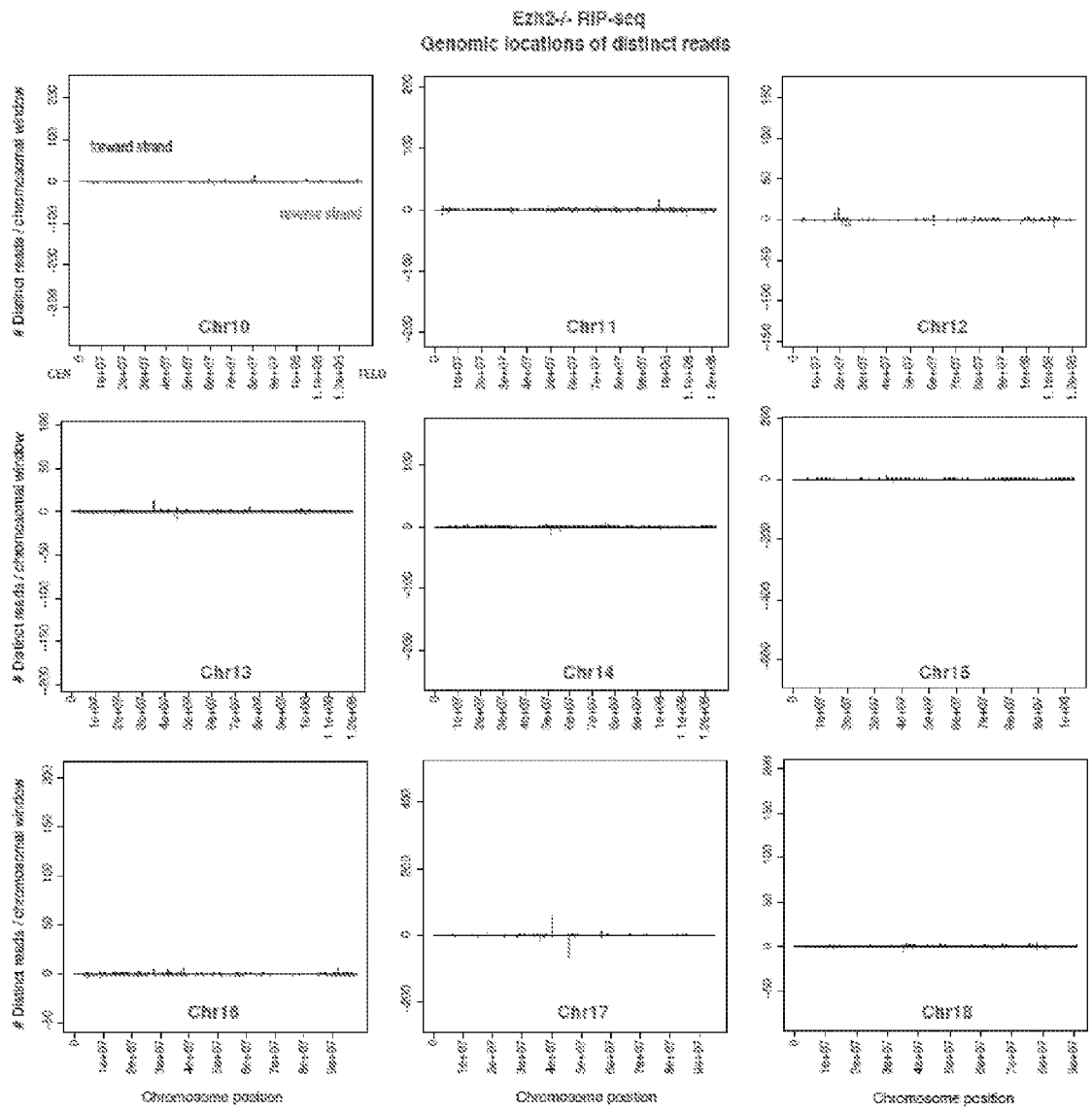
Figure 9C:
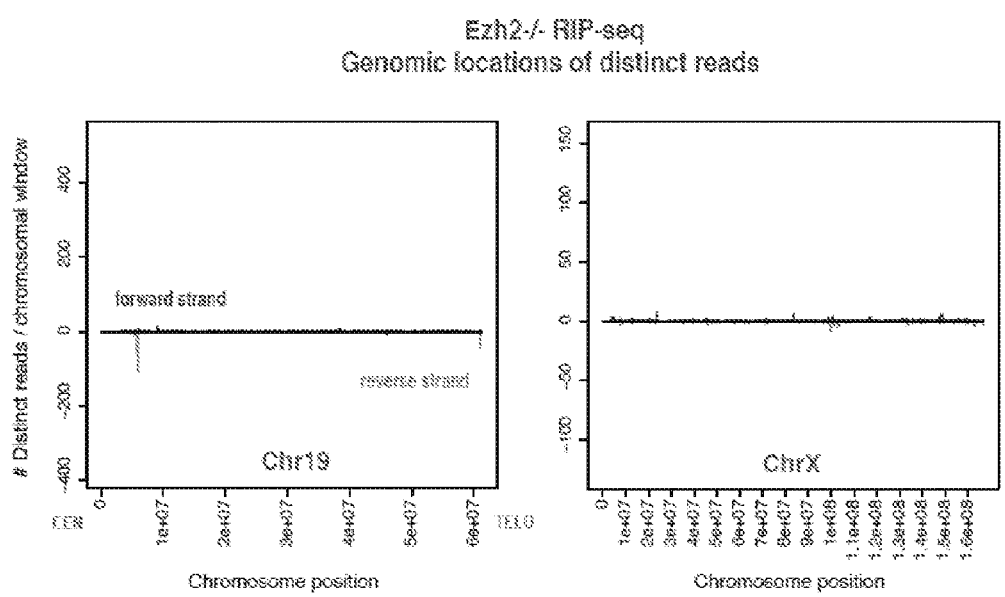
Figure 10A:
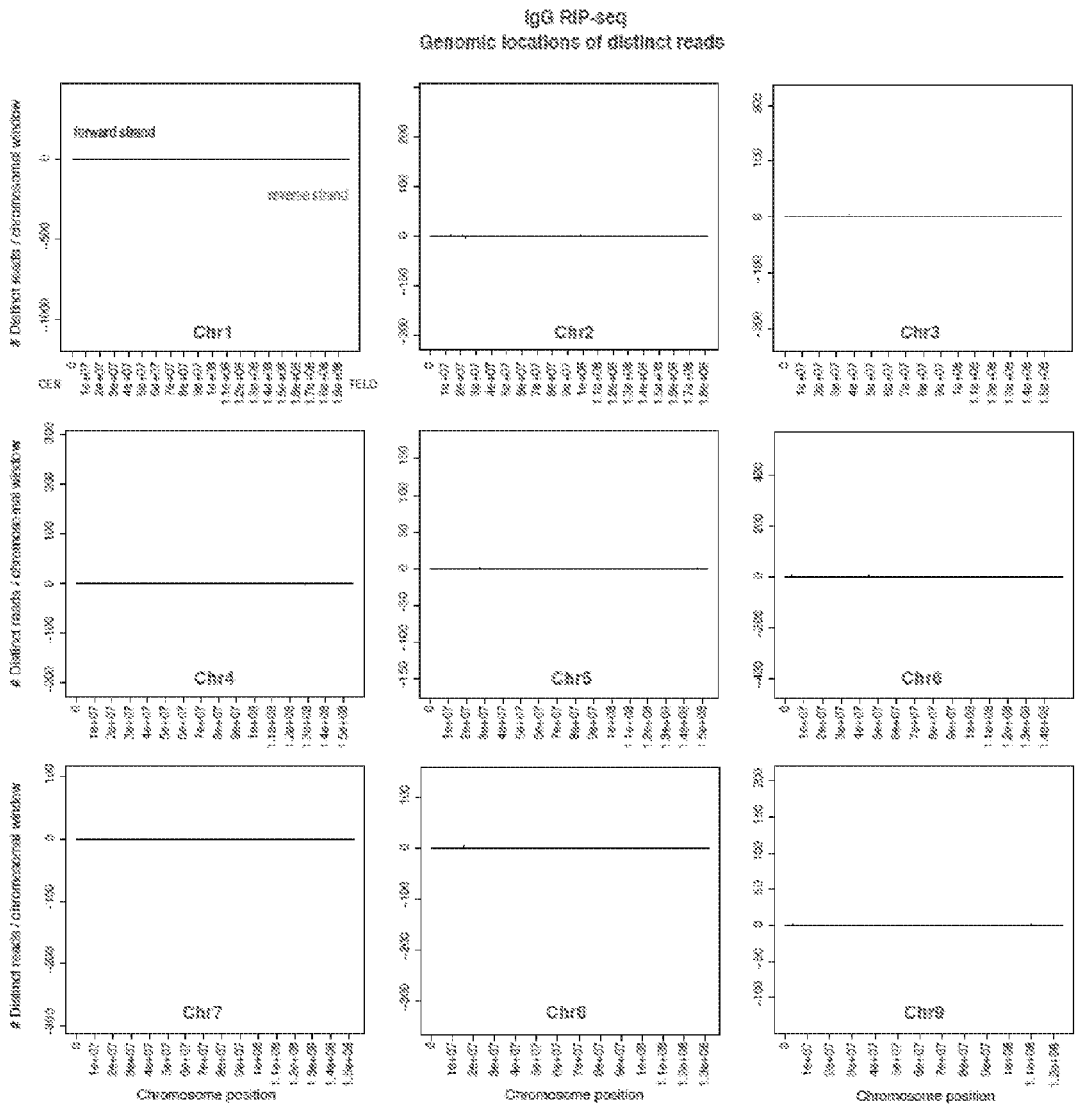
FIGS. 10A-C show chromosome ideograms for the IgG control library plotted with duplicates removed. The analysis was carried out as described in FIG. 8 legend. Note that the graphs are plotted at scales identical to those for the wildtype library.
Figure 10B:
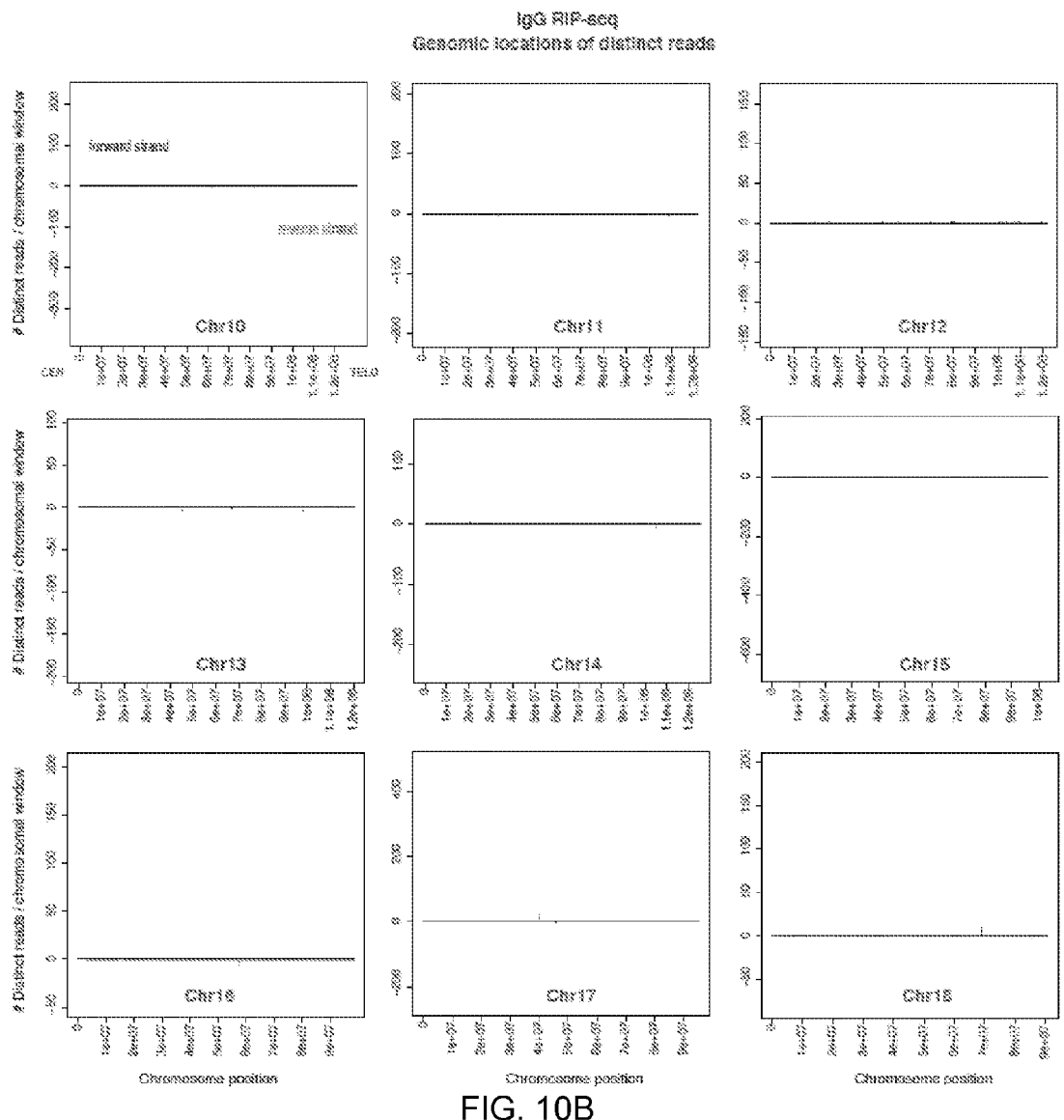
Figure 10C:
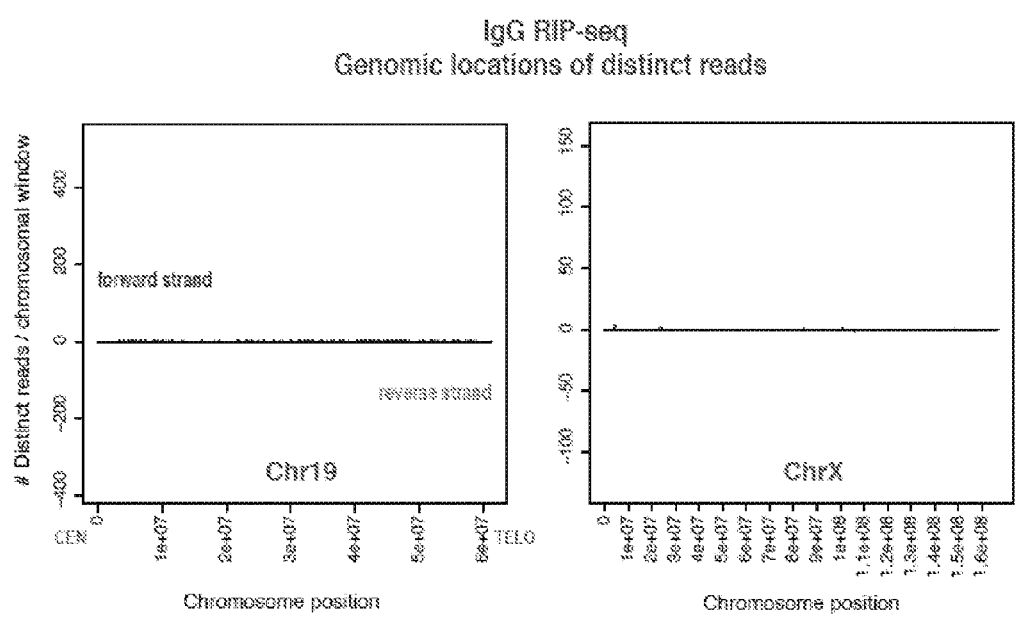
Figure 11A:
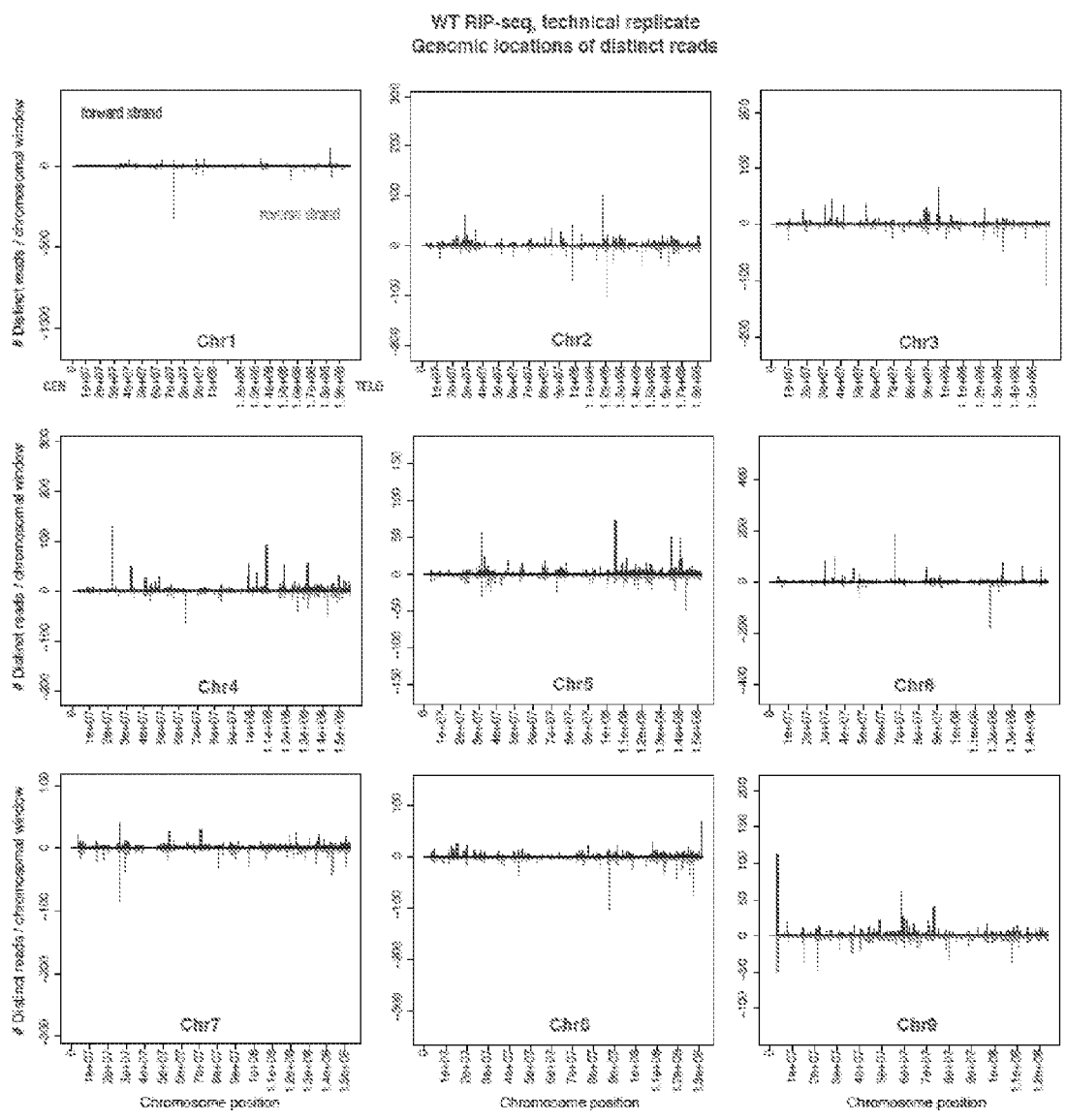
FIGS. 11A-C show chromosome ideograms for wildtype technical replicate plotted with duplicates removed. The analysis was carried out as described in FIG. 8 legend. Note that the graphs are plotted at scales identical to those for the original wildtype library.
Figure 11B:
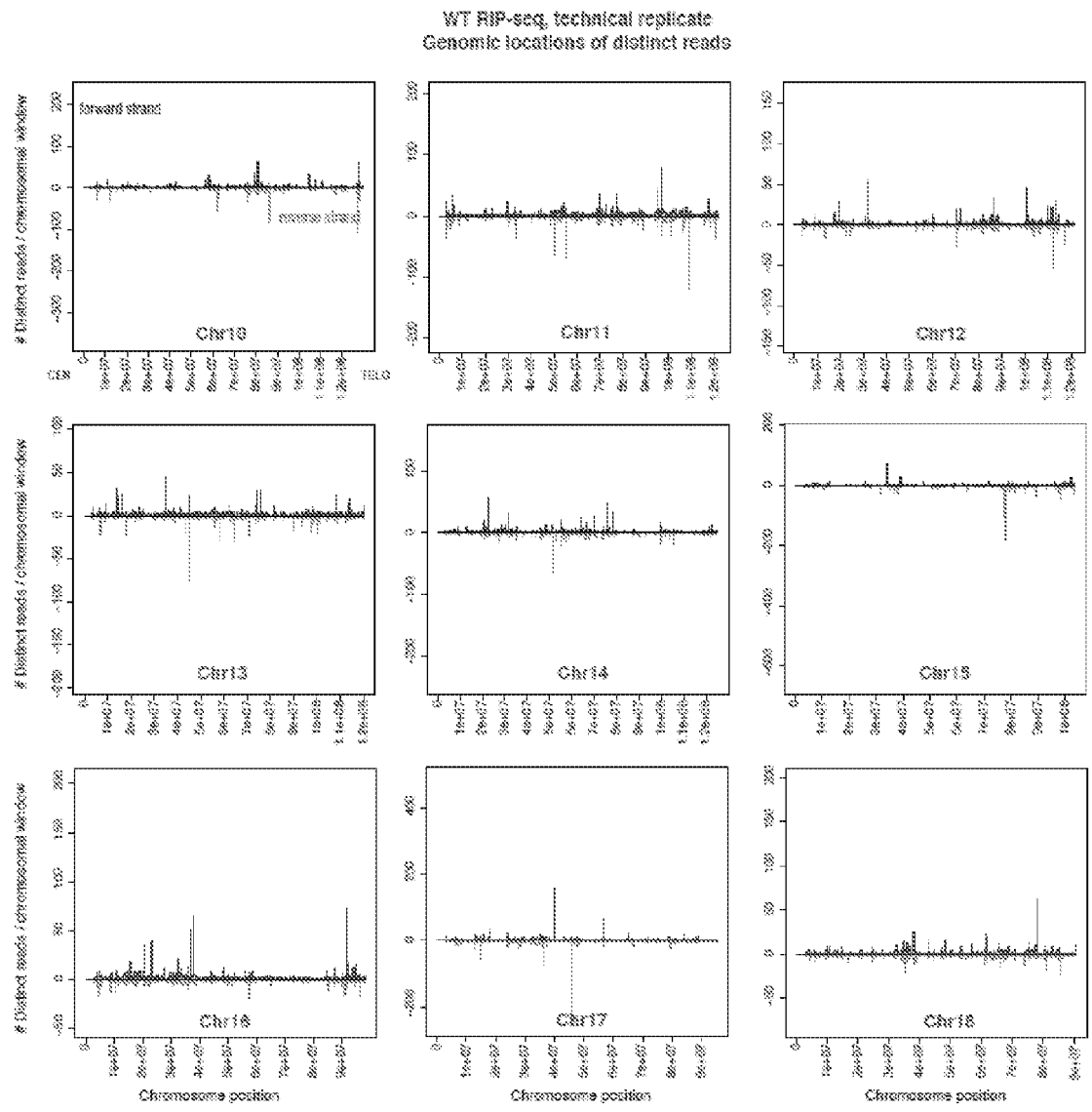
Figure 11C:
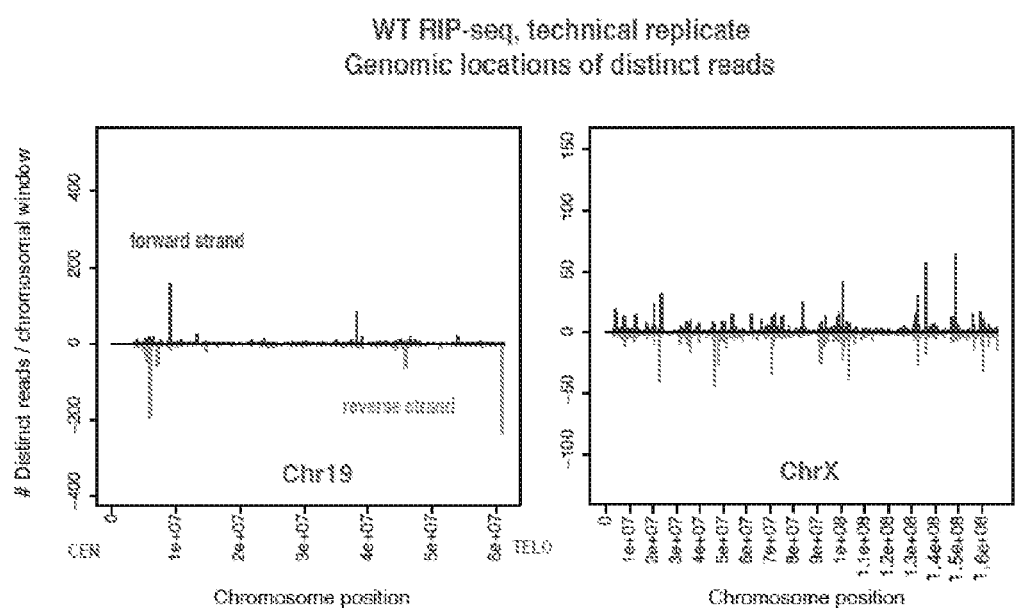
Figure 12A:
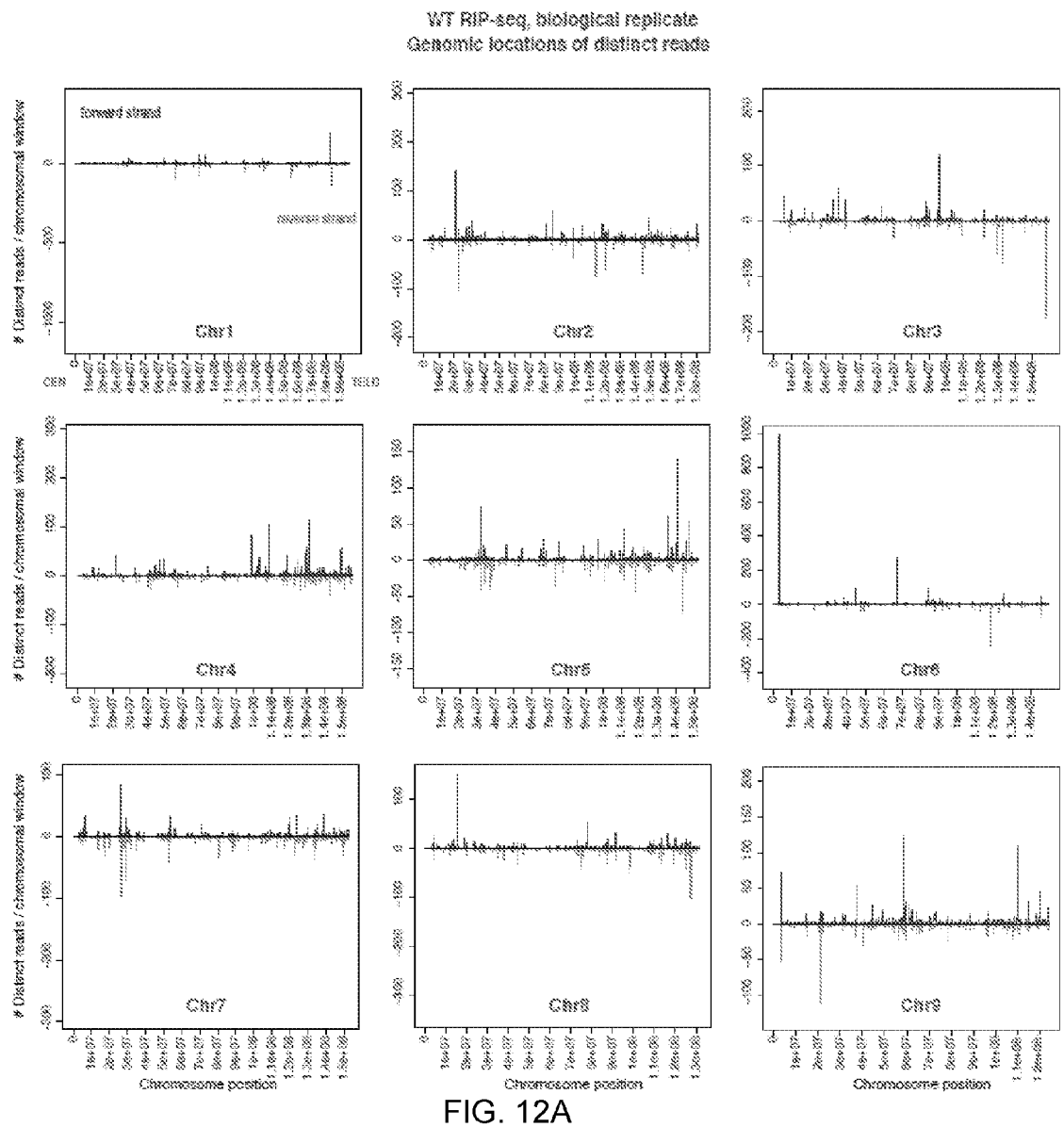
FIGS. 12A-C show chromosome ideograms for the wildtype biological replicate plotted with duplicates removed. The analysis was carried out as described in FIG. 8 legend. Note that the graphs are plotted at scales identical to those for the original wildtype library.
Figure 12B:
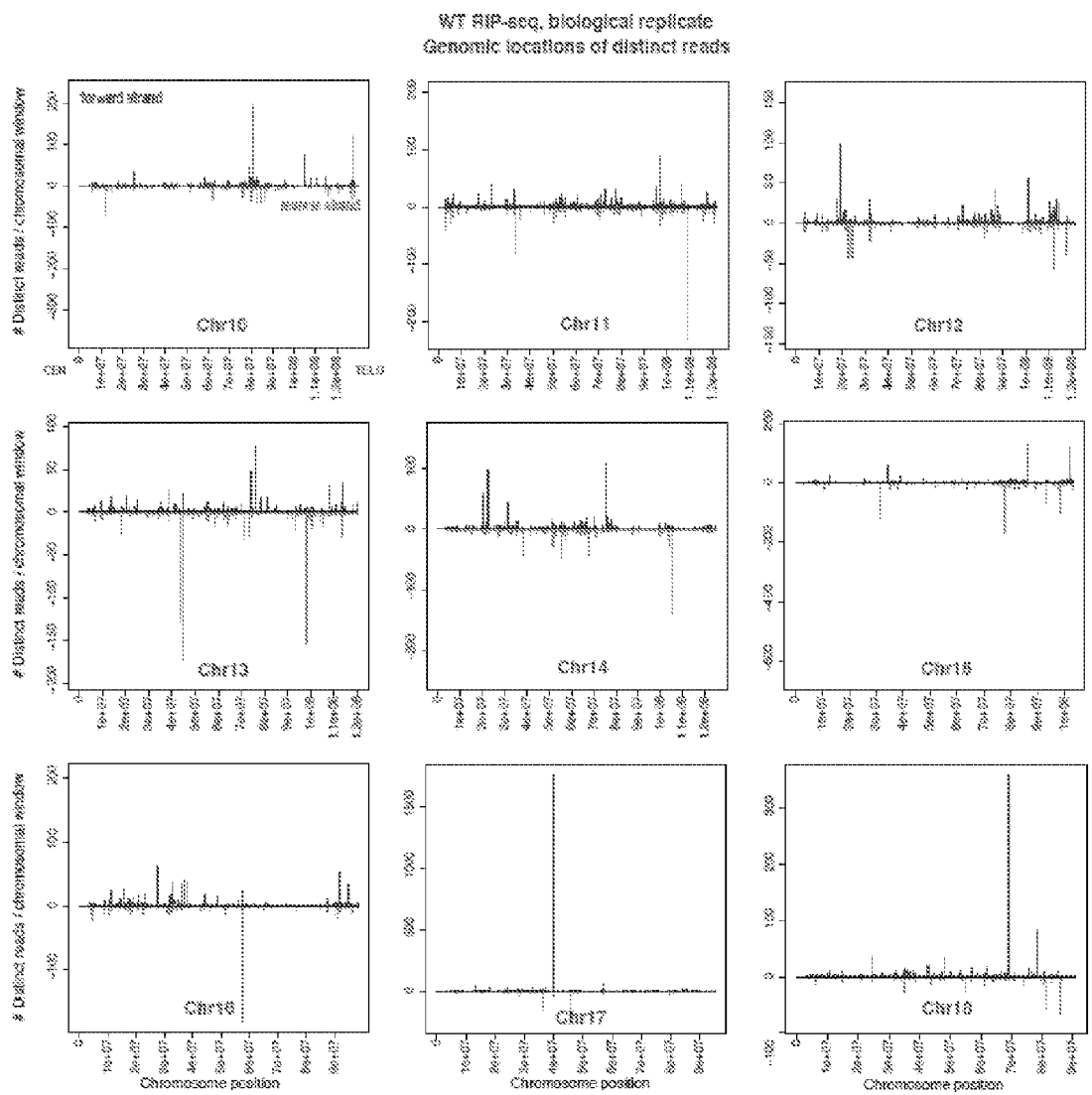
Figure 12C:
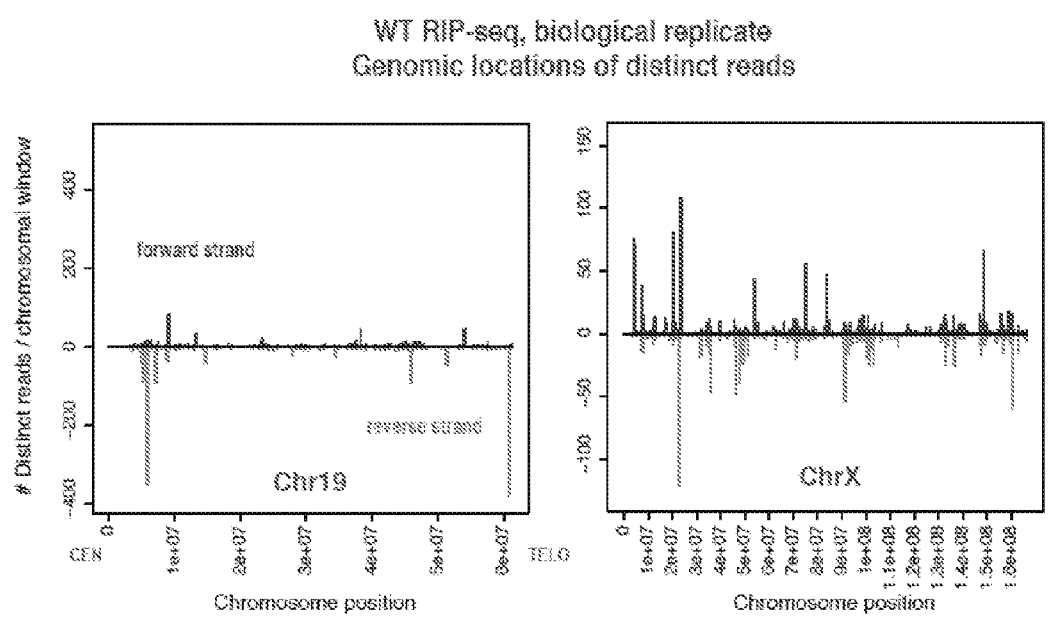

To address if the RNA operates by attracting PRC2 to Dlk1, we carried out quantitative chromatin immunoprecipitation (ChIP) using α-Ezh2 and α-H3-K27me3 antibodies. Indeed, when Gtl2 RNA was knocked down, we detected a two-fold decrease in Ezh2 recruitment to the Dlk1 promoter and a commensurate decrease in H3-K27 trimethylation in cis (FIG. 6C), consistent with increased Dlk1 expression (FIG. 6B). We also saw decreased Ezh2 recruitment and H3-K27 trimethylation at a differentially methylated region (DMR) of the ICR proximal to Gtl2, whereas lesser effects were seen at the distal DMR (FIG. 6C). Because the distal DMR is genetically upstream of Gtl2 (Lin et al., 2003; Takahashi et al., 2009), we did not expect regulation by Gtl2. Gapdh and Actin controls did not show significant decreases after Gtl2 knockdown, and decreased Ezh2 recruitment to Dlk1 was not the result of generally decreased Ezh2 levels in Gtl2-knockdown cells (FIG. 6D). These data argue that Gtl2 indeed functions by attracting PRC2 to Dlk1. In further support, abolishing Ezh2 phenocopied the Gtl2 knockdown, with a ~3-fold increase in Dlk1 expression relative to Gtl2 levels (FIG. 6E). Given direct Gtl2-PRC2 interactions (FIG. 5) and loss of Ezh2/H3-K27me3 at Dlk1 when Gtl2 is knocked down (FIG. 6), we conclude that Gtl2-PRC2 interactions regulate Dlk1 by targeting PRC2 to Dlk1 in cis.

Example 7

Long ncRNA Modulation of Oncogenes and Tumor Suppressor Genes

Figure 13:
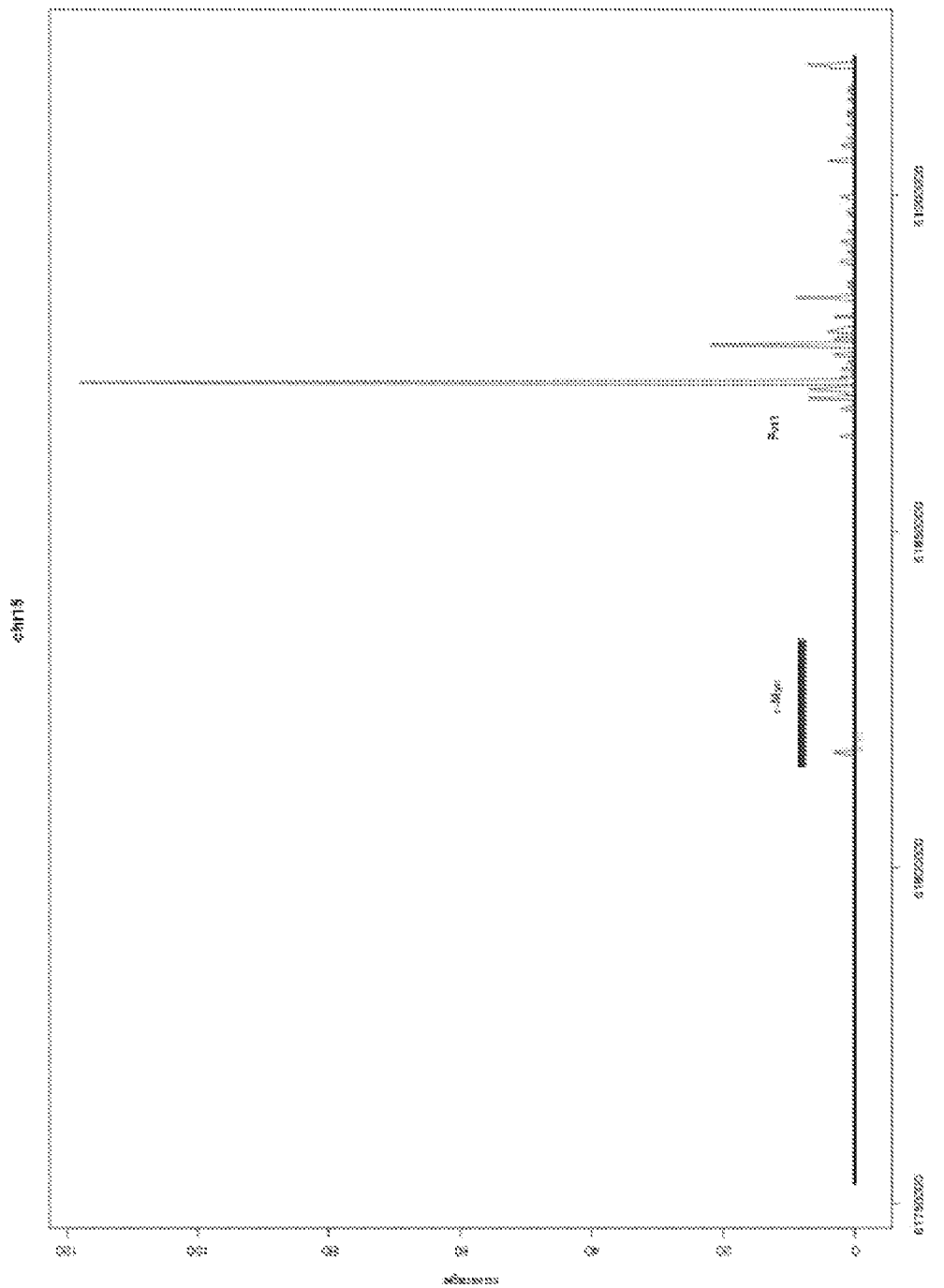
FIG. 13 depicts a plot showing the region around the c-Myc oncogene (bar).

As described hereinabove, application of the RIP-seq method generated a genome-wide pool of long ncRNA transcripts that bind to the PRC2 Transcriptome. Genomic distribution of the identified transcripts was examined by plotting distinct reads as a function of chromosome position. As a result, lncRNAs that regulate both oncogenes and tumor suppressor genes were identified. FIG. 13 depicts a plot showing the region around the c-Myc oncogene (red bar). Zooming into the reads around the c-Myc oncogene shows an impressive peak of PRC2 binding (tall red peak at chromosome coordinate 61,870,000). Further analysis revealed this lncRNA to be Pvt1 (GenBank Accession Nos. Z12002.1 (mouse), or =NR_003367.1 (human)). Pvt1 is known in the art to be disrupted in some cases of Burkitt's lymphoma as well as in plasmacytomas (e.g., by translocations from another chromosome). Therefore, Pvt1 is likely to act by targeting PRC2 to c-Myc in order to repress its expression. Accordingly, exogenous administration of Pvt1 or fragments thereof could rescue Pvt1 loss-of-function phenotypes contributing to various cancers.

Figure 14:
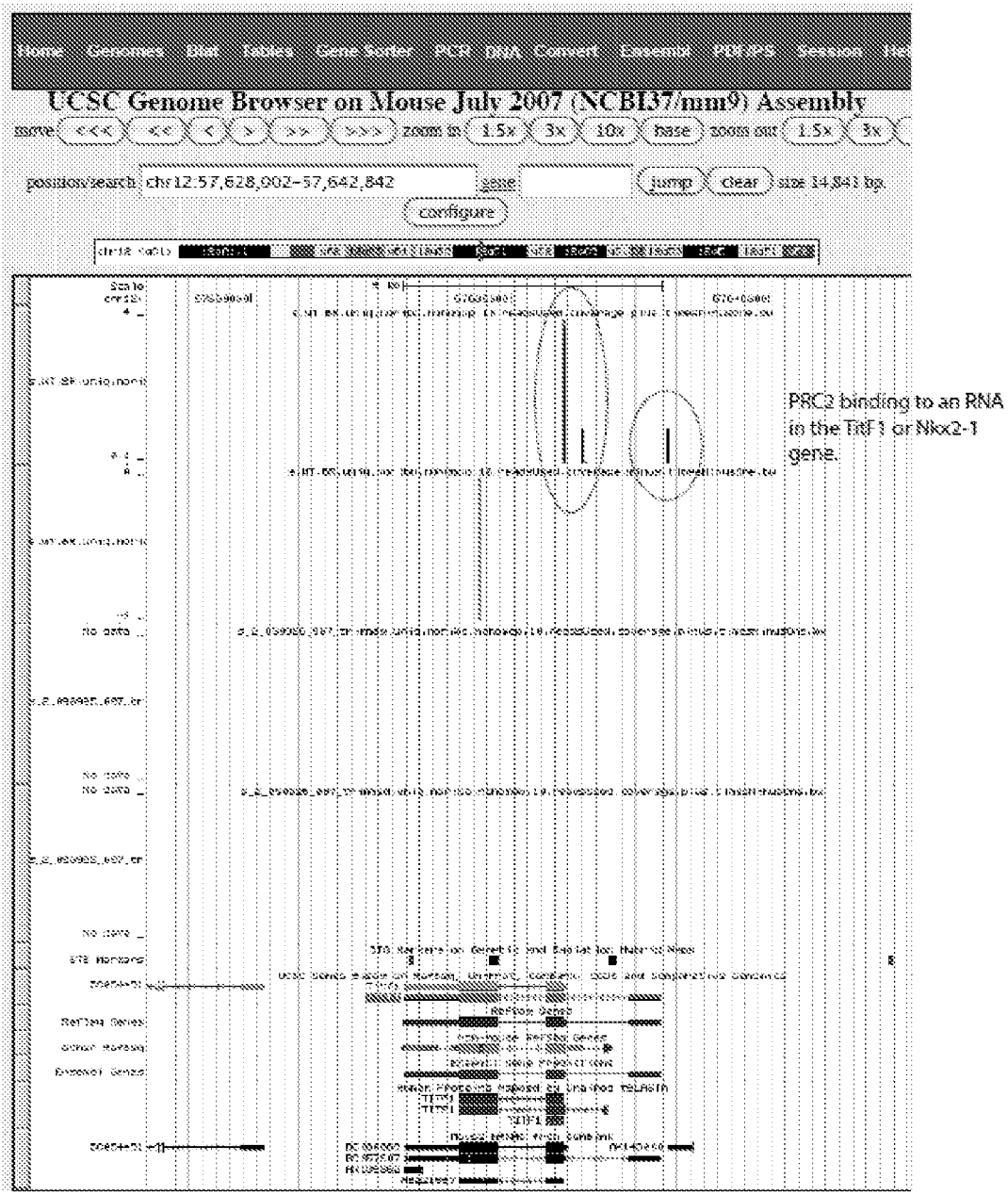
FIG. 14 depicts a plot showing the region around the Nkx2-1 gene (also known as Titf1).

FIG. 14 depicts a plot showing the region around the Nkx2-1 gene (also known as Titf1; Genbank Acc. No. NM_001079668.2 (human mRNA) and NM_001146198.1 (mouse mRNA); genomic sequence is NC_000014.8 (human), NT_026437.12, NC_000078.5 (mouse) or NC_000078.5 (mouse)). In humans, NKX2-1 is frequently amplified or mutated in lung adenocarcinomas and has been directly linked to lung oncogenesis. It is described as a proto-oncogene in driving initial cancer development, but at the same time, its loss of expression is eventually associated with bad prognosis. Therefore, regulation of NKX2-1 is of special interest, as its regulatory elements could be used to modulate NKX2-1 expression in patients. The circled areas of the plot represent locations of PRC2 binding to an antisense lncRNA within the mouse Nkx2-1 gene (a.k.a. Titf1). Based on the hit pattern and density, the antisense RNA resides within the interval on mouse Chr12 from by 57,636,100 to 57,638,250 (likely including the promoter of Nkx2-1 and AK14300) (SEQ ID NO: 191088), in the mouse genome assembly version, NCBI37/mm9. The RNA species at the 5' end of Nkx2-1 is a promoter-associated antisense transcript overlapping the Nkx2-1 promoter and residing within a bivalent domain. As noted above, mouse and human RNAs are well-conserved, even for long ncRNAs (e.g., PVT1, XIST, GTL2). Mouse-to-human LiftOver analysis and analysis in the UCSC genome browser of syntenic positions indicate the existence of a similar noncoding, antisense promoter-associated transcript for the human NKX2-1/TITF1 locus (likely overlapping, if not coincident, with Human gene BX161496; Chr14: by 36,988, 521-36,991,722 (SEQ ID NO: 191087) in human genome assembly version, GRCh37/hg19). The similarity in gene structure and the existence of an upstream RNA sequence are evident in the UCSC genome browser. These points suggest that regulation of the human locus may be similar to that in mouse.

Levels of this antisense transcript can be modulated to affect expression of NKX2-1. The promoter-associated antisense transcript are administered to subjects, e.g., lung adenocarcinoma patients, with amplified NKX2-1 expression, and/or introduced into tumor cells, to decrease expression of NKX2-1. Alternatively, in patients with poor prognosis who have lost NKX2-1 expression, an inhibitory RNA, such as an LNA molecule that binds specifically to a region within the NKX2-1 antisense lncRNA, is introduced to antagonize the PRC2-interacting antisense transcript and restart expression of the NKX2-1 gene.

Example 8

Identification of PRC2-Binding Peaks from Appendix I

In some or any embodiments, the region of an RNA to which a protein binding partner (e.g., PRC2) binds is one of the exemplary locations on a target lncRNA to which an inhibitory nucleic acid is designed to hybridize. For example, these regions can be identified by reviewing the data in Appendix I and identifying regions that are enriched in the dataset; these regions are likely to include PRC2-binding sequences.

The sequence reads in Appendix I come directly off the Illumina GA-II genome analyzer and are in an orientation that is the reverse complement of the PRC2-binding transcript. Appendix I is a filtered subset of all of the reads after bioinformatic filtering removed adaptor/primer dimers, mitochondrial RNA, rRNA, homopolymers, reads with indeterminate nucleotides, and truncated reads (<15 nt). They are likely to represent regions best protected from endogenous nucleases during RIP and subsequent RNA purification steps described in Example 1 above (a RIP-seq method) and thus represent candidate regions of RNA that bind to PRC2 or associated proteins or complexes. From Appendix I, reads were extracted corresponding to transcripts that are enriched 3:1 in WT vs. null [RPKM(WT)/RPKM(null)≥3.0] and with a minimal RPKM value of 0.4. We then identified regions of the PRC2-binding transcripts with an uninterrupted pile-up of reads (peaks) and consider them candidate PRC2 contact regions within the RNA The sequence reads in Appendix I were used to generate sequence coverage on the reference genome using the Broad Institute's Arachne aligner, ShortQueryLookup, which is based on making a k-mer (K=12) dictionary of the reference genome and performing a local Smith-Waterman alignment on a read's candidate locations based on matching k-mer locations in the genome. The aligner does multiple placements. The best alignment is allowed to have at most one error and alignments that differ from the best alignment's number of errors by one are also accepted. The coverage is normalized by dividing by the number of places the read aligns (e.g. if a reads aligns to four places, 0.25 is added to each of the bases in the four places).

To obtain the target Peaks, the following methodology was used. A base-level mouse (mm9) coverage file of regions where the wild-type coverage of the transcriptome is enriched at least three-fold over the coverage of the Ezh2−/− transcriptome and has a minimum RPKM coverage of at least 0.4 serves as the starting point. The coverage is strand-specific. Next, in non-overlapping consecutive windows of 100 bps in length, peak values and their locations are determined. Peak positions are then corrected for those peaks that are on the edge of a window that are determined to be on a side of a larger peak. Those peaks are moved to the top of the larger peak. Duplicate peak locations are then removed. Peaks positions that are on a plateau are moved to the center of the plateau. The coverage is then smoothed using a Gaussian kernel, $(1/\sqrt{2*sigma*pi}))*\exp(-t^2/(2*sigma))$, where sigma=5.0. Peak widths are then determined by locating the nearest position to the peak such that the smoothed coverage is less than or equal to one-third the maximum coverage. Adjacent peaks that overlap each other are resolved by placing a boundary between them at the midpoint between the peaks.

Peaks are then output into a table with the position, width, the maximum amplitude, and the sum of unsmoothed coverage underneath the width of the peak. The corresponding nucleotide sequences of the mouse Peaks in mm9 (converted to RNA by replacing T with U) appear in the sequence listing as SEQ ID NOS: 21583 to 124436, or 190717 to 190933. Mouse-to-human LiftOver of the mouse chromosome coordinates and strand of these mouse Peaks was performed in the UCSC genome browser as described herein, to generate orthologous human chromosome coordinates. This process and LiftOver chains are generally described in Kent et al., *Proc. Nat'l Acad. Sci.*, 100(20) 11484-11489 (2003). When the mouse coordinates (mm9) of each mouse Peak were converted to the corresponding human (hg19) coordinates, mapping percentages of 50, 65, 75, and 95 yielded essentially identical location and length results whenever a match occurred. Consequently, the 50% mapping parameter was used.

Each corresponding human Peak RNA sequence (i.e., the nucleotide sequence of the human chromosomal coordinates and strand, converted to RNA by replacing T with U) appear in the sequence listing as SEQ ID NOS: 124437 to 190716, or 190934 to 191086. These human Peaks and the human PRC2 transcriptome (i.e. human sequences of PRC2-binding transcripts referenced in Tables 1-7) were intersected with known genes from the NCBI database to identify genes targeted by the PRC2-binding RNA (i.e. an intersecting or nearby gene).

Table 8 shows the annotation of the mouse and human Peaks with the names of genes that were near or intersected with each Peak. The unique NCBI gene ID associated with the human gene (listed first) or mouse gene (listed second) appears in parentheses adjacent to the gene name. The degree of overlap between the Peak coordinates and the gene coordinates appears in square brackets. A positive number indicates the number of overlapping nucleotides between the two, and a negative number represents the size of the gap between the two (i.e. the number of nucleotides of distance between the two). For Peaks, an "F" within the square brackets indicates that the Peak coordinates fully overlap the gene coordinates. For transcripts, an "F" within the square brackets indicates that the transcript coordinates fully overlap the gene coordinates, or vice versa. The RNA transcript or Peak is "antisense" to the reference genes in the "Opposite Strand" column, while the RNA transcript or Peak is in the same "sense" orientation as the reference gene in the "Same Strand" column.

Bioinformatic analysis indicates that the average Peak is about 40-60 bases, which is an excellent size for initial design of inhibitory nucleic acids. More than 100,000 Peaks were identified in the mouse transcriptome of Table 2. Each of these Peaks is fully represented by the reverse-complement reads in Appendix I since it corresponds to a segment of overlapping reverse-complement reads from Appendix I. The Peaks can be found anywhere within the coding gene, and in either sense or antisense orientations. Peaks can also be found in the promoter/5'UTR regions, introns, internal exons, and 3'UTR and beyond. The analysis strongly suggests that the PRC2-interacting transcripts are not the protein-coding mRNA, but a distinct transcript or transcripts that overlap with the mRNA sequence. Many are novel RNAs not previously described.

Routine methods can be used to design an inhibitory nucleic acid that binds to target locations or segments with sufficient specificity, or are sufficiently complementary to the target RNA to give the desired effect. In some embodiments, the methods include using bioinformatics methods known in the art to identify regions of secondary structure, e.g., one, two, or more stem-loop structures, or pseudoknots, and selecting those regions to target with an inhibitory nucleic acid.

Additional target segments 5-500 nucleotides in length, or about 5 to about 100 nucleotides in length, comprising a stretch of at least five (5) consecutive nucleotides within the Peak, or immediately adjacent thereto, are considered to be suitable for targeting as well.

Example 9

In Vitro Effect of Inhibitory Oligonucleotides on Upregulation of mRNA Expression A. ApoE Inhibitory oligonucleotides were designed to target lncRNA as set forth in Table 8 in order to upregulate ApoE. The oligonucleotides were less than 16 bases in length and comprised unmodified DNA and multiple locked nucleic acid modified bases, all linked by phosphorothioate bonds. Transfection and data analysis were carried out briefly as follows.

RNA was harvested from the Hep 3B cells using Promega SV 96 Total RNA Isolation system omitting the DNAse step. In separate pilot experiments, 50 ng of RNA was determined to be sufficient template for the reverse transcriptase reaction. RNA harvested from the Hep3B cells was normalized so that 50 ng of RNA was input to each reverse transcription reaction. For the few samples that were too dilute to reach this limit, the maximum input volume was added. Quantitative PCR evaluation was then completed.

A baseline level of ApoE mRNA expression was determined through quantitative PCR as outlined above. Baseline levels were also determined for mRNA of various housekeeping genes which are constitutively expressed. A "control" housekeeping gene with approximately the same level of baseline expression as ApoE mRNA was chosen for comparison purposes to ApoE.

Hep3B cells were seeded into each well of 24-well plates at a density of 25,000 cells per 500 uL and transfections were performed with Lipofectamine and the inhibitory oligonucleotides. Control wells contained Lipofectamine alone. At 48 hours post-transfection, approximately 200 uL of cell culture supernatants were stored at −80 C for ELISA. At 48 hours post-transfection, RNA was harvested from the Hep 3B cells and quantitative PCR was carried out as outlined above. The percent induction of ApoE mRNA expression by each inhibitory oligonucleotide was determined by normalizing mRNA levels in the presence of the inhibitory oligonucleotide to the mRNA levels in the presence of control (Lipofectamine alone). This was compared side-by-side with the increase in mRNA expression of the "control" housekeeping gene.

A total of 26 oligonucleotides tested were complementary to SEQ ID NO: 15050 in Table 2. Of these 26 oligonucleotides, 7 upregulated apoE expression in human Hep3B cells, as indicated by increased ApoE mRNA levels relative to the "control" housekeeping gene.

The above procedure was repeated using human renal proximal tubule epithelial cells (RPTEC). Of the 26 oligonucleotides complementary to SEQ ID NO: 15050 in Table 2, 5 increased ApoE mRNA levels in renal cells, relative to the "control" housekeeping gene. Levels increased by about 1.5 to about 5-fold over baseline expression.

In addition, of 11 oligonucleotides that are complementary to Peaks in Table 8 associated with apoE, 3 upregulated apoE expression.

Inhibitory oligonucleotides as short as 8 nucleobases in length were demonstrated to upregulate gene expression.

B. Nkx2-1

The experiments as described in Example 9A above were repeated for inhibitory oligonucleotides designed to target lncRNA as set forth in Table 8 in order to upregulate Nkx2-1. A total of 13 oligonucleotides tested were complementary to SEQ ID NO. 17040 in Table 2. Of these 13 oligonucleotides, 3 upregulated Nkx2-1 expression as indicated by increased Nkx2-1 mRNA expression relative to baseline, although no "control" housekeeping gene could be matched with Nkx2-1 due to low levels of intrinsic expression. In addition, of 9 oligonucleotides that are complementary to Peaks in Table 8 associated with Nkx2-1, 3 upregulated Nkx-21 expression.

C. Brca1

The experiments as described in Example 9A above were repeated for inhibitory oligonucleotides designed to target lncRNA as set forth in Table 8 in order to upregulate Brca1. A total of 30 oligonucleotides tested were complementary to SEQ ID NOs: 192,309 in Table 2 and SEQ ID NO: 192,965. Of these 30 oligonucleotides, 5 oligonucleotides upregulated Brca1 expression. Of these 30 oligonucleotides, 13 oligonucleotides were also complementary to Peaks in Table 8 associated with Brca1. Of these 13 oligonucleotides complementary to Peaks, 2 oligonucleotides upregulated Brca1 expression. Levels increased by about 2 to about 3 fold over baseline expression.

D. Smad7

The experiments as described in Example 9A above were repeated for inhibitory oligonucleotides designed to target lncRNA as set forth in Table 8 in order to upregulate Smad7, with the following exception: the kidney cell line RPTEC was used instead of HepB3. A total of 28 oligonucleotides tested were complementary to SEQ ID NO. 18602 in Table 2. Of these 28 oligonucleotides, 4 upregulated Smad7 expression. In addition, of 28 oligonucleotides that are complementary to Peaks in Table 8 associated with Smad7, 4 upregulated Smad7 expression.

E. SirT6

The experiments as described in Example 9A above were repeated for inhibitory oligonucleotides designed to target lncRNA as set forth in Table 8 in order to upregulate SirT6. A total of 25 oligonucleotides tested were complementary to SEQ ID NO: 192,182 in Table 2. Of these 25 oligonucleotides, 3 upregulated SirT6 expression. A total of 2 oligonucleotides tested were complementary to SEQ ID NO: 130,694 in Table 2. Of these 2 oligonucleotides, 1 upregulated SirT6 expression. A total of 2 oligonucleotides tested were complementary to SEQ ID NO: 130,695 in Table 2. Of these 2 oligonucleotides, neither upregulated SirT6 expression. Levels increased by 2 to 6 fold over baseline expression. In addition, of 6 oligonucleotides that are complementary to Peaks in Table 8 associated with SirT6, 1 upregulated SirT6 expression.

F. Serpinf1

The experiments as described in Example 9A above were repeated for inhibitory oligonucleotides designed to target lncRNA as set forth in Table 8 in order to upregulate Serpinf1. A total of 38 oligonucleotides tested were complementary to SEQ ID NOs: 16698 and 16699 in Table 2. Of these 38 oligonucleotides, 3 upregulated SerpinF1 expression. Levels increased by 1.2 to 2 fold over baseline expression. In addition, of 32 oligonucleotides that are complementary to Peaks in Table 8 associated with Serpinf1, 3 upregulated SerpinF1 expression.

Example 10

LNA Molecules Targeting Xist Repeat C Rapidly Displace Xist RNA from Xi

Figure 15A:
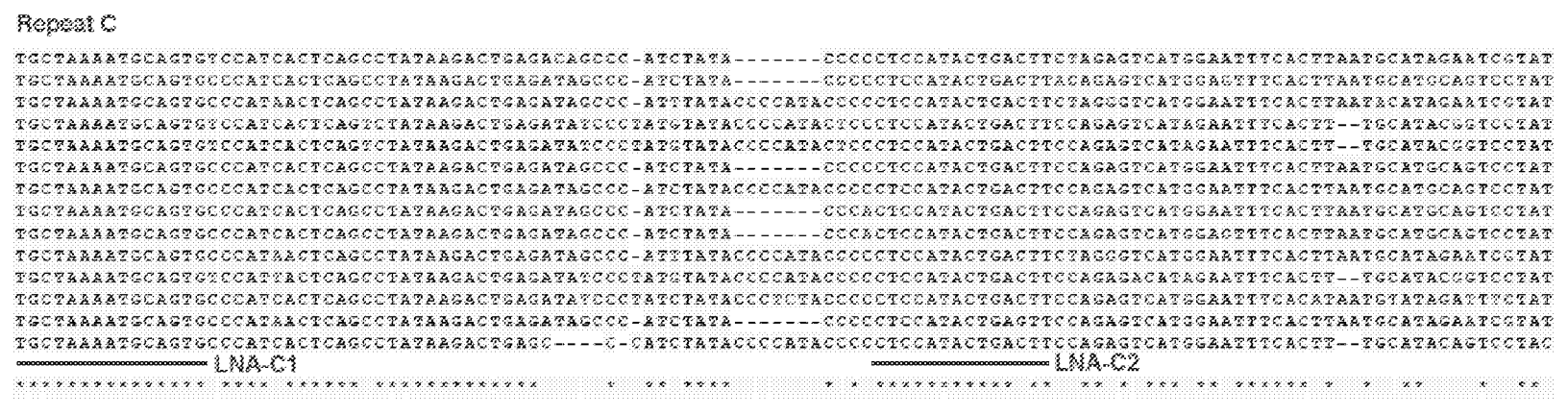
Figure 15B:
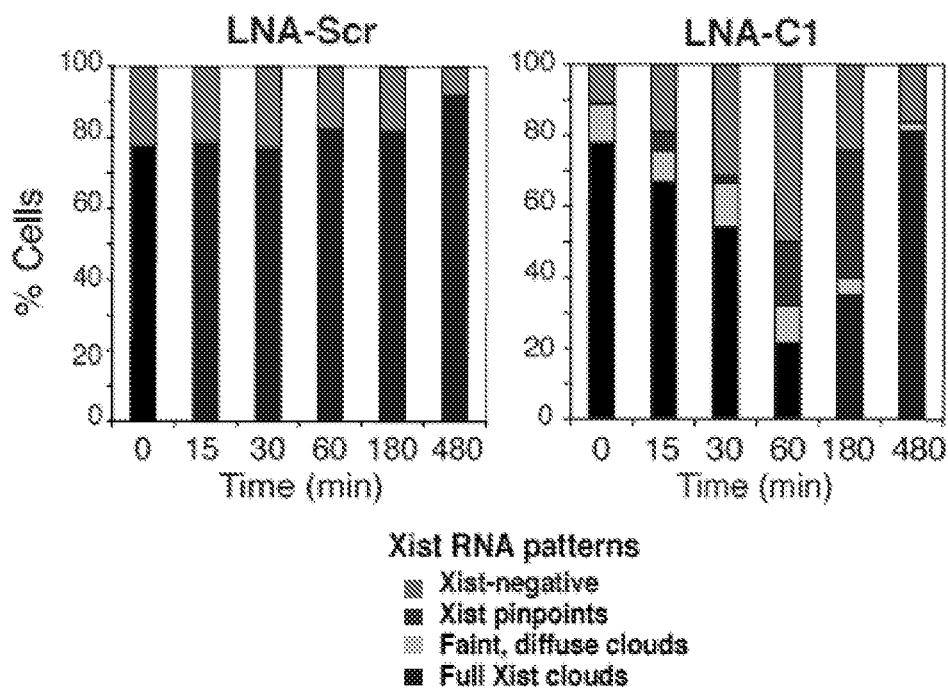
Figure 15C:
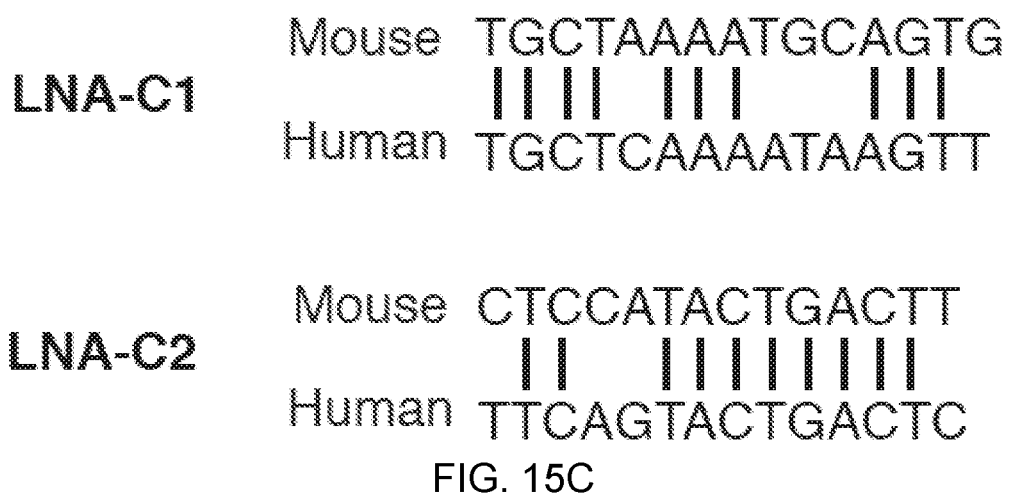

Repeat C was aligned using Geneious (Drummond et al., (2010) Geneious v5.1, Available on the internet at geneious.com) and LNA molecules complementary to two regions with a high degree of inter-repeat conservation were synthesized (FIG. 15A). The first LNA molecule showed conservation in all 14 repeats (LNA-C1) and the second in 13 of 14 (LNA-C2) (FIG. 15A). LNA molecules were nucleofected separately into transformed mouse embryonic fibroblasts (MEFs), and the cells were adhered onto slides and fixed in situ at various timepoints between 0 minutes (immediately after nucleofection) and 8 hours post-nucleofection. To examine effects on Xist RNA, RNA fluorescence in situ hybridization (FISH) was performed using Xist-specific probes. (MEF cells are tetraploid due to transformation; each tetraploid cell has two Xa and two Xi). In controls transfected with scrambled LNA molecules (LNA-Scr), robust Xist clouds were seen in 80-90% of cells at all timepoints (FIG. 15C). Intriguingly, introduction of either LNA-C1 or -C2 resulted in immediate loss of Xist RNA from Xi (FIG. 15B; LNA-C1 shown, with similar results for LNA-C1 and LNA-C2). Even at t=0 (cells fixed immediately, within seconds to minutes, after LNA introduction), ~10% of nuclei displayed a loosening of the Xist RNA clusters, with the clusters appearing faint and diffuse (FIG. 15C lightest grey bars)(n=149). The percentage of nuclei with full Xist clouds continued to drop during the first hour and reached a minimum at t=60 minutes (21%, n=190). These findings indicate that LNA molecules disrupted Xist binding to chromatin as soon as they were introduced. However, the loss of Xist from Xi was transient, as pinpoints of Xist RNA typical of nascent transcripts seen in undifferentiated embryonic stem (ES) cells, became visible at t=3 hr (FIG. 15C, darkest grey bars)(18%, n=190 at 1 hr; 36%, n=123 at 3 hr). Full recovery of Xist clouds was not seen until 8-24 hr post-nucleofection (81% at 8 hr, n=117).

The next experiment addressed whether LNA molecules had similar effects in mouse ES cells an established ex vivo model which recapitulates XCI as the cells differentiate in culture. In the undifferentiated state, wildtype female ES cells express low levels of Xist RNA, visible as pinpoint signals by RNA FISH. By day 6 of differentiation, ~40% of cells would normally have upregulated Xist RNA. When ES cells were nucleofected with LNA-C1 on day 6, Xist displacement occurred rapidly, reaching a maximum at 1 hr and recovering by 8 hr. Thus, LNA molecules were effective in ES cells as well as in somatic cells. These results contracted sharply with those obtained from MEFs nucleofected with siRNAs or shRNAs toward the same region of Xist. Neither siRNAs nor shRNAs led to loss of Xist at the 1, 3 or 24 hour timepoints, and partial decreases in Xist clouds occurred only at 48 hours (83%, n=84 at 1 hr; 80%, n=106 at 24 hr). Thus, LNA molecules can be used efficiently to target long nuclear ncRNAs such as Xist with extremely rapid kinetics, much more rapid than the action of siRNAs or shRNAs, in multiple cell types.

To test the specificity of the LNA molecules, human 293 cells were nucleofected with the Repeat C LNA molecules. Sequence comparison between the mouse and human Xist/XIST revealed that the region targeted by LNA-C1 is conserved in 10 of 15 nt and is conserved in 10 of 14 nt for LNA-C2 (FIG. 15C). Nucleofection of scrambled LNA molecules followed by XIST RNA FISH in human cells showed two normal XIST clouds in nearly all cells (92%, n=108). Similarly, nucleofection with either LNA-C1 or LNAC-2 did not change the XIST clouds (LNA-C1, 89%, n=126; LNA-C2, 85%, n=139). Thus, mouse Repeat C LNA molecules do not affect human XIST localization, suggesting that they function in a species-specific manner. To determine whether human Repeat C could displace human XIST, we nucleofected LNA molecules complementary to the human Repeat C into 293 cells, but observed no loss of XIST clouds (91%, n=103 at 1 hr; 87%, n=95 at 3 hr and 92%, n=85 at 8 hr). This finding indicated that, although Repeat C may play a role in humans, additional human elements function in RNA localization. Whereas mouse Repeat C occurs 14 times, the human repeat is present only once (8, 9).

Example 11

Xist RNA is Displaced without Transcript Destabilization

Figure 16:
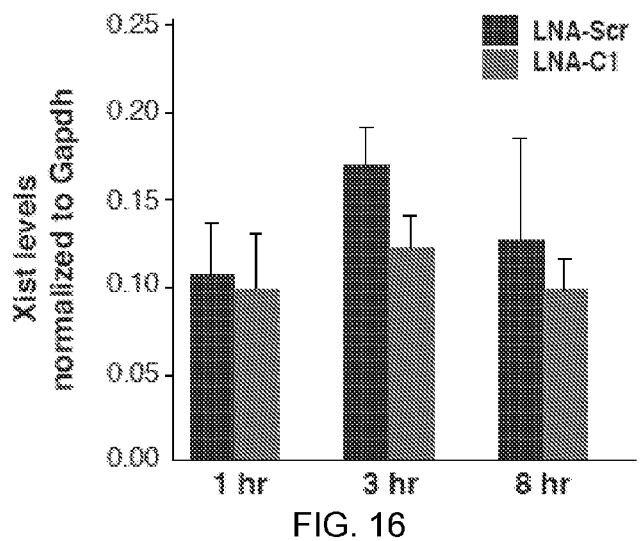
FIG. 16 shows Xist RNA displacement is accompanied by loss of PRC2 localization and recovery occurs initially near Xist. The bar graph shows the results of real-time qRT-PCR analysis of Xist levels, normalized to Gapdh RNA.

Several mechanisms could explain the disappearance of Xist. LNA molecules could anneal to the complementary region and target Xist for degradation. Alternatively, hybridization to LNA molecules could displace Xist RNA from Xi without affecting the transcript stability. To distinguish between these possibilities, Xist levels were quantitated relative to Gadph levels (control) by qRT-PCR at different timepoints. At 1 hr when Xist clouds were no longer visible, Xist levels remained comparable to that seen in the scrambled control (FIG. 16). Even at 3 and 8 hr, Xist levels did not change significantly. These results showed that displacement of Xist occurred without complete RNA degradation. Thus, LNA molecules function by blocking Xist interaction with chromatin rather than altering the RNA's stability.

The rapid displacement of Xist and the slow kinetics of recovery provided the opportunity to investigate several unanswered questions regarding Xist's mechanism of localization. To ask whether reappearance of Xist on Xi is due to relocalization of displaced Xist molecules or to coating by newly synthesized RNA, we performed time-course analysis in the presence of actinomycin D (ActD), an inhibitor of RNA polymerase II. Previous studies have shown that the half-life of Xist in the cell is approximately 4-6 hr (14-16). It was reasoned that treating cells with ActD for 0-8 hr would prevent new synthesis of Xist RNA during this timeframe and that, therefore, reappearance of Xist clouds would imply relocalization of displaced RNA back onto Xi. LNA molecules were introduced into cells and then the cells were allowed to recover in medium containing ActD. In the scrambled controls, Xist clouds were clearly visible at all time points without ActD. With ActD, Xist clouds were apparent in the 1 and 3 hr timepoints and were lost by 8 hr, consistent with a 4-6 hr half-life. In LNA-C1- or LNA-C2-treated samples allowed to recover without ActD, pinpoints of Xist were visible at 3 hr and Xist clouds were restored by the 8 hr timepoint. However, with ActD, Xist clouds were never restored, neither fully nor partially. Thus, Xist recovery after LNA molecule-mediated displacement from Xi is due to new RNA synthesis and not relocalization of the displaced transcript.

Example 12

Xist RNA Localizes Near the X-Inactivation Center First

Taking further advantage of the rapid displacement and slow recovery, the long-standing question of whether Xist spreads in a piecemeal fashion or localizes simultaneously throughout Xi was asked. One hypothesis is that coating initiates near the Xist locus and proceeds to both ends of the chromosome through booster elements located along the X (17). Alternatively, coating can occur all at once through multiple X-linked seeding points which would promote local spreading. Xist localization on metaphase chromosomes was analyzed during the 3-8 hr period of recovery. In cells treated with scrambled LNA molecules, all metaphase chromosomes coated with Xist RNA showed a banded pattern similar to the heterogeneous patterns described in earlier works (18-20). By contrast, LNA-C1 treated cells gave intermediate patterns. At 1 hr, no metaphase chromosomes showed a coat of Xist RNA (0%, n=41). At 3 hr when Xist RNA could be seen as a pinpoint in interphase cells, the predominant pattern was a combination of a single bright band in the middle of the metaphase chromosome together with a small number of very faint bands elsewhere on the X (52%, n=46). This result suggested that Xist RNA initially bound locally. To determine whether the strong RNA band was localized to the Xist region, Xist RNA FISH was carried out on non-denatured nuclei and followed with denaturation and hybridization to an Xist probe. Indeed, the focal RNA band observed at the 3-hr mark colocalized with the Xist region. At 5 hr, intermediate degrees of coating and intensities could be seen (68%, n=38). At 8 hr, the predominant pattern was the whole-chromosome painting pattern typical of control cells (78%, n=38). In controls, intermediate patterns were not observed at any time. These findings argue that Xist RNA initially binds nearby, but seems to spread to the rest of Xi at the same time, within the temporal and spatial resolution of the FISH technique.

Example 13

Xist RNA Displacement is Accompanied by Loss of PRC2 Localization

The pattern of Polycomb repressive complex 2 (PRC2) binding to Xi has been of considerable interest, as its Ezh2 subunit catalyzes trimethylation of Histone H3 at lysine 27 (H3K27me3). Several studies have shown that PRC2 localizes to Xi in an Xist-dependent manner, as deleting Xist in ES cells precludes PRC2 recruitment during differentiation and conditionally deleting Xist in MEF cells results in loss of PRC2 on Xi (21-24). However, the kinetics with which PRC2 is recruited to and lost from X are not known. Because Xist RNA directly recruits PRC2 (12), it was asked whether LNA molecule-mediated displacement of Xist results in immediate loss of PRC2 by immunostaining for Ezh2 in MEFs after LNA molecule delivery. Upon treatment with the Repeat C LNA molecules, Ezh2 was rapidly lost. There was nearly perfect concordance between Xist and PRC2 loss. At 1 and 3 hr, Ezh2 foci were never observed in nuclei that had lost Xist and, conversely, were always observed in nuclei with restored Xist clouds. The loss of Ezh2 on Xi was due to Ezh2 protein turnover (see Western analysis below). Transient displacement of PRC2, however, does not lead to appreciable H3K27me3 loss within the 1-8 hr timeframe. Thus, PRC2's localization onto Xi absolutely depends on Xist RNA for both initial targeting and for stable association after XCI is established, but the H3K27me3 mark is stable in the short term when Xist and PRC2 are displaced.

Given this, it was asked whether LNA molecules affected gene silencing. At 3 hr when Xist was maximally displaced, RNA FISH was performed for Xist and either Pgk1 or Hprt, two X-linked genes subject to XCI. In control-nucleofected (LNA-Scr) cells, Xist clouds were observed from Xi and nascent Pgk1 or Hprt transcripts from Xa. Nucleofection with LNA-C1 and LNA-4978 did not change the expression pattern, as two foci of Pgk1 transcripts were still seen in 79% (n=39) of controls and 80% (n=36) of LNA-C1-treated cells, and two foci of Hprt RNA were seen in 84% (n=44) of controls and 79% (n=35) of LNA-C1-treated cells. Four foci of Pgk1 or Hprt transcripts were never seen. Thus, consistent with retention of H3K27me3, silencing was not disrupted by transient loss of Xist and PRC2.

Example 14

A Broader Domain Around Repeat C is Required for Xist Localization

Figure 17A:
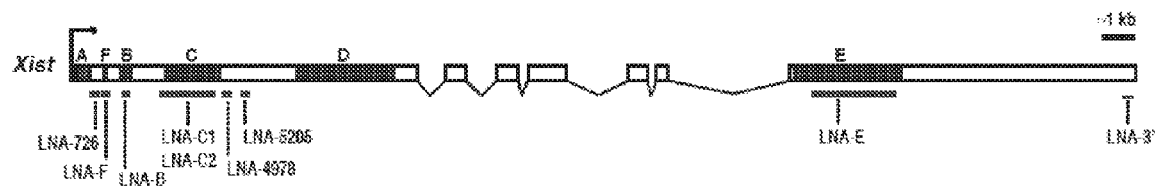
FIGS. 17A-C show that a broader domain around Repeat C is required for Xist localization.
Figure 17B:
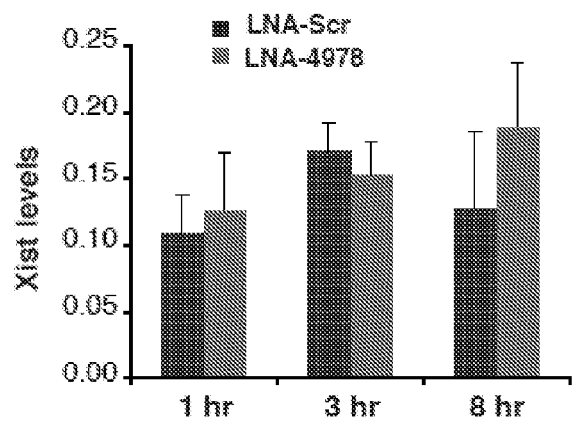
Figure 17C:
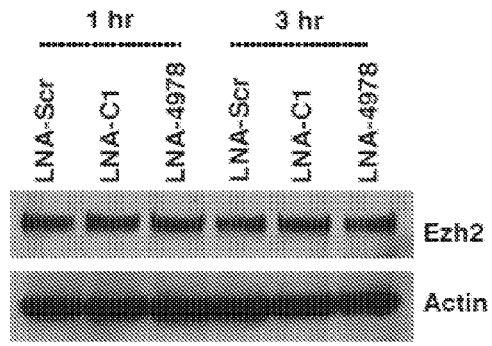

The next experiments investigated other conserved repeats within Xist. As Repeat A has already been shown to be essential for targeting PRC2, the experiments focused on Repeats B, E, and F, and found that Xist localization was not affected by targeting any repeat individually or in combination (FIG. 17A). Conserved unique regions of Xist were also tested, including LNA-726 (between Repeats A and F), LNA-4978 and LNA-5205 (between Repeats C and D), and LNA-3' (distal terminus of Xist) (FIG. 17A). None affected Xist localization except for LNA-4978, which corresponds to a 15-nt element located 280 bp downstream of Repeat C. LNA-4978 induced effects similar to LNA-C1/C2 but differed by its slower kinetics. At 1 hr, Xist clouds were still visible but appeared faint and dispersed (78%, n=125). The number of clouds reached a minimum at 3 hr (25%, n=158). At 8 hr, Xist was visible as small pinpoints (39%, n=123). Recovery was not complete until the 24-hr timepoint. As for Repeat C LNA molecules, loss of Xist was not due to RNA turnover, as determined by qRT-PCR (FIG. 17B), and Ezh2 was displaced without affecting H3K27me3 or change in Ezh2 protein level (FIG. 17C). Therefore, Xist localization to chromatin involves a broader region encompass both Repeat C and a unique region directly downstream of the repeat.

To determine if the two motifs cooperate, LNA-4978 and LNA-C1 were nucleofected separately or together into MEFs. As expected, treating with LNA-C1 alone resulted in loss of Xist RNA clouds by 1 hr and recovery beginning at 3 hr, and treating with LNA-4978 showed loss and recovery at 3 hr and 8 hr, respectively. Treating with both LNA molecules expanded the window of Xist depletion: Loss of Xist RNA and Ezh2 was observed by 1 hr (as was the case for LNA-C1 alone) and recovery did not begin until the 8 hr timepoint (as was the case for LNA-4978 alone). Thus, the LNA molecule effects were additive, not synergistic, as the effects were not enhanced beyond the widening of the Xist-depleted time window.

Example 15

Ezh2 Recovery after LNA Molecule Nucleofection is Slow but Uniform Along Xi

Figure 18A:
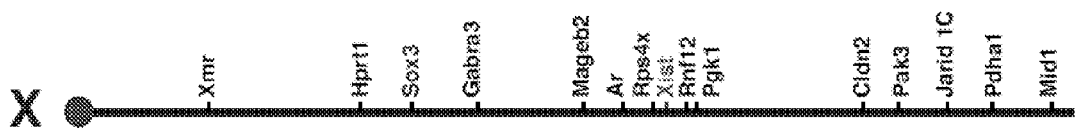
FIGS. 18A-D show Ezh2 recovery after LNA molecule nucleofection is uniform along Xi but slow in kinetics.
Figure 18B:
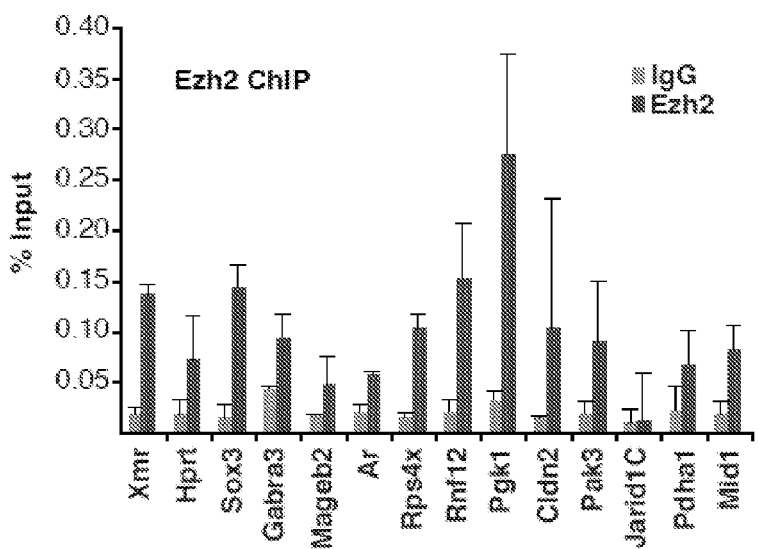
Figure 18C:
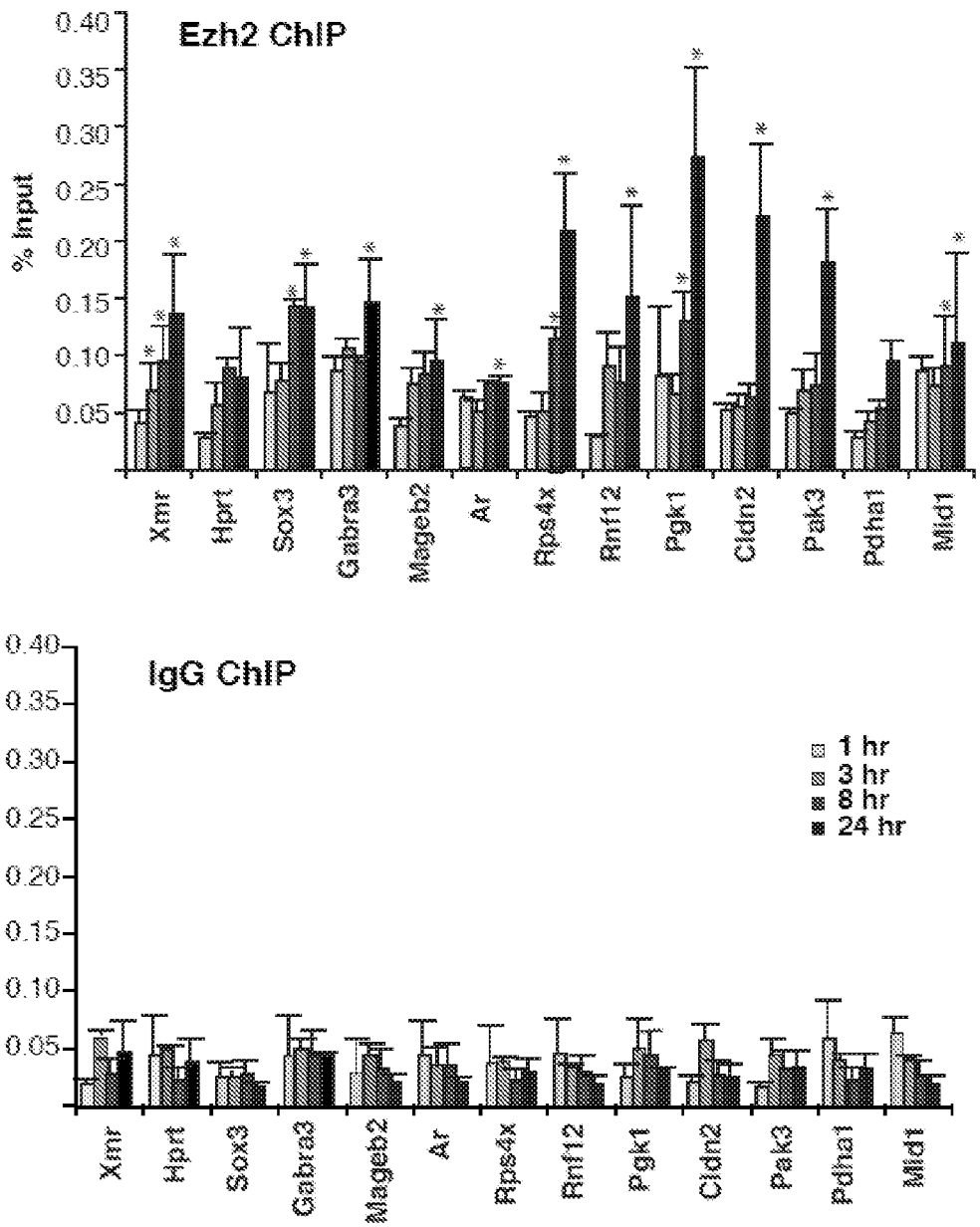
Figure 18D:
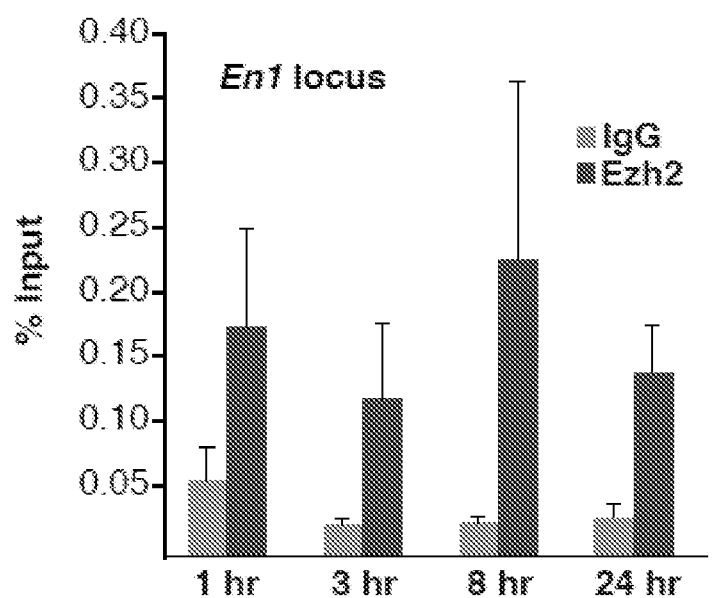

Finally, it was asked whether Ezh2 retargeting to Xi closely follows the piecemeal relocalization of Xist RNA during the recovery phase. Because PRC2 generally binds near promoters (25, 26), Ezh2 localization at X-gene promoters was analyzed by quantitative chromatin immunoprecipitation (qChIP)(FIG. 18A). Although female cells have two Xs and Ezh2 epitopes pulled down by the antibody could theoretically come from either Xa or Xi, evidence indicates that the vast bulk of Ezh2 and H3K27me3 is bound to Xi (21-24). Ezh2 was indeed enriched at promoters of genes that are silenced on Xi (e.g., Xmr, Pgk1), but not at promoters of genes (e.g., Jarid1c) that escape XCI (FIG. 18B). Then, MEF cells were nucleofected with LNA-C1 and performed qChIP using anti-Ezh2 antibodies between 1 and 24 hr. At t=1 hr, Ezh2 levels decreased dramatically at all tested target gene promoters to background levels (FIG. 18C), indicating that depletion of promoter-bound Ezh2 closely followed Xist displacement along Xi. At the 3- and 8-hr points, there was a gradual, uniform increase in Ezh2 levels across all genes, with many genes appearing to have reached saturating amounts of Ezh2 by t=8 hr. On promoters with the highest levels of Ezh2 at t=0 hr (FIG. 18B), Ezh2 levels did not fully recover until 24 hr (FIG. 18C). Thus, ChIP pulldowns were expected to originate predominantly, if not nearly exclusively, from Xi. In contrast, Ezh2 levels at the En1 control, a known autosomal PRC2 target (27), did not change significantly (FIG. 18D). Thus, Ezh2 levels fall and rise with similar kinetics throughout Xi. The loss of Xist RNA and Ezh2 binding between 1 and 8 hrs presents a window of opportunity during which cells could be reprogrammed to achieve novel epigenetic states.

REFERENCES

1. Kapranov P, Willingham A T, & Gingeras T R (2007) Genome-wide transcription and the implications for genomic organization. *Nat Rev Genet* 8(6):413-423.
2. Mercer T R, Dinger M E, & Mattick J S (2009) Long non-coding RNAs: insights into functions. *Nat Rev Genet* 10(3):155-159.
3. Krutzfeldt J, et al. (2005) Silencing of microRNAs in vivo with 'antagomirs'. *Nature* 438(7068):685-689.
4. Orom U A, Kauppinen S, & Lund A H (2006) LNA-modified oligonucleotides mediate specific inhibition of microRNA function. *Gene* 372:137-141.
5. Morris K V (2008) RNA-mediated transcriptional gene silencing in human cells. *Curr Top Microbiol Immunol* 320:211-224.
6. Petersen M & Wengel J (2003) LNA: a versatile tool for therapeutics and genomics. *Trends Biotechnol* 21(2):74-81.
7. Penny G D, Kay G F, Sheardown S A, Rastan S, & Brockdorff N (1996) Requirement for Xist in X chromosome inactivation. *Nature* 379(6561):131-137.
8. Brockdorff N, et al. (1992) The product of the mouse Xist gene is a 15 kb inactive X-specific transcript containing no conserved ORF and located in the nucleus. *Cell* 71(3):515-526.
9. Brown C J, et al. (1992) The human XIST gene: analysis of a 17 kb inactive X-specific RNA that contains conserved repeats and is highly localized within the nucleus. *Cell* 71(3):527-542.
10. Clemson C M, McNeil J A, Willard H F, & Lawrence J B (1996) XIST RNA paints the inactive X chromosome at interphase: evidence for a novel RNA involved in nuclear/chromosome structure. *J Cell Biol* 132(3):259-275.
11. Wutz A, Rasmussen T P, & Jaenisch R (2002) Chromosomal silencing and localization are mediated by different domains of Xist RNA. *Nat Genet* 30(2):167-174.
12. Zhao J, Sun B K, Erwin J A, Song J J, & Lee J T (2008) Polycomb proteins targeted by a short repeat RNA to the mouse X chromosome. *Science* 322(5902):750-756.
13. Beletskii A, Hong Y K, Pehrson J, Egholm M, & Strauss W M (2001) PNA interference mapping demonstrates functional domains in the noncoding RNA Xist. *Proc Natl Acad Sci USA* 98(16):9215-9220.
14. Sheardown S A, et al. (1997) Stabilization of Xist RNA mediates initiation of X chromosome inactivation. *Cell* 91(1): 99-107.
15. Sun B K, Deaton A M, & Lee J T (2006) A transient heterochromatic state in Xist preempts X inactivation choice without RNA stabilization. *Mol Cell* 21(5):617-628.
16. Panning B, Dausman J, & Jaenisch R (1997) X chromosome inactivation is mediated by Xist RNA stabilization. *Cell* 90(5):907-916.
17. Gartler S M & Riggs A D (1983) Mammalian X-chromosome inactivation. *Annu Rev Genet* 17:155-190.
18. Duthie S M, et al. (1999) Xist RNA exhibits a banded localization on the inactive X chromosome and is excluded from autosomal material in cis. *Hum Mol Genet* 8(2):195-204.
19. Chadwick B P & Willard H F (2004) Multiple spatially distinct types of facultative heterochromatin on the human inactive X chromosome. *Proc Natl Acad Sci USA* 101(50): 17450-17455.
20. Clemson C M, Hall L L, Byron M, McNeil J, & Lawrence J B (2006) The X chromosome is organized into a gene-rich outer rim and an internal core containing silenced nongenic sequences. *Proc Natl Acad Sci USA* 103(20): 7688-7693.
21. Plath K, et al. (2003) Role of histone H3 lysine 27 methylation in X inactivation. *Science* 300(5616): 131-135.
22. Kohlmaier A, et al. (2004) A chromosomal memory triggered by Xist regulates histone methylation in X inactivation. *PLoS Biol* 2(7):E 171.
23. Silva J, et al. (2003) Establishment of histone h3 methylation on the inactive X chromosome requires transient recruitment of Eed-Enx1 polycomb group complexes. *Dev Cell* 4(4):481-495.
24. Zhang L F, Huynh K D, & Lee J T (2007) Perinucleolar targeting of the inactive X during S phase: evidence for a role in the maintenance of silencing. *Cell* 129(4):693-706.
25. Boyer L A, et al. (2006) Polycomb complexes repress developmental regulators in murine embryonic stem cells. *Nature* 441(7091):349-353.
26. Ku M, et al. (2008) Genomewide analysis of PRC1 and PRC2 occupancy identifies two classes of bivalent domains. *PLoS Genet* 4(10):e1000242.
27. Bracken A P, Dietrich N, Pasini D, Hansen K H, & Helin K (2006) Genome-wide mapping of Polycomb target genes unravels their roles in cell fate transitions. *Genes Dev* 20(9):1123-1136.
28. Blais A, et al. (2005) An initial blueprint for myogenic differentiation. *Genes Dev* 19(5):553-569.

Axelson, H. (2004). The Notch signaling cascade in neuroblastoma: role of the basic helix-loop-helix proteins HASH-1 and HES-1. Cancer Lett 204, 171-178

Batzoglou, S., Jaffe, D. B., Stanley, K., Butler, J., Gnerre, S., Mauceli, E., Berger, B., Mesirov, J. P., and Lander, E. S. (2002). ARACHNE: a whole-genome shotgun assembler. Genome Res 12, 177-189

Bernardi, R., and Pandolfi, P. P. (2007). Structure, dynamics and functions of promyelocytic leukaemia nuclear bodies. Nat Rev Mol Cell Biol 8, 1006-1016

Bernstein, B. E., Mikkelsen, T. S., Xie, X., Kamal, M., Huebert, D. J., Cuff, J., Fry, B., Meissner, A., Wernig, M., Plath, K., et al. (2006a). A bivalent chromatin structure marks key developmental genes in embryonic stem cells. Cell 125, 315-326

Bernstein, E., and Allis, C. D. (2005). RNA meets chromatin. Genes Dev 19, 1635-1655

Bernstein, E., Duncan, E. M., Masui, O., Gil, J., Heard, E., and Allis, C. D. (2006b). Mouse polycomb proteins bind differentially to methylated histone H3 and RNA and are enriched in facultative heterochromatin. Mol Cell Biol 26, 2560-2569

Boyer, L. A., Plath, K., Zeitlinger, J., Brambrink, T., Medeiros, L. A., Lee, T. I., Levine, S. S., Wernig, M., Tajonar, A., Ray, M. K., et al. (2006). Polycomb complexes repress developmental regulators in murine embryonic stem cells. Nature 441, 349-353

Carninci, P., Kasukawa, T., Katayama, S., Gough, J., Frith, M. C., Maeda, N., Oyama, R., Ravasi, T., Lenhard, B., Wells, C., et al. (2005). The transcriptional landscape of the mammalian genome. Science 309, 1559-1563

Cloonan, N., Forrest, A. R., Kolle, G., Gardiner, B. B., Faulkner, G. J., Brown, M. K., Taylor, D. F., Steptoe, A. L., Wani, S., Bethel, G., et al. (2008). Stem cell transcriptome profiling via massive-scale mRNA sequencing. Nat Methods 5, 613-619

Coombes, C., Arnaud, P., Gordon, E., Dean, W., Coar, E. A., Williamson, C. M., Feil, R., Peters, J., and Kelsey, G. (2003). Epigenetic properties and identification of an imprint mark in the Nesp-Gnasxl domain of the mouse Gnas imprinted locus. Mol Cell Biol 23, 5475-5488

Core, L. J., Waterfall, J. J., and Lis, J. T. (2008). Nascent RNA sequencing reveals widespread pausing and divergent initiation at human promoters. Science 322, 1845-1848

Denisenko, O., Shnyreva, M., Suzuki, H., and Bomsztyk, K. (1998). Point mutations in the WD40 domain of Eed block its interaction with Ezh2 Mol Cell Biol 18, 5634-5642

Edwards, C. A., and Ferguson-Smith, A. C. (2007). Mechanisms regulating imprinted genes in clusters. Curr Opin Cell Biol 19, 281-289

Edwards, C. A., Mungall, A. J., Matthews, L., Ryder, E., Gray, D. J., Pask, A. J., Shaw, G., Graves, J. A., Rogers, J., Dunham, I., et al. (2008). The evolution of the DLK1-DIO3 imprinted domain in mammals. PLoS Biol 6, e135

Francis, N. J., Saurin, A. J., Shao, Z., and Kingston, R. E. (2001). Reconstitution of a functional core polycomb repressive complex. Mol Cell 8, 545-556

Gupta, R. A., Shah, N., Wang, K. C., Kim, J., Horlings, H. M., Wong, D. J., Tsai, M. C., Hung, T., Argani, P., Rinn, J. L., et al. (2010). Long non-coding RNA HOTAIR reprograms chromatin state to promote cancer metastasis. Nature 464, 1071-1076

Guttman, M., Amit, I., Garber, M., French, C., Lin, M. F., Feldser, D., Huarte, M., Zuk, O., Carey, B. W., Cassady, J. P., et al. (2009). Chromatin signature reveals over a thousand highly conserved large non-coding RNAs in mammals. Nature Kanhere, A., Viiri, K., Araujo, C. C., Rasaiyaah, J., Bouwman, R. D., Whyte, W. A., Pereira, C. F., Brookes, E., Walker, K., Bell, G. W., et al. (2010). Short RNAs Are Transcribed from Repressed Polycomb Target Genes and Interact with Polycomb Repressive Complex-2. Mol Cell 38, 675-688

Kapranov, P., Cheng, J., Dike, S., Nix, D. A., Duttagupta, R., Willingham, A. T., Stadler, P. F., Hertel, J., Hackermuller, J., Hofacker, I. L., et al. (2007). RNA maps reveal new RNA classes and a possible function for pervasive transcription. Science 316, 1484-1488

Khalil, A. M., Guttman, M., Huarte, M., Garber, M., Raj, A., Rivea Morales, D., Thomas, K., Presser, A., Bernstein, B. E., van Oudenaarden, A., et al. (2009). Many human large intergenic noncoding RNAs associate with chromatin-modifying complexes and affect gene expression. Proc Natl Acad Sci USA Ku, M., Koche, R. P., Rheinbay, E., Mendenhall, E. M., Endoh, M., Mikkelsen, T. S., Presser, A., Nusbaum, C., Xie, X., Chi, A. S., et al. (2008). Genomewide analysis of PRC1 and PRC2 occupancy identifies two classes of bivalent domains. PLoS Genet 4, e1000242

Lee, J. T. (2009). Lessons from X-chromosome inactivation: long ncRNA as guides and tethers to the epigenome. Genes Dev 23, 1831-1842

Lee, J. T. (2010). The X as model for RNA's niche in epigenomic regulation. Cold Spring Harb Perspect Biol 2, a003749

Lee, J. T., and Lu, N. (1999). Targeted mutagenesis of Tsix leads to nonrandom X inactivation. Cell 99, 47-57

Lee, T. I., Jenner, R. G., Boyer, L. A., Guenther, M. G., Levine, S. S., Kumar, R. M., Chevalier, B., Johnstone, S. E., Cole, M. F., Isono, K., et al. (2006). Control of developmental regulators by Polycomb in human embryonic stem cells. Cell 125, 301-313

Li, G., Margueron, R., Ku, M., Chambon, P., Bernstein, B. E., and Reinberg, D. Jarid2 and PRC2, partners in regulating gene expression. Genes Dev 24, 368-380

Li, G., Margueron, R., Ku, M., Chambon, P., Bernstein, B. E., and Reinberg, D. (2010). Jarid2 and PRC2, partners in regulating gene expression. Genes Dev 24, 368-380

Lin, S. P., Youngson, N., Takada, S., Seitz, H., Reik, W., Paulsen, M., Cavaille, J., and Ferguson-Smith, A. C. (2003). Asymmetric regulation of imprinting on the maternal and paternal chromosomes at the Dlk1-Gtl2 imprinted cluster on mouse chromosome 12. Nat Genet 35, 97-102

Mercer, T. R., Dinger, M. E., and Mattick, J. S. (2009). Long non-coding RNAs: insights into functions. Nat Rev Genet 10, 155-159

Mikkelsen, T. S., Ku, M., Jaffe, D. B., Issac, B., Lieberman, E., Giannoukos, G., Alvarez, P., Brockman, W., Kim, T. K., Koche, R. P., et al. (2007). Genome-wide maps of chromatin state in pluripotent and lineage-committed cells. Nature 448, 553-560

Miremadi, A., Oestergaard, M. Z., Pharoah, P. D., and Caldas, C. (2007). Cancer genetics of epigenetic genes. Hum Mol Genet 16 Spec No 1, R28-49

Montgomery, N. D., Yee, D., Chen, A., Kalantry, S., Chamberlain, S. J., Otte, A. P., and Magnuson, T. (2005). The murine polycomb group protein Eed is required for global histone H3 lysine-27 methylation. Curr Biol 15, 942-947

Mortazavi, A., Williams, B. A., McCue, K., Schaeffer, L., and Wold, B. (2008). Mapping and quantifying mammalian transcriptomes by RNA-Seq. Nat Methods 5, 621-628

Pandey, R. R., Mondal, T., Mohammad, F., Enroth, S., Redrup, L., Komorowski, J., Nagano, T., Mancini-Dinardo, D., and Kanduri, C. (2008). Kcnq1ot1 antisense noncoding RNA mediates lineage-specific transcriptional silencing through chromatin-level regulation. Mol Cell 32, 232-246

Pasini, D., Bracken, A. P., Jensen, M. R., Lazzerini Denchi, E., and Helin, K. (2004). Suz12 is essential for mouse development and for EZH2 histone methyltransferase activity. EMBO J 23, 4061-4071

Pasini, D., Cloos, P. A., Walfridsson, J., Olsson, L., Bukowski, J. P., Johansen, J. V., Bak, M., Tommerup, N., Rappsilber, J., and Helin, K. JARID2 regulates binding of the Polycomb repressive complex 2 to target genes in E S cells. Nature 464, 306-310

Peng, J. C., Valouev, A., Swigut, T., Zhang, J., Zhao, Y., Sidow, A., and Wysocka, J. (2009). Jarid2/Jumonji Coordinates Control of PRC2 Enzymatic Activity and Target Gene Occupancy in Pluripotent Cells. Cell 139, 1290-1302

Pietersen, A. M., and van Lohuizen, M. (2008). Stem cell regulation by polycomb repressors: postponing commitment. Curr Opin Cell Biol 20, 201-207

Rajasekhar, V. K., and Begemann, M. (2007). Concise review: roles of polycomb group proteins in development and disease: a stem cell perspective. Stem Cells 25, 2498-2510

Ringrose, L., and Paro, R. (2004). Epigenetic regulation of cellular memory by the Polycomb and Trithorax group proteins Annu Rev Genet 38, 413-443

Rinn, J. L., Kertesz, M., Wang, J. K., Squazzo, S. L., Xu, X., Brugmann, S. A., Goodnough, L. H., Helms, J. A., Farnham, P. J., Segal, E., et al. (2007). Functional demarcation of active and silent chromatin domains in human HOX loci by noncoding RNAs. Cell 129, 1311-1323

Schoeftner, S., Sengupta, A. K., Kubicek, S., Mechtler, K., Spahn, L., Koseki, H., Jenuwein, T., and Wutz, A. (2006). Recruitment of PRC1 function at the initiation of X inactivation independent of PRC2 and silencing. Embo J 25, 3110-3122

Schuettengruber, B., Chourrout, D., Vervoort, M., Leblanc, B., and Cavalli, G. (2007). Genome regulation by polycomb and trithorax proteins. Cell 128, 735-745

Schwartz, Y. B., Kahn, T. G., Nix, D. A., Li, X. Y., Bourgon, R., Biggin, M., and Pirrotta, V. (2006). Genome-wide analysis of Polycomb targets in *Drosophila melanogaster*. Nat Genet 38, 700-705

Schwartz, Y. B., and Pirrotta, V. (2008). Polycomb complexes and epigenetic states. Curr Opin Cell Biol 20, 266-273

Seila, A. C., Calabrese, J. M., Levine, S. S., Yeo, G. W., Rahl, P. B., Flynn, R. A., Young, R. A., and Sharp, P. A. (2008). Divergent transcription from active promoters. Science 322, 1849-1851

Shen, X., Liu, Y., Hsu, Y. J., Fujiwara, Y., Kim, J., Mao, X., Yuan, G. C., and Orkin, S. H. (2008). EZH1 mediates methylation on histone H3 lysine 27 and complements EZH2 in maintaining stem cell identity and executing pluripotency. Mol Cell 32, 491-502

Shen, X., Woojin, K., Fujiwara, Y., Simon, M. D., Liu, Y., Mysliwiec, M. R., Yuan, G. C., Lee, Y., and Orkin, S. H. (2009). Jumonji Modulates Polycomb Activity and Self-Renewal versus Differentiation of Stem Cells. Cell 139, 1303-1314

Simon, J. A., and Lange, C. A. (2008). Roles of the EZH2 histone methyltransferase in cancer epigenetics. Mutat Res 647, 21-29

Sing, A., Pannell, D., Karaiskakis, A., Sturgeon, K., Djabali, M., Ellis, J., Lipshitz, H. D., and Cordes, S. P. (2009). A vertebrate Polycomb response element governs segmentation of the posterior hindbrain. Cell 138, 885-897

Sparmann, A., and van Lohuizen, M. (2006). Polycomb silencers control cell fate, development and cancer. Nat Rev Cancer 6, 846-856

Taft, R. J., Glazov, E. A., Cloonan, N., Simons, C., Stephen, S., Faulkner, G. J., Lassmann, T., Forrest, A. R., Grimmond, S. M., Schroder, K., et al. (2009). Tiny RNAs associated with transcription start sites in animals. Nat Genet 41, 572-578

Takahashi, N., Okamoto, A., Kobayashi, R., Shirai, M., Obata, Y., Ogawa, H., Sotomaru, Y., and Kono, T. (2009). Deletion of Gtl2, imprinted non-coding RNA, with its differentially methylated region induces lethal parent-origin-dependent defects in mice. Hum Mol Genet 18, 1879-1888

Thorvaldsen, J. L., and Bartolomei, M. S. (2007). SnapShot: imprinted gene clusters. Cell 130, 958

Ule, J., Jensen, K., Mele, A., and Darnell, R. B. (2005). CLIP: a method for identifying protein-RNA interaction sites in living cells. Methods 37, 376-386

Wan, L. B., and Bartolomei, M. S. (2008). Regulation of imprinting in clusters: noncoding RNAs versus insulators. Adv Genet 61, 207-223

Williamson, C. M., Turner, M. D., Ball, S. T., Nottingham, W. T., Glenister, P., Fray, M., Tymowska-Lalanne, Z., Plagge, A., Powles-Glover, N., Kelsey, G., et al. (2006). Identification of an imprinting control region affecting the expression of all transcripts in the Gnas cluster. Nat Genet 38, 350-355

Woo, C. J., Kharchenko, P. V., Daheron, L., Park, P. J., and Kingston, R. E. (2010). A region of the human HOXD cluster that confers Polycomb-group responsiveness. Cell 140, 99-110

Yap, K. L., Li, S., Munoz-Cabello, A. M., Raguz, S., Zeng, L., Mujtaba, S., Gil, J., Walsh, M. J., and Zhou, M. M. (2010). Molecular interplay of the noncoding RNA ANRIL and methylated histone H3 lysine 27 by polycomb CBX7 in transcriptional silencing of INK4a. Mol Cell 38, 662-674

Zhao, J., Sun, B. K., Erwin, J. A., Song, J. J., and Lee, J. T. (2008). Polycomb proteins targeted by a short repeat RNA to the mouse X chromosome. Science 322, 750-756

Prasanth et al., Cell, 123:249-263, 2005

Khalil et al., Proc. Natl. Acad. Sci. USA, 106:11667-1672, 2009

Bernard et al., EMBO J, 29:3082-3093, 2010

Mariner et al., Molec. Cell, 29:499-509, 2008

Shamovsky et al., Nature, 440:556-560, 2006

Sunwoo et al., Genome Res., 19:347-359, 2009

Kanhere et al., Molec. Cell, 38:675-388, 2010

Sarma et al., Proc. Natl. Acad. Sci., USA 107:22196-22201, 2010

Examples of Embodiments

Examples of embodiments described herein include, but are not limited to:

1. A method of preparing a plurality of validated cDNAs complementary to a pool of nuclear ribonucleic acids (nR-NAs), the method comprising:

providing a sample comprising nuclear ribonucleic acids, e.g., a sample comprising nuclear lysate, e.g., comprising nRNAs bound to nuclear proteins;

contacting the sample with an agent, e.g., an antibody, that binds specifically to a nuclear protein that is known or suspected to bind to nuclear ribonucleic acids, e.g., Ezh2, G9a, or Cbx7, under conditions sufficient to form complexes between the agent and the protein, e.g., such that the nRNAs remain bound to the proteins;

isolating the complexes;

synthesizing DNA complementary to the nRNAs to provide an initial population of cDNAs;

optionally PCR-amplifying the cDNAs using strand-specific primers;

purifying the initial population of cDNAs to obtain a purified population of cDNAs that are at least about 20 nucleotides (nt) in length, e.g., at least 25, 50, 100, 150 or 200 nt in length;

sequencing at least part or substantially all of the purified population of cDNAs; comparing the high-confidence sequences to a reference genome, and selecting those sequences that have a high degree of identity to sequences in the reference genome, e.g., at least 95%, 98%, or 99% identity, or that have fewer than 10, 5, 2, or 1 mismatches; and selecting those cDNAs that have (i) reads per kilobase per million reads (RPKM) above a desired threshold, and (ii) are enriched as compared to a control library (e.g., a protein-null library or library made from an IgG pulldown done in parallel);

thereby preparing the library of cDNAs.

2. The method of embodiment 1, wherein the agent is an antibody and isolating the complexes comprises immunoprecipitating the complexes.

3. The method of embodiment 1, wherein the cDNAs are synthesized using strand-specific adaptors.

4. The method of embodiment 1, further comprising sequencing substantially all of the cDNAs.

5. A library of cDNAs complementary to a pool of nuclear ribonucleic acids (nRNAs) prepared by the method of embodiments 1-4.

6. The library of embodiment 5, wherein each of the cDNAs is linked to an individually addressable bead or area on a substrate.

7. An isolated nucleic acid comprising a sequence referred to in Table 1, 2, 3, 6, and/or 7, or a fragment comprising at least 20 nt thereof 8. A method of decreasing expression of an oncogene in a cell, the method comprising contacting the cell with a long non-coding RNA, or PRC2-binding fragment thereof, as referred to in Table 6 or a nucleic acid sequence that is at least about 90%, 91%, 92%, 93%, 94%, 95%, 96%, 97%, 98%, 99%, or 100% homologous to a lncRNA sequence, or PRC2-binding fragment thereof, as referred to in Table 6.

9. The method of embodiment 8, wherein the oncogene is c-myc.

10. The method of embodiment 9, wherein the long non-coding RNA is Pvt1.

11. A method of increasing expression of a tumor suppressor in a mammal, e.g. human, in need thereof comprising administering to said mammal an inhibitory nucleic acid that specifically binds to a human lncRNA corresponding to a tumor suppressor locus of Table 7, or a human lncRNA corresponding to an imprinted gene of Table 1, and/or a human lncRNA corresponding to a growth-suppressing gene of Table 2, or a related naturally occurring lncRNA that is orthologous or at least 90%, (e.g., 91%, 92%, 93%, 94%, 95%, 96%, 97%, 98%, 99%, or 100%) identical over at least 15 (e.g., at least 20, 21, 25, 30, 100) nucleobases thereof, in an amount effective to increase expression of the tumor suppressor.

12. A method of inhibiting or suppressing tumor growth in a mammal, e.g. human, with cancer comprising administering to said mammal an inhibitory nucleic acid that specifically binds to a human lncRNA corresponding to a tumor suppressor locus of Table 7, or a human lncRNA corresponding to an imprinted gene of Table 1, and/or a human lncRNA corresponding to a growth-suppressing gene of Table 2, or a related naturally occurring lncRNA that is orthologous or at least 90%, (e.g., 91%, 92%, 93%, 94%, 95%, 96%, 97%, 98%, 99%, or 100%) identical over at least 15 (e.g., at least 20, 21, 25, 30, 50, 70, 100) nucleobases thereof, in an amount effective to suppress or inhibit tumor growth.

13. A method of treating a mammal, e.g., a human, with cancer comprising administering to said mammal an inhibitory nucleic acid that specifically binds to a human lncRNA corresponding to a tumor suppressor locus of Table 7, or a human lncRNA corresponding to an imprinted gene of Table 1, and/or a human lncRNA corresponding to a growth-suppressing gene of Table 2, or a related naturally occurring lncRNA that is orthologous or at least 90% (e.g., 91%, 92%, 93%, 94%, 95%, 96%, 97%, 98%, 99%, or 100%) identical over at least 15 (e.g., at least 20, 21, 25, 30, 50, 70, 100) nucleobases thereof, in a therapeutically effective amount.

14. The method of any of embodiments 11-13 wherein the inhibitory nucleic acid is single stranded or double stranded.

15. The method of any of embodiments 11-14 wherein the inhibitory nucleic acid is an antisense oligonucleotide, LNA, PNA, ribozyme or siRNA.

16. The method of any of embodiments 11-15 wherein the inhibitory nucleic acid is 5-40 bases in length (e.g., 12-30, 12-28, 12-25).

17. The method of embodiment 14 wherein the inhibitory nucleic acid is double stranded and comprises an overhang (optionally 2-6 bases in length) at one or both termini.

18. The method of any of embodiments 1-17 wherein the inhibitory nucleic acid comprises a sequence of bases at least 80% or 90% complementary to (e.g., at least 5, 10, 15, 20, 25 or 30 bases of, or up to 30 or 40 bases of), or comprises a sequence of bases with up to 3 mismatches (e.g., up to 1, or up to 2 mismatches) over 10, 15, 20, 25 or 30 bases.

19. The method of embodiments 8-18, wherein the cell is a cancer cell, e.g., a tumor cell, in vitro or in vivo, e.g., in a subject.

20. The method of embodiments 8-19, wherein the gene is Nkx2-1.

21. The method of embodiment 20, wherein the long non-coding RNA is at mouse Chromosome 12 from by 57,636,100 to 57,638,250 in the mouse genome assembly version NCBI37/mm9 (SEQ ID NO: 191,088), or in the human NKX2-1 locus at Chromosome 14 from by 36,988,521 to 36,991,722, in human genome assembly version, GRCh37/hg19 (SEQ ID NO: 191,087).

22. A method of enhancing pluripotency of a stem cell, the method comprising contacting the cell with a long non-coding RNA, or PRC2-binding fragment thereof, as referred to in Table 3 or a nucleic acid sequence that is at least about 90%, 91%, 92%, 93%, 94%, 95%, 96%, 97%, 98% or 99% homologous to a lncRNA sequence, or PRC2-binding fragment thereof, as referred to in Table 3.

23. A method of enhancing differentiation of a stem cell, the method comprising contacting the cell with an inhibitory nucleic acid that specifically binds to a long non-coding RNA as referred to in Table 3.

24. The method of embodiments 22 or 23, wherein the stem cell is an embryonic stem cell.

25. The method of embodiments 22 or 23, wherein the stem cell is an iPS cell.

26. A sterile composition comprising an inhibitory nucleic acid that specifically binds to or is at least 90% complementary to (e.g., at least 5, 10, 15, 20, 25 or 30 bases of, or up to 30 or 40 bases of) a lncRNA of Table 1, 2, 6, or 7, or a related naturally occurring lncRNA at least 90%, 91%, 92%, 93%, 94%, 95%, 96%, 97%, 98%, 99%, or 100% identical to at least 15 (e.g., at least 20, 21, 25, 30, 100) nucleobases of an lncRNA of Table 1, 2, 6, or 7, for parenteral administration.

27. The composition of embodiment 26, wherein the inhibitory nucleic acid is selected from the group consisting of antisense oligonucleotides, ribozymes, external guide sequence (EGS) oligonucleotides, siRNA compounds, micro RNAs (miRNAs); small, temporal RNAs (stRNA), and single- or double-stranded RNA interference (RNAi) compounds.

28. The composition of embodiment 26, wherein the RNAi) compound is selected from the group consisting of short interfering RNA (siRNA); or a short, hairpin RNA (shRNA); small RNA-induced gene activation (RNAa); and small activating RNAs (saRNAs).

29. The composition of embodiment 26, wherein the antisense oligonucleotide is selected from the group consisting of antisense RNAs, antisense DNAs, chimeric antisense oligonucleotides, and antisense oligonucleotides 30. The composition of any of embodiments 26-29, wherein the inhibitory nucleic acid comprises one or more modifications comprising: a modified sugar moiety, a modified internucleoside linkage, a modified nucleotide and/or combinations thereof.

31. The composition of embodiment 30, wherein the modified internucleoside linkage comprises at least one of: alkylphosphonate, phosphorothioate, phosphorodithioate, alkylphosphonothioate, phosphoramidate, carbamate, carbonate, phosphate triester, acetamidate, carboxymethyl ester, or combinations thereof.

32. The composition of embodiment 30, wherein the modified sugar moiety comprises a 2'-O-methoxyethyl modified sugar moiety, a 2'-methoxy modified sugar moiety, a 2'-O-alkyl modified sugar moiety, or a bicyclic sugar moiety.

Yet other examples of embodiments include, but are not limited to:

1A. A locked nucleic acid (LNA) molecule that is complementary to and binds specifically to a long noncoding RNA (lncRNA).

With respect to these embodiments, lncRNA includes endogenous cellular RNAs that are greater than 60 nt in length, e.g., greater than 100 nt, e.g., greater than 200 nt, have no positive-strand open reading frames greater than 100 amino acids in length, are identified as lncRNAs by experimental evidence, and are distinct from known (smaller) functional-RNA classes (including but not limited to ribosomal, transfer, and small nuclear/nucleolar RNAs, siRNA, piRNA, and miRNA). See, e.g., Lipovich et al., "MacroRNA underdogs in a microRNA world: Evolutionary, regulatory, and biomedical significance of mammalian long non-protein-coding RNA" Biochimica et Biophysica Acta (2010) doi: 10.1016/j.bbagrm.2010.10.001; Ponting et al., Cell 136(4): 629-641 (2009), Jia et al., RNA 16 (8) (2010) 1478-1487, Dinger et al., Nucleic Acids Res. 37 1685 (2009) D122-D126 (database issue); and references cited therein. LncRNAs have also been referred to as long RNA, large RNA, macro RNA, intergenic RNA, and NonCoding Transcripts.

2A. The molecule of embodiment 1A, wherein the lncRNA is a large intergenic non-coding RNA (lincRNA), a promoter associated short RNA (PASR), an endogenous antisense RNA, or an RNA that binds a chromatin modifier, e.g., a Polycomb complex, e.g., Polycomb repressive complex 2.

3A. The molecule of embodiment 1A, wherein the lncRNA is localized to the nucleus.

4A. The molecule of embodiment 1A, wherein the LNA molecule is complementary to a region of the lncRNA comprising a known RNA localization motif 5A. The method of embodiment 1A, wherein the LNA comprises at least one non-locked nucleotide.

6A. A method of dissociating a long noncoding RNA (lncRNA) from its cognate binding sequence, the method comprising contacting the lncRNA with a locked nucleic acid (LNA) molecule that is complementary to and binds specifically to the lncRNA.

7A. A method of decreasing binding of a long noncoding RNA (lncRNA) to its cognate binding sequence, the method comprising contacting the lncRNA with a locked nucleic acid (LNA) molecule that is complementary to and binds specifically to the lncRNA.

8A. The method of embodiment 6A or 7A, wherein the lncRNA is a large intergenic non-coding RNA (lincRNA), a promoter associated short RNA (PASR), an endogenous antisense RNA, or an RNA that binds a chromatin modifier.

9A. The method of embodiment 6A or 7A, wherein the lncRNA is localized to the nucleus.

10A. The method of embodiment 6A or 7A, wherein the LNA molecule is complementary to a region of the lncRNA comprising a known RNA localization motif 11A. The method of embodiment 6A or 7A, wherein the LNA comprises at least one non-locked nucleotide.

Yet other examples of embodiments include, but are not limited to:

1B. An inhibitory nucleic acid that specifically binds, or is complementary to, an RNA that is known to bind to Polycomb repressive complex 2 (PRC2), optionally an RNA of SEQ ID NO: 17040, or an RNA of any of Tables 1-8 or an RNA of any of SEQ ID NOS: 1 to 193,049, for use in the treatment of disease, wherein the treatment involves modulating expression of a gene targeted by the RNA, wherein the inhibitory nucleic acid is between 5 and 40 bases in length, and wherein the inhibitory nucleic acid is formulated as a sterile composition.

2B. A process of preparing an inhibitory nucleic acid that specifically binds, or is complementary to, an RNA that is known to bind to Polycomb repressive complex 2 (PRC2), the process comprising the step of designing and/or synthesizing an inhibitory nucleic acid of between 5 and 40 bases in length, optionally single stranded, that specifically binds to an RNA sequence that binds to PRC2, optionally an RNA of SEQ ID NO: 17040, or an RNA of any of Tables 1-8 or an RNA of any of SEQ ID NOS: 1 to 193,049.

3B. The process of embodiment 2B wherein prior to designing and/or synthesising the inhibitory nucleic acid the process further comprises identifying an RNA that binds to PRC2.

4B. The process of embodiment 2B wherein the RNA has been identified by a method involving identifying an RNA that binds to PRC2.

5B. The process of embodiment 2B, wherein the sequence of the designed and/or synthesised inhibitory nucleic acid is based on a said RNA sequence that binds to PRC2, or a portion thereof, said portion having a length of from 15 to 100 contiguous base pairs.

6B. The process of embodiment 2B, wherein the sequence of the designed and/or synthesised inhibitory nucleic acid is based on a nucleic acid sequence that is complementary to said RNA sequence that binds to PRC2, or is complementary to a portion thereof, said portion having a length of from 5 to 40 contiguous base pairs;

7B. The process of any one of embodiments 2B to 6B, wherein the inhibitory nucleic acid is for use in the manufacture of a pharmaceutical composition or medicament for use in the treatment of disease, optionally wherein the treatment involves modulating expression of a gene targeted by the RNA binds to PRC2.

8B. A sterile composition comprising an inhibitory nucleic acid that specifically binds, or is complementary to, an RNA sequence of any one of SEQ ID NOS: 1 to 193,049, and is capable of modulating expression of a gene targeted by the RNA.

9B. An inhibitory nucleic acid for use in the treatment of disease, wherein said inhibitory nucleic acid specifically binds, or is complementary to, an RNA sequence of any one of SEQ ID NOS: 1 to 193,049, and wherein the treatment involves modulating expression of a gene targeted by the RNA.

10B. A method of modulating gene expression comprising administering to a mammal an inhibitory nucleic acid that specifically binds, or is complementary to, an RNA sequence of any one of SEQ ID NOS: 1 to 193,049, in an amount effective for modulating expression of a gene targeted by the RNA.

11B. An inhibitory nucleic acid for use in the treatment of disease, wherein said inhibitory nucleic acid specifically binds, or is complementary to, a mouse RNA sequence of any one of the mouse RNAs of Tables 1-7, e.g., set forth in SEQ ID NOS: 1 to 12,603, and wherein the treatment involves modulating expression of a gene targeted by the RNA.

12B. An inhibitory nucleic acid for use in the treatment of disease, wherein said inhibitory nucleic acid specifically binds, or is complementary to a human RNA sequence corresponding to a mouse RNA sequence of any one of the mouse RNAs of Tables 1-7, e.g., set forth in SEQ ID NOS: 1 to 12,603 wherein the human RNA sequence is (a) obtainable by mapping of highly conserved regions from the mouse to human genome, or by mapping of syntenic positions from the mouse to human genome, e.g., mouse-to-human LiftOver analysis, or (b) is at least 90% identical over at least 15 bases (or at least 20, 21, 25, 30, or 100 bases) to the mouse RNA sequence, and wherein the treatment involves modulating expression of a gene targeted by the RNA.

13B. The inhibitory nucleic acid of embodiment 12B wherein the human RNA sequence is any one of the human RNAs of Table 1-7, e.g. set forth in SEQ ID NOS: 12,604 to 21,582 or 191,089 to 193,049.

14B. A method of modulating expression of a gene comprising administering to a mammal an inhibitory nucleic acid that specifically binds, or is complementary to, a mouse RNA sequence of any one of the mouse RNAs of Tables 1-7, e.g. set forth in SEQ ID NOS: 1 to 12,603, in an amount effective for modulating expression of a gene targeted by the RNA.

15B. A method of modulating expression of a gene comprising administering to a mammal an inhibitory nucleic acid that specifically binds, or is complementary to a human RNA sequence that corresponds to a mouse RNA sequence of any one of the mouse RNAs of Tables 1-7, e.g. set forth in SEQ ID NOS: 1 to 12,603, wherein the human RNA sequence is (a) obtainable by mapping of highly conserved regions from the mouse to human genome, or by mapping of syntenic positions from the mouse to human genome, e.g., mouse-to-human LiftOver analysis, or (b) is at least 90% identical over at least 15 bases (or at least 20, 21, 25, 30, or 100 bases) to the mouse RNA sequence, in an amount effective for modulating expression of a gene targeted by the RNA.

16B. The method of embodiment 15B wherein the human RNA sequence is any one of the human RNAs of Tables 1-7, e.g. set forth in SEQ ID NOS: 12,604 to 21,582 or 191,089 to 193,049.

17B. A sterile composition comprising an inhibitory nucleic acid that specifically binds, or is complementary to, a human RNA sequence of any of the human Peaks, e.g. set forth in SEQ ID NOS: 124,437 to 190,716, or 190,934 to 191,086, or 191,087, or a mouse RNA sequence of any of the mouse Peaks, e.g. set forth in SEQ ID NOS: 21,583 to 124, 436, or 190,717 to 190,933, or 191,088, and that is capable of modulating expression of a gene targeted by the RNA.

18B. An inhibitory nucleic acid for use in the treatment of disease, wherein said inhibitory nucleic acid specifically binds, or is complementary to, a human RNA sequence of any of the human Peaks, e.g. set forth in SEQ ID NOS: 124,437 to 190,716, or 190,934 to 191,086, or 191,087, or a mouse RNA sequence of any of the mouse Peaks, e.g. set forth in SEQ ID NOS: 21,583 to 124,436, or 190,717 to 190,933, or 191,088, and wherein the treatment involves modulating expression of a gene targeted by the RNA.

19B. A method of modulating expression of a gene comprising administering to a mammal an inhibitory nucleic acid that specifically binds, or is complementary to, a mouse RNA sequence of any of the human Peaks, e.g. set forth in SEQ ID NOS: 124,437 to 190,716, or 190,934 to 191,086, or 191,087, or a mouse RNA sequence of any of the mouse Peaks, e.g. set forth in SEQ ID NOS: 21,583 to 124,436, or 190,717 to 190,933, or 191,088, in an amount effective for modulating expression of a gene targeted by the RNA.

20B. An inhibitory nucleic acid of about 5 to 50 bases in length that specifically binds, or is complementary to, a fragment of any of the RNA of SEQ ID NOS: 1 to 21,582 or 191,089 to 193,049, said fragment about 2000, 1750, 1500, 1250, 1000, 750, 500, 400, 300, 200, or about 100 bases in length (or any range in between any of these numbers), wherein the fragment of RNA overlaps with and comprises a stretch of at least five (5), 10, 15, 20, 25, 30, 35, 40, 45, or 50 consecutive bases within any of the human Peaks, e.g. set forth in SEQ ID NOS: 124,437 to 190,716, or 190,934 to 191,086, or 191,087, or of any of the mouse Peaks, e.g. set forth in SEQ ID NOS: 21,583 to 124,436, or 190,717 to 190,933, or 191,088, optionally for use in the treatment of disease, wherein the treatment involves modulating expression of a gene targeted by the RNA.

21B. A method of modulating expression of a gene comprising administering to a mammal an inhibitory nucleic acid of embodiment 20B in an amount effective for modulating expression of a gene targeted by the RNA.

22B. The inhibitory nucleic acid, process, composition or method of any of the preceding embodiments wherein the modulating is upregulating gene expression, optionally wherein the gene targeted by the RNA is selected from the group of genes set forth in Table 8, and wherein the RNA sequences are selected from the SEQ ID NOs of the RNAs that target the gene as shown in Table 8.

23B. A sterile composition comprising an inhibitory nucleic acid that specifically binds, or is complementary to a mouse RNA sequence of any one of the mouse RNAs of Tables 1, 2, 6 or 7, e.g. as set forth in SEQ ID NOS: 1 to 9,836 or 12,053 to 12,603.

24B. A sterile composition comprising an inhibitory nucleic acid that specifically binds, or is complementary to, a human RNA sequence corresponding to a mouse RNA sequence of any one of the mouse RNAs of Tables 1, 2, 6 or 7, e.g. as set forth in SEQ ID NOS: 1 to 9,836, or 12,053 to 12,603.

25B. The sterile composition of embodiment 24B wherein (a) the human RNA sequence is obtainable by mapping of highly conserved regions from the mouse to human genome, or by mapping of syntenic positions from the mouse to human genome, e.g., mouse-to-human LiftOver analysis, or (b) the human RNA sequence is at least 90% identical over at least 15 bases (or at least 20, 21, 25, 30, or 100 bases) to the mouse RNA sequence.

26B. The sterile composition of embodiment 24B wherein the human RNA sequence is any one of the human RNAs of Tables 1, 2, 6 or 7, e.g. as set forth in SEQ ID NOS: 12,604 to 19,236, or 21,195 to 21,582, or 191,089 to 192,885, or 192, 980 to 193,049.

27B. The sterile composition of any of the preceding embodiments which is for parenteral administration.

28B. The sterile composition of any of the preceding embodiments wherein the inhibitory nucleic acid is capable of upregulating expression of a gene targeted by the RNA.

29B. A composition for use in a method of increasing expression of a tumor suppressor, for use in a method of inhibiting or suppressing tumor growth, or for use in a method of treating cancer, the composition comprising an inhibitory nucleic acid that specifically binds, or is complementary to, a mouse RNA sequence of any one of the mouse RNAs of Tables 1 or 7, e.g. as set forth in SEQ ID NOS: 1 to 49, or 12,268 to 12,603, for use in a method of increasing expression of a tumor suppressor, for use in a method of inhibiting or suppressing tumor growth, or for use in a method of treating cancer.

30B. A composition for use in a method of increasing expression of a tumor suppressor, for use in a method of inhibiting or suppressing tumor growth, or for use in a method of treating cancer, the composition comprising an inhibitory nucleic acid that specifically binds, or is complementary to, a human RNA sequence orthologous to a mouse RNA sequence of any one of the mouse RNAs of Tables 1 or 7, e.g. as set forth in SEQ ID NOS: 1 to 49, or 12,268 to 12,603.

31B. A method of increasing expression of a tumor suppressor in a mammal in need thereof comprising administering to said mammal an inhibitory nucleic acid that specifically binds, or is complementary to a mouse RNA sequence of any one of the mouse RNAs of Tables 1 or 7, e.g. as set forth in SEQ ID NOS: 1 to 49, or 12,268 to 12,603, in an amount effective to increase expression of the tumor suppressor.

32B. A method of increasing expression of a tumor suppressor in a mammal in need thereof comprising administering to said mammal an inhibitory nucleic acid that specifically binds, or is complementary to a human RNA sequence corresponding to a mouse RNA sequence of any one of the mouse RNAs of Tables 1 or 7, e.g. as set forth in SEQ ID NOS: 1 to 49, or 12,268 to 12,603, in an amount effective to increase expression of the tumor suppressor.

33B. A method of inhibiting or suppressing tumor growth in a mammal in need thereof comprising administering to said mammal an inhibitory nucleic acid that specifically binds, or is complementary to a mouse RNA sequence of any one of the mouse RNAs of Tables 1 or 7, e.g. as set forth in SEQ ID NOS: 1 to 49, or 12,268 to 12,603, in an amount effective to suppress or inhibit tumor growth.

34B. A method of inhibiting or suppressing tumor growth in a mammal in need thereof comprising administering to said mammal an inhibitory nucleic acid that specifically binds, or is complementary to a human RNA sequence corresponding to a mouse RNA sequence of any one of the mouse RNAs of Tables 1 or 7, e.g. as set forth in SEQ ID NOS: 1 to 49, or 12,268 to 12,603, in an amount effective to suppress or inhibit tumor growth.

35B. A method of treating a mammal with cancer comprising administering to said mammal an inhibitory nucleic acid that specifically binds, or is complementary to a mouse RNA sequence of any one of the mouse RNAs of Tables 1 or 7, e.g. as set forth in SEQ ID NOS: 1 to 49, or 12,268 to 12,603, in a therapeutically effective amount.

36B. A method of treating a mammal with cancer comprising administering to said mammal an inhibitory nucleic acid that specifically binds, or is complementary to a human RNA sequence corresponding to a mouse RNA sequence of any one of the mouse RNAs of Tables 1 or 7, e.g. as set forth in SEQ ID NOS: 1 to 49, or 12,268 to 12,603, in a therapeutically effective amount.

37B. The composition or method of any of embodiments 29B-36B wherein (a) the human RNA sequence is obtainable by mapping of highly conserved regions from the mouse to human genome, or by mapping of syntenic positions from the mouse to human genome, e.g., mouse-to-human LiftOver analysis, or (b) the human RNA sequence is at least 90% identical over at least 15 bases (or at least 20, 21, 25, 30, or 100 bases) to the mouse RNA sequence.

38B. The composition or method of any of embodiments 29B-36B wherein the human RNA sequence is any one of the human RNAs of Tables 1 or 7, e.g. as set forth in SEQ ID NOS: 12,604 to 12,632, or 21,338 to 21,582, or 192,874 to 192,885 or 193,007 to 193,049.

39B. A method of enhancing differentiation of a stem cell, optionally an embryonic stem cell, and optionally an iPS cell, the method comprising contacting the cell with an inhibitory nucleic acid that specifically binds, or is complementary to, a mouse RNA sequence of any one of the mouse RNAs of Table 3, e.g. as set forth in SEQ ID NOS: 9,837 to 10,960.

40B. A method of enhancing differentiation of a stem cell, optionally an embryonic stem cell, and optionally an iPS cell, the method comprising contacting the cell with an inhibitory nucleic acid that specifically binds, or is complementary to, a human RNA sequence corresponding to a mouse RNA sequence of any one of the mouse RNAs of Table 3, e.g. as set forth in SEQ ID NOS: 9,837 to 10,960.

41B. The method of embodiment 40B wherein (a) the human RNA sequence is obtainable by mapping of highly conserved regions from the mouse to human genome, or by mapping of syntenic positions from the mouse to human genome, e.g., mouse-to-human LiftOver analysis, or (b) the human RNA sequence is at least 90% identical over at least 15 bases (or at least 20, 21, 25, 30, or 100 bases) to the mouse RNA sequence.

42B. The method of embodiment 40B wherein the corresponding human RNA sequence is any one of the human RNAs of Table 3, e.g. as set forth in SEQ ID NOS: 19,237 to 20,324, or 192,886 to 192,906.

43B. The method of any of embodiments 39B-42B carried out ex vivo, optionally to differentiate the stem cell into a particular cell type, optionally nerve, neuron, dopaminergic neuron, muscle, skin, heart, kidney, liver, lung, neuroendocrine, retinal, retinal pigment epithelium, pancreatic alpha or beta cells, hematopoietic, chondrocyte, bone cells, blood cells T-cells, B-cells, macrophages, erythrocytes, or platelets.

44B. The inhibitory nucleic acid, process, composition or method of any of the preceding embodiments wherein the inhibitory nucleic acid is 5 to 40 bases in length (optionally 12-30, 12-28, or 12-25 bases in length).

45B. The inhibitory nucleic acid, process, composition or method of any of the preceding embodiments wherein the inhibitory nucleic acid is 10 to 50 bases in length.

46B. The inhibitory nucleic acid, process, composition or method of any of the preceding embodiments wherein the inhibitory nucleic acid comprises a sequence of bases at least 80% or 90% complementary to (including fully complementary to), e.g., at least 5-30, 10-30, 15-30, 20-30, 25-30 or 5-40, 10-40, 15-40, 20-40, 25-40, or 30-40 bases of the RNA sequence. It is understood that complementarity is determined over a contiguous stretch of bases, e.g. 5-30 contiguous bases.

47B. The inhibitory nucleic acid, process, composition or method of any of the preceding embodiments wherein the inhibitory nucleic acid comprises a sequence of bases at least 90% complementary to at least 10 bases of the RNA sequence.

48B. The inhibitory nucleic acid, process, composition or method of any of the preceding embodiments wherein the inhibitory nucleic acid comprises a sequence of bases with up to 3 mismatches (e.g., up to 1, or up to 2 mismatches) in complementary base pairing over 10, 15, 20, 25 or 30 bases of the RNA sequence.

49B. The inhibitory nucleic acid, process, composition or method of any of the preceding embodiments wherein the inhibitory nucleic acid comprises a sequence of bases at least 80% complementary to at least 10 bases of the RNA sequence.

50B. The inhibitory nucleic acid, process, composition or method of any of the preceding embodiments wherein the inhibitory nucleic acid comprises a sequence of bases with up to 3 mismatches over 15 bases of the RNA sequence.

51B. The inhibitory nucleic acid, process, composition or method of any of the preceding embodiments wherein the inhibitory nucleic acid is single stranded.

52B. The inhibitory nucleic acid, process, composition or method of any of the preceding embodiments wherein the inhibitory nucleic acid is double stranded.

53B. The inhibitory nucleic acid, process, composition or method of any of the preceding embodiments wherein the inhibitory nucleic acid comprises one or more modifications comprising: a modified sugar moiety, a modified internucleoside linkage, a modified nucleotide and/or combinations thereof.

54B. The inhibitory nucleic acid, process, composition or method of any of the preceding embodiments wherein the inhibitory nucleic acid is an antisense oligonucleotide, LNA molecule, PNA molecule, ribozyme or siRNA.

55B. The inhibitory nucleic acid, process, composition or method of any of the preceding embodiments wherein the inhibitory nucleic acid is double stranded and comprises an overhang (optionally 2-6 bases in length) at one or both termini.

56B. The inhibitory nucleic acid, process, composition or method of any of the preceding embodiments wherein the inhibitory nucleic acid is selected from the group consisting of antisense oligonucleotides, ribozymes, external guide sequence (EGS) oligonucleotides, siRNA compounds, micro RNAs (miRNAs); small, temporal RNAs (stRNA), and single- or double-stranded RNA interference (RNAi) compounds.

57B. The inhibitory nucleic acid, process, composition or method of embodiment 56B wherein the RNAi compound is selected from the group consisting of short interfering RNA (siRNA); or a short, hairpin RNA (shRNA); small RNA-induced gene activation (RNAa); and small activating RNAs (saRNAs).

58B. The inhibitory nucleic acid, process, composition or method of embodiment 54B or 56B wherein the antisense oligonucleotide is selected from the group consisting of antisense RNAs, antisense DNAs, chimeric antisense oligonucleotides, and antisense oligonucleotides.

59B. The inhibitory nucleic acid, process, composition or method of embodiment 53B wherein the modified internucleoside linkage comprises at least one of: alkylphosphonate, phosphorothioate, phosphorodithioate, alkylphosphonothioate, phosphoramidate, carbamate, carbonate, phosphate triester, acetamidate, carboxymethyl ester, or combinations thereof.

60B. The inhibitory nucleic acid, process, composition or method of embodiment 53B wherein the modified sugar moiety comprises a 2'-O-methoxyethyl modified sugar moiety, a 2'-methoxy modified sugar moiety, a 2'-O-alkyl modified sugar moiety, or a bicyclic sugar moiety.

61B. The inhibitory nucleic acid, process, composition or method of embodiment 53B comprising a 2'-OMe, 2'-F, LNA, PNA, FANA, ENA or morpholino modification.

62B. A sterile composition comprising an isolated nucleic acid that is a mouse RNA sequence of any one of the mouse RNAs of Tables 1-7, e.g. as set forth in SEQ ID NOS: 1 to 12,603, or a fragment thereof at least 20 bases in length that retains PRC2-binding activity.

63B. A sterile composition comprising an isolated nucleic acid that is a human RNA sequence of any one of the human RNAs of Tables 1-7, e.g. as set forth in SEQ ID NOS: 12,604 to 21,582 or 191,089 to 193,049, or a fragment thereof at least 20 bases in length that retains PRC2-binding activity.

64B. An RNA for use in a method of decreasing expression of an oncogene, comprising a mouse RNA sequence of any one of the mouse RNAs of Table 6, e.g. as set forth in SEQ ID NOS: 12,053 to 12,267 or a corresponding human RNA sequence optionally having a nucleobase sequence of any one of SEQ ID NOS: 21,195 to 21,337, or 192,980 to 193,006 or a fragment thereof at least 20 bases in length that retains PRC2-binding activity.

65B. A method of decreasing expression of an oncogene in a cell, the method comprising contacting the cell with a mouse RNA sequence of any one of the mouse RNAs of Table 6, e.g. as set forth in SEQ ID NOS: 12,053 to 12,267 or a corresponding human RNA sequence optionally having a nucleobase sequence of any one of SEQ ID NOS: 21,195 to 21,337, or 192,980 to 193,006 (see Table 6), or a fragment thereof at least 20 bases in length that retains PRC2-binding activity.

66B. An RNA for use in a method of enhancing pluripotency of a stem cell, optionally an embryonic stem cell, and optionally an iPS cell, comprising a mouse RNA sequence of any one of the mouse RNAs of Table 3, e.g. as set forth in SEQ ID NOS: 9,837 to 10,960 or a corresponding human RNA sequence optionally having a nucleobase sequence of any one of SEQ ID NOS: 19,237 to 20,324 or 192,886 to 192,906 (see Table 3), or a fragment thereof at least 20 bases in length that retains PRC2-binding activity.

67B. A method of enhancing pluripotency of a stem cell, optionally an embryonic stem cell, and optionally an iPS cell, the method comprising contacting the cell with a mouse RNA sequence of any one of the mouse RNAs of Table 3, e.g. as set forth in SEQ ID NOS: 9,837 to 10,960 or a corresponding human RNA sequence optionally having a nucleobase sequence of any one of SEQ ID NOS: 19,237 to 20,324 or 192,886 to 192,906 (see Table 3), or a fragment thereof at least 20 bases in length that retains PRC2-binding activity.

68B. A LNA molecule that is complementary to and binds specifically to an lncRNA that binds to a chromatin modifier.

69B. The LNA molecule of embodiment 68B, wherein the chromatin modifier is Polycomb repressive complex 2.

70B. A method of decreasing binding of a long noncoding RNA (lncRNA) to its cognate binding sequence, e.g. PRC2 or a chromosome, the method comprising contacting the lncRNA with a locked nucleic acid (LNA) molecule that is complementary to and binds specifically to the lncRNA.

71B. A LNA molecule that is complementary to and binds specifically to an lncRNA that is a large intergenic non-coding RNA (lincRNA), a promoter associated short RNA (PASR), an endogenous antisense RNA, or an RNA that binds a chromatin modifier, e.g., a Polycomb complex, e.g., Polycomb repressive complex 2.

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

Lengthy table referenced here

US09328346-20160503-T00001

Please refer to the end of the specification for access instructions.

Lengthy table referenced here

US09328346-20160503-T00002

Please refer to the end of the specification for access instructions.

Lengthy table referenced here

US09328346-20160503-T00003

Please refer to the end of the specification for access instructions.

Lengthy table referenced here

US09328346-20160503-T00004

Please refer to the end of the specification for access instructions.

Lengthy table referenced here

US09328346-20160503-T00005

Please refer to the end of the specification for access instructions.

Lengthy table referenced here

US09328346-20160503-T00006

Please refer to the end of the specification for access instructions.

Lengthy table referenced here

US09328346-20160503-T00007

Please refer to the end of the specification for access instructions.

Lengthy table referenced here

US09328346-20160503-T00008

Please refer to the end of the specification for access instructions.

Lengthy table referenced here

US09328346-20160503-T00009

Please refer to the end of the specification for access instructions.

LENGTHY TABLES

The patent contains a lengthy table section. A copy of the table is available in electronic form from the USPTO web site (http://seqdata.uspto.gov/?pageRequest=docDetail&DocID=US09328346B2). An electronic copy of the table will also be available from the USPTO upon request and payment of the fee set forth in 37 CFR 1.19(b)(3).

SEQUENCE LISTING (194345 sequences)

SEQ ID NO: 1 - RNA, 34200 nt, Mus musculus
cacuuggccccagcuccuacuccucaucugucccugucuccggguuauucguuguucucauggcuccucuucucagaccgggcauuguucagucccuaauucugaccauaucuagucauagcgaaugcauccuccaagcccccucccuccacccugcugccaacugagcaaccauuuggccugugacauuuaaagccacacaggagccaaugcucgcaguugucgggcuacugcugccuuccuuggcuccacaugccuggcccccagcacacuugcuuguugacugacagcucaggccagucaaaccccuuuccagucaggcuuucuuaauuuggcuccuucaccucacggauggcccacacaagcccauuccugccccuauaaggagaagccaggcaggggacugggggcguuuugagcggcaggacaagguguaggccaucugugugccugugauaugggagcacaugccuagagcauggugugauguccgccacagcuguccucuucuccuuggcuuccaaccccaguagaccccauggcccugcuauuaauauaauacaaagaggccuagcaacuggcuaggacaaaaucuuuccacacagauagcgacaacugucauuagguggacuccaaguguccccaccacacauucuucccaaaagggcagagcuggaugugccuggugccugcuacugaacauacauugacuuggccuuggaaaaaacagagacugccaaagaccaaucuggaggcuguccaagggguagcuacagggagcucuuaaggcuuuuaucugcacuugaggcccaaggcaguucccauccugggagauggcaccucacaaggaacauggggcggcugcucaaaugcucccuacuuucucucuaggggacagagaagguggguucugcuuuuuuuuuuuuuuuuuuccgagacaggguuucucugugcagcccuggcuguccuggaacucacucuguagaccaggcuggccucgaacucagaaauccaccugccucugccucccaagugcugggauuaaaggugugcgccaccgccgccuggcugaggguggcuucuacuuauccaaagaaccaaaagaccauuaacuggaggauaaggaaagucacuguugucccagacuaccaagggagcuucgugcuuucuauaccuugaaaggcuccaggggagaugcacagccaucaccugggcuugcuagccucaccuguacuugguauacuuaaaaaccgccuuaauaggcguaagaauguguacaugaaaauaggauucuggaaauauuuugaaagacucauguaaaggcucuggcuggaagcagggccuuuccuggcccaaggaaucuaggaagcagcucccugaagccaaaggccacaggucaagcauuuuaugauaaaggcugcuuccucugcaaaguaaacguguccaaagaugguaaaugucacagccaagucccucaagacaaugucuucuuccauguauuauuaggaggcaaaugucaaggaaagaaaauaggcccaagccauuuauccugguugcaauucaacuuauuagaacuagaauccgucuccucuuccccagagcguuaacauccccgcugggcgucaggaggcggcuggcagggggacaggaucgaugucugcucugcuguugagaacuugagcuccauuuccaaaacccacaacuguccugugaccucuguacaugugugcccccacccccacuaccaccacgcauaagucaauuaaaaaaaaaucagucuggguaugguggcauaaaucuuuaauccagcacuggguagguagaggagggcagaucucugaguucaaggccagccuggucuacaaagugagcaugugauagccggggcuacagagugaaacccugucuaggagaaagcaaagggguuauggaacaggcagcuuacucuguuaaaugcacugagagcaauacgacaauagucgucuguaaugaccaccacuacucuacuuacacugugacuaacucaacaaugccaggggagaggcagcagguggggcuggggacaaggaccuugacuucuaaacuugagcgcauucuuuaaauuguggccauuccuagcuucaaaugucuagauccaggauuagaagagggggggucucuuuugggcuuuggugcuauuaaaggaggggugagugccugugauccgagugagcucuuuaggagucaccaccaagguuggcaaauggccuuguacaaguccggucaccccccagacuaaagaaaaugaacccacaaccuagagcuccccguuccuucccuagaccccaccacuacccacuccuccaaguccuuccucacuuuccauucacagcaaagcucagaaauacuguuugcugacauuaaccuaccucucugaugggcaaagagugauuaagccaaggucacgcccuagccccacaagcaaggaaaacaaucccagcccucucccacgcagagacucugagcacaaagugacuuaagccuuagcucuaugugguuuuugugaaguuauuagauaguacauaucauuuagacaaccacauauacccaguggagcuucuagucugccauggguucauggagcagacaucuugagacacagcaggcucgccuuuuuguaccuccacugucuggugcgagguuuaaguaaucaugggagcuuuaggagauggauagacuuuugaauaaccagcagaaaaaguacaccaccgaacuacaucagcuuuugccuuggccaaguccuucuggccuuguguagacuuggccaggcuugacuacuggggcauaguauaguucuauuucuagccuccaaggcacuucuaaguuccugccuuuucaaaaaggagccaguggaaugucagcacugaagugaucaagaaaagaauguggaacugucaaguguccauuugguuguagaaagaaauagaucugaugucaagagggcuggcaucugagugcugggccacucuuccuguggugcauuaaaaucugagagagaguucagacuaugcaaacugagcucacgugcuggcuuuccuagacucuaagacccucccucccuucccucucccagccuguguccuuacuuguaaacugaggguggcuaaggcugggucucucuggucucuucuaguucuagaacuugcaagaccaacaagccagaaguaauguggagcacgcaaagguggguuccuuggcaccggcuuuccuacuucucuccaucaagggccagacugaaacucugcagcaucugaugccuuuuccuguggggcccaagacuacuucgaaccccacagguuagugcagaaggaugcucagcaugugggaacuuggagugcuaucacacaaccagcuguguucccuauuucucucacucaaugaaggauacacagauccaucccaacauggguguugggauguuguccucaagcuuuguggcuggcuucugcauuagucacugaagcucucuuaccaccucccaucucauauauuucuguagucaccaccaacucugguuuucccauuuaucucuuaaaccugguaccagauaagagcuuugaaacaaacuugauuaggcaccuccuggucccaggguaagggcuuccuaccacucaacaacacucccagacucaucccgcugucccacaauccugcugacugccuguaccaccccugccaccacaggaucagccuucagccucagcucaagugcacaggacacauucccaggaaggcaucuccugguauauccaaguaucgguuagcucccugugcugugugcccuagaaauaaaccacugcuccuuuggaggcucuguagcaccuuggcaugcauaagccacucugcagcaugaugccccgacaagaagaguagggaggcaggcucuacaacagacgaccaccauccaaccucacucuggguucucucuauuccauggccuaucuugucucaaaaacaagcaaacccacugaaaggaaauuagaguuguauuucacacagacacaaugcagcuuggcugggucugaccguuggggcucuuucuacccaagaugauuaaguccccuucccuucccaccaccucggccaugggcuuaacaccuuuauaggcauuaccgcccccguucccagcaucaaugcuaacaccaaccaccuaacacgcagaaagcagugacuggagagaaaaagcucuuuaaaaagcaagucaaacaagacugcuccucucuuguguaauuucagaaaacacagugagucauaaauuaagggugaaguaauuagaaaaaacucagaagaauaaaagcagaagccuaacuagauggcauccaacugacuagagcagccgcucucaaccuuaacuuugcaacccuuuuacacaguuccucaugcugugcuuauccaagucauaacauuauuuucauugcuccuuuauaacuaucacucugcuguuaugaaucauaauguaaauaucuacauucuuuccgauggucuugugugacccuaaaagggcccuuugacccuaacaggaucgcauacaauccacaaguugacaaccgacugcuggaugagaacaaaccagaagaaugacaugaaaacaauuuuacaguaaaagacgcucaggccuaccaaaggcugaacucuacccaagagcacacugagcugagagguccuacccugagauuuuaugaugauaaaauuucaaaagaaaucuaugguguuaagcaaaacaaaaauuaccuaaaaaaaaaaaaaaaaaaagccuauugcaagggcugauuuguuuuguuuuggaagcaacucgaagagaccauuucucuggucuccuugggucuguugcuggagcacaugaugugucagguuugugacuguccuguccugugcugacaguguugguucucaggguuuccccugggcuaaggucuucuguguggaaccaugucaucugcuaagaaugcuuccacuuccuccucuccaugagccaugcuugugcuugcuucucugcucucguugcucuuggccuagaccauaauggagguucugauuuguccccacguaguagaaugcuggcugcagaucugucaucuauggccuuuguuacacuacacacagcugcuucuggcugguucaaggaguuuauuacaaagggauguugagaguuuaugaaauggccuugggaguucauuucugugaugucacacacuuaaaauacucugugcaugucuuuaauuaccccuacuucccugaagugaagucuaugaaauugugauaucuuuuuuuuuaaaauaugguuuuaaaguuuuaaaaguauacuuggguauuacauguggggugugccugugccauggcucauggaggaaggaccacagaacaaguuguaggauucagcucuccccuuccaguauacauggguggguggcuaggucuucaggcuuggcagcaggcuuacccacuaagccaucccacuggccccucugaguauuuuguuaggcauuuuuauuccuguguaaaauuggucuauaauuuguguguguuccuguggccaacuugguaugugaagaauacugguuucuuaaaagggagcuugguaauguuccugccuacccuguuccauggaggaaugcgguaaguccuggugcuugguucuuguguuaggucuggucauaugcacagugaaucuaucuaagccuaauuguuucugagucaggagauuauuauuaccgcaccaacaucaccacucgcuauagauuuguuuaaauuauuuaccucaucuggguuugacguuggucagucacaugcaauacaaauucaaaauuuuguauucaaaaagaaaauuucaaaccacuuucuuuguauuuccuaguuuaguggacucuauuugcuuccggaauuauguguuugccgccuuugucacuucugcugucacaggaugcacacaauuagauguaaugucaccuuccuggcuaauuacuagccugcucuuuauccuuuucuuuggguuaguuugguuaaaagccaaucuuacucaucuuuggguuaauuugguuaaaagccugccaaucuuacucaucuuuucaacgauccagcucuuucuuccauugauucuuuguuuuuuuuuuuuuccccucgauguuggcuucugcccugagacaccugucugcagguuacucagcuugguucaacuguucgucuucagugagcuguuuguucagaauuucguggggcuuuaaaaaacauuuugugugucuguacacacacauacacaccuaccgauggaaaucauaggacaacuugaggaaggucagucagcucuuuugaccacauggguccuggagacugaauuagucugaugccugccgaccuuuuccuuaaggaagcacucagaucuauaaaugcucuggaaaccucuucauuaugagccagugacuauguuuguuguauuuauuuccacuugcuucuugggguuucuugauuuccucuuuugccccucacucaccugucuaucacaagaaauucauucauuuuccuauauuuguuaaggcuugucuugugucuuaauaucagcucucuuuuaaauuauuuggggaguaguagaauucaguuugauuaaaaacaaaauuucccacuuaauuuaaaauaucuaaaaacuuaccauauaaaacuucuaauaaucaucuucuguccuucuagaaaacaaaauaggauaaaaaccuaaaagguaggaaagaggcuuagguagccucaguaaagguuagucccucccuaaauuagucuuggcacgaaaacucaaagcccugucuaugugucucucuuccuaccagcagugcugggcauucagugguggaggagcugagcacuccgcacucccuccaggagucagcagagcaugcacuggagagcuagcuacuggaagccucauccaccagacaauucuagauguagcagaauaugagggaaguguacaaaaaccaauaucaucccauaaacacauuauaaacagccuaaaaacccaaugaaaaauauacccauucacaaagcaacacaaguaucaaaugccugagaaaccuaugugugccauuucuucaagcaucaaaugccacauuuuauauucaaauuguauaaagaaaauacaaacucuuaaugugggaaagacuugaauacauagagacuagacuucaggcuuaagacuaaaugcagacgagaucacggugcuuccucauuuaauuuauugacugaaugcaguuccaggcaaaauaccaccaaggccauuacagaacuugauaaaaaugguuuuuaaauuuguauagaaaaauaaaugggcaaaaagcucagagagcgaggacgcagugugcaggaggaagccacaggcucuguccagcaggucuuaaaacaacgaaggacaggcuguaaagcaacugagggacacaccgggaagacaguacaaucuaacaaacucaccgggaauagacaagaucacaguaagaaagugcagaccacaggaugagucaacccuuggagacaaaaaucuccuucaaaacccacuuagcccaggauagacgcaagauucaugcuccuccuacccccgcuuucuuuuucauaagagagacaucagaaaaugucaaggggacaagauggcuauuuucugacucugaagggaaagcagccuuuccuauuuaccuuucccaaguccauuucaaguccuccauuccuaaagcacuuacagucaaaggcagcagauuaagacacaguguucucuaauugugcuguugugcgagggagggacgcugugcccacacauauucugccugcucugucacaccuuucggugggcacccaaacuaccacagggccuucccaugcgacuguggcucccagagaaggaagccacgggagacuacaggacuuuacguuuucauccugcuccaccaugcaaggguucuucccucacaggugguggaugggucaggaggguagccauugccaguaugagaaaaagcucacaauuaaugaaggguuuaauaaucacaacagggaggacugggacuguugccuucauuucuggaccuaagaugacacuccagucauaagcuucauuguguaccaugcaaagucgucauaaguuccauuaggaaucaugucauccuaacacuguacgucaguaaacuggcucaggaucucagggugguguccagagaaagguaaacacagcauggcagaggcugguuaaaggagccugggacagaucacacagccauaugcacaccugagcugagcccacagggguggggcucagcccaacuccugcauagggugggcugggcugggagguccagcagacagccuuugaaaacaaagccaagugagaaacgaacacaugccucagaauccucuuuaccucaaagcaaagcaaagcucugugcaugaggccgauguugcccaguuaucaggacaggcugauuacagagccuagacucauuugccugaagauaauugccucaauucuccacuucacuuugcacauauagaaagagucccaaucuacugcggccucagugacuagacauguaaaauuggucuaaucaucguuugaagagcucaagcugaaaggauucuaugagcccgagccugaaccacgacaccacuaagggcuucuuuccucuggcucgaggcucgcccacucccuggcucccucccccaggucugaagggugacucagaaccucaggcaaaggaggcucucuguccaugguggcuggaggggggagugaguugcucagaaaaguugaacaaaagccuagcuaggaguaaugccuuuuggguagcaaguccagaguagccaacaguguuucugccccaagacgccauucuagguagaagcugaggcagacgauauccaagaucagaagcaccuggacucaucuuacacacuggugucuggcugggaagcaggcagagcccauuucugaccucuacaguacaaaacaaucaucagagcccagaaaggccaagcucuagggccaaacaaaacccaacaaggacacacacacacuuuucagcgggccugugcagcaagcucugugagggaaggaccucccaaguguagacauuacucacuccacagagagggacagacagauucuguugguucuguguugaucugcauacaguggagggcaggaaaggugggucuauggguucagcucugaccccaucuuacuccugacaggaacaacacagauaaacccaaugauggucagggcagaacccagacacauccuauagauaccccccccccccuuuuuggcuuuagcuggccuuucccccuaaauuacaaaaucaggaguuuggaguuuucaucauuucuaacaguuagucaacuaagaucaguguggucugaguacagcaaagcagcaccuggagagacagaccacauguccccaugcugccucgucaacuugcggcacaggagggaaggggcccaugccaaauucucaguugguugagcauuucuggcugacugccacagggagagguggggaauacuucaaagucccucaauucauuucucuccaaaggaaaguuuagaaagcucuccauuuccaaaaaccauguuccccuccagugacugucuaaaagccacguucgagagugcuugugccugcuggccaggcagagcagagcccagccucuauuguaggucugguaccuguagcucugugacgauagccugcaagcccccagacucaugugacacacugguucccaguauguugcucugcacaucaaacagguagaauaggggcaauccucucaguuugaaaaauaaaagccaaacagacgaacuggaagaacuuuaccuguggucucacaugguccacgucgcuggccagcagcugcugcucauccucauugacuuccaucucuccacaaugcuaggaacagcgcuaggucauaaaagugacucaauucaugaccacuaaauagccaauuuuauuuuguaauuuccaagacagcuccaggaggggaggcccagaggccaauguaaugaauagauggcccugacugacaccuuggcuccaggagugagaacgaaacugaggcagagugggaggcuugaaacccccacccccaccccaagcccucuccuacagcccugggggagcaacuacagagggccguggucaaaccuugucuuagcucuagcaguuucacaagcuccauggaaaccucuaucuaacauguagucaucuguccuuugacuuagcauagcuccugccgacgccgaguccauucuccuucagaguccuacuugcuagaauauuccuccuugggcugaagccuaccuguacacagcacccaucuaggcccucauuuugcccccuggagcuaugucaaauaacuagugaagccauuuccacaggacaguccucuaagcucaaaagaaucuucuucccaauacauccaaauaagaacccuucuauaugauacuguaagcaacuggaaacugccuuccugcccaacuggucuagaagccuccuuccugaaagucuaaagguaauauaugaccacacuuuauuuaccugcaaacacagagaaccccuuguaccccagcugguaacaacugaggucguucaucaccuacuuggccccuuuugaaauucacucugcagcaagcacuuuuuaaaguccugcacauaaugcauuuuaaagagcauuuucugugcagauccauuugcucaaccucggcacuaagugcaagauggagcugucuuuuggugcagcccugcuccuccuggaguccgugcugagcacgugcugaaaugaauuuguaacuguacagaugaccggggcucggaagcguaugcuuuguuaacuguccauagcugauucaaacgcaucuugcaagaaagagcagugcuaaugcagaacccugguccaagauauguauuauguaaugcauaguuuuuaauaaugugggcaguccugguguuucuguacuagugcauaggaugugggcugccaucucuaucacgggcauaaagcuuuccccugaaaaaugaggcacuuucccacacacacuaaaaaccaucauccaccucacugcugacagcuggcaucaguuuccaucaaacgggcauuuaccagcacccacaguccuguuuuccucucucugugugcccuaaaauuggcuagaccaaugucuuugugcuccauaugauguuggcagaacuguuuuaacugaaaaaaaaaaaaaauaagguuaaguguauggaagcggucggaccccucagauacccccauucaucaggguggaaaggcagagauaaggaucugagaucucaaccccaaacaggggcucaagagucacagcaaugcacuaagagucagcagaacaucuagauuacagccacacauuuguucaugagaucugcugauccaaccccacucuaucucaccagcauuuaaggcuguacaugaacuccuagaccacaagaugcagcaccaacagucaagacagagagauucuauaaucuccaaccaugcagggcaccuaggaccuaagucugugacacugcaucugggagccugacucugaggugcaagugugugaggguaaguaagugaccuaggaccagcaccugcuucaagacauaacucacaauuccaccuccaggaaggaacccugggggagcagcuuggagaggcagcaguaccucuugugacucuucacauggacucaagggaaaaacaaaaaaccaaacagcccaccgugugacauguguuccauguaaaaaacaaaucaaaaaaaccucaaaaccaaaaacccaacaacuaaaacacccugccaagacuucaugcaucccuauaacacaacucugcuaguguuaugcuuuuuuuuuuuuaagguacucuauauuuaacaaggcaaaaggcaagauaaacgagccccacacccacuucccacagggcuccauccccuccuggaccuaccugaguccaucggcucuuccaagcgcgcucuggaacaagcaggucguuuuaccuuguucuuccgaguccaacagcaggauccaguggucucuggccgcccccuagccaugaugcucuugcugacguaccuguuuuucucauguagcgugagcuagaugaaguaaugaugcuggaagaaugagcugaugcucugguuaagauauauuaaccccucaagaccccuuucucuaauccaagaccugcuccuguuccucgcuaucuucagcaccuagaacagagcuccgcgagugccgggaacucaaguguguugguugaacccucagcugaaaugcaugaguccguggcucaaagacuacccuaaaaacccacacggagagcagcaguugaagggcauucucguggauacucacucucagcuuccuauggucuuccagcacaccucaguggaacaguguucaccaugagcugacugucggcuugcaaauuccuacaucuacagccgcggggggcgggguuguuugccagugggguucauaccuucuuggaggcugcucuaauuaauuacaguuacuuuaacagcccugacaaaaguaaccaccuuugauaagguuaguguuuacuugaggcucugauccucaagcauucacgcucuucggucauuaacacucauucacguacggauccucauuccccugaauauuuacaauuuugcguucugguuuucaauuguuugguggcuaugcucauggagaaaaaguugaggaguggggacaaccccccgugggaaucuauacuuggcuucuaaaauccgcuaaccuguagcuaucuuacucccuucgcucgcuagaccucgauauccagccccccaccccccaugcuuuggccaaaucuacucaaacaagguucccgccugccaccugccggcccacuagggucugcgccaugagcuaugcgccaacgcacagcucgcggggaggcacucccgcccccaaacaccucccuacugcacaugcccggcagaaguccgcgcaacuuuauagggccccauugccccaucucuccucagucuccucuauccucucccagacgagaggaucaguggaggcaccucucggagucuuagacuucagagucugagacuuagcgagaggagccucgaggagacuccuucucucuucuuuacccaucccuuucuuuuacuuacagccacaagcugaggcgcggagcuuuagaaaguucgcagugguuugaagguagguacaucccuucuuuuugccccgaggcgagauuggggucuucagaccccagcuucucuccucauaagguuaauccuuuucggccccaacaguccuugcgcaguggggccacucucugcagagccagagggugagucggcuucucggugagcaccuaagagaauggaucgcaggucccgggcucagcaguggcgccgagcucgccauaauuacaacgaccugugcccgcccauaggccgccgggcugccaccgcucuccucuggcucuccugcuccauugcucuccuccgcgcccuagccucuuccaacgcccgcgcccagcagcgugcugcccagcgccggagcuuccuuaacgcccaccaccgcuccgcugccgcugcagcugccgcacagguacucccugaguccucugaaucugagucugaucacgagcacgaggagguugagccugagcuggcccgccccgagugccuagaguacgaucaggacgacuacgagaccgagaccgauucugagaccgagccugaguccgauaucgaauccgagaccgaaaucgagaccgagccagagaccgagccagaaaccgagccagagaccgagccagaggacgagcgcggcccccggggugccaccuucaaccagucacucacucagcgucugcacgcucugaaguugcagagcgccgacgccuccccgagacgugcgcagcccaccacucaggagccugagagcgcaagcgagggggaggagccccagcgagggcccuuagaucaggauccucgggaccccgaggaggagccagaggagcgcaaggaggaaaacaggcagccccgccgcugcaagaccaggaggccagcccgccgucgcgaccaguccccggaguccccucccagaaaggggcccauccccauccggcgucacuaaugggugacuccguccagauucuccuuguuuucauggauaaagguuaguugcccugaccaaacuggggucccugagacaguagggugggaggaaagagacagaugggaggcaaggugggaagggagcggugcccauuaaucagcccgaaaugcaccccggaaaaggagagagggcucuucaagucucuccagggcacccaggggcgcuugggaggccaaagguuuguuggacggugaggcauuucuggcgccucgcuggagacaaccugagguccccgagcugauacccggugcgcaacauugaauucggugugccacacugaauucccagcgcgccccagguuuggaguuacauacauaaacggcaaagguaagucacuuguuuucuauguucucuccccuccuacagaaguuagucuucagcaacggaguuggcuuuagguagagcccacugggcucgauauggaggugcacgcaccaacuuuggcgaucugagacugcugcgccauagcuacaguauugcaaugcgcagaaaguaacugcguuugggauugggugacaacucuggagccuaaaucgcacguggcauucagccggcgcggagccuggaaaucggguaccggcauggccaauuuggggccgcgggacccuggagccagugccuccccccacgccgugcaaguagucuugguuaauaccgcucaccucuggagguucgaggaggccugagaucgugaaaaggggcgcgcgcaccucucccgugcguccuaaagccaaccuucccgcgcagaaaggaguuucuugauaguggauagugcuuggaggacacucaguggugguauaggguucuuuacgggugcccuucugggcuaccuggguuggcagacagcuaggaucacaucgggguaucgcgcagcugguuaggcagauccgacuuguccggagagguccgggacugugcgccuaggccauagaggcaggagagaaggaaugagagcaauaagaaguggucuugggaggaaagguaaagcgggucaaggcacaggcugaguacggaggucguggcuaucacucugacaccuucaaagguguacccaaagaucguggcacuuccuaagcugggaagaugucggauccugcgcuuuggacugagagguggcagggaggaugcgcuacagccauuuuggccaucuucagcucggguggggcuguuuuuggaaccuguaaccugugggggaggggagaucacccaccggugaucugccccagcaccaagcacguaacgcaccuuagaaugcuuuccccuccagccuugggcggaaaggcugaucuuaaguaaaacgcaccuacuguaucucacccauuuagaaacuuuuuuuuuuuuuuuaagugugcgcggcuggucuugcggcggcuugagauauuuugaugggaugauuugggaaaucugguuaagaaacgcaguuucaaagcuugaaaucaaagccggcugggcuccugagcuccuaagaggagaauggugcuagaaggaacacauuacguagucuccuuccaggaccuacccucuuuccugggauggcgucgcagcccccagaauuuaagugagggugggcugugcgcacugcggcuaauugcgacuuuggucaacagcaggaagcaguuuguuagcaguggguagagaaugagccgguagcuugcggaaaggaggcgggggcuuuuggguugaaagcgugaaauugccuaagugagacauuauuuuuccuaaguuaaaaugcucggcaacgaaaaagaugacgugacguuuucuugacguuagguaccuuuaugucuuguaauguagccugaguuuaccaagcaacagguuucuaguuaacagguggagaagccgcacuuuuuuuucagcaguuagauuuuuuuuucauuagcuaaaaauuaggaugcugccuuguugcugggauaaauaaaaauuuaaaagugucuccaguuucuauaaccaccaccucacgcuguucuuauagaagccuagagccuggcaagguggugcaaaccucuaaucucagcgggggucggguggggauggggaggcagguggaucucugugaguucuaggccagccugcucuacagagcaaguucccgaacugccaggacugcacagagaaaccccguuuccgggaaaaaacaaaaacaaacacccucuccccccgccaacaaaccaaauuuaaaaacaacacaacaauagcuacaaaagaagcccaagugagcaguguaagagaggcucauacccgggguauucaaacaggaacgcgcauuuugcuuucuauuaguaaccuugcacugucuaccugagucacagcagacgcuuuaguccagccugcuaccggcccgcacaacccuccccucccucucagcaccucccccucccuagcgccauccugacuccagguaaaaaaaccucggcgggcuauauaggagcacaccacccuugggagagccccaccacccacacaagagguuuugauaaaacacccaucccaaggccauuuucugugaaauaguucauucgcucacuaggcucaggauuuuacuuuuccagggcuuuucuagcagguccucaaacaucccuaacuagcccuuugucucacccuguuaaagcgggguuagcauuugaauggacuggcaagcccuuucccuccguagguagacuggcugagggagaugcacgugggacaagugggggucggugacaaagcuaguuaaacugccuuccaagagcuuuuggaucuuuagcugcauuaaucguuugcuuaaugggaaaacuuccuucugugguggaagggugcgauuauugagugucuuuuaagugauuuucuuuuuuaaaauuauguggcaauguucaaauaccgugugguggcaaaugccagauguaaguacuguuuaguuuaucaguaaaacuuuuaauuuuauuugugagaauuggagaaugagaugggagguguaaacucuaggauugauuuguaaguguguuuuuuuguuugcuuuuuuaugugccugaagccuuuuauccucugggauugcuuacaaccuuugacucuuuagccuacauuuuagcagcuguguccccuuaacgagaaacuugaaacaucagaacugguaagaauaaaguuuuuuuuuuuuaauggauuuacuuaauuucuccuuuugucaugucaaaagaaaagaggaugaggaaacugagcagagacaacggugugggggcaagcaggacagcagcccaucacaaaagcaacaaaagcaagucaugauaaucaauuguucagggccagagaccagugaugucaccuuguuagcucaaauacugcuuccucugaagucccacuuaguaacaagaugagaaacucaggccauaccuuugaucccgugcuccacaugagggaaggaauguccuguugugggguuuggccacuaauuaaccuaacucccaaacccagacagaaugagaaaccagcagacugagacaaaaggcauaagauacugggugagcccagggugccucuuucccaccuugcugacugccuccggucuucccucacaccccucugccucaguuucuucuuaaagugugcuagcagaacaaaaucguucucucucuggugucagaagggcagagccgcaccucuagcuccagcgacguucccaaaucucaaauguuugacuaaauaaaaagcacuaacugugaagaaguguguuuguguugucaagacucacugcguccaguccugggggcgggguuggggagugugagcgagcacuccuaagagcaccuaucaaugcuauguugugcuguucccgaauucucccccugugguuagugucuagaaugaaccuuccagaacccaguugguacaagcccauuagggaugcuagcuacgaaauaugggagacagcaagcugacaguacagguuaaguaauggcuuagaggcucuagauaguugggauaaacggggaaguguuucaccuccuguccauuaucauucccucccaggggcuuuuuuuccagccauauccagccagugguuccugucuccaguuuuaguacucacaucuuuuuauaugcugcaaggccugguaauagcuaagcucacucucacacacaccacaaacaugcacacacguaucaaacacaugcacguacucauacaaacacaccagacacucaauacucauaccccagauaccucucacaugcacaaacaccacacucauccacacacauacccgacacaugcaccuacucauccacaaacacgacagacacucaugcucacacacaagcacacacucauccacacacauacccgacacaugcaccuacucauccacaaacacacgacagacacucaugcucacacacaagcacacacucauccacacacacacacacacaaacaucacagucauacaccacacacacucacaagcacaccagacauacucauacacacacacucauacacacaagcacacccacaauuauacacacaccagacacucauauacaaauguacccacucauacacauaaacacagccacucacacaagcacaccauacucauacacacacaaacacacccacacucacucccccauauguauguauacauacauacacacacacacacaccagacacacacaagcaagcacaccacacucauacacacccacacucauaugcacagcagacauacaccacacacucacccccagacacaaacacacagccaaauuuggcuccacugcugaggcaaacaaagcaaacacuucucccaauaaucggcucugcaaauugacuuuuuauugaccauuuauuuauuucauguuuuaaccccuuuggggcauuuaaaaauuuggucuaauuuuacuaguguuuguuuucuccaagucuccuagauagggagccccagcccagccaugaagcagaacagcuggcauggugaggaccagaggacagacauagccuagugacuuggauccccugagugcaggugucugcagugcagagcaacaucacuuauugauagugcucagccacagaggcgggaggccccaggggagcucaaaugugcacauuccuauguuuuuuccuaugagccuauuuuaggguaaacauguuacacacuagcaaggggauguggcugccccaaggugaggggagcaaaaaggguuguggggacccagggaguaaaagaacaugcuauggaggcccgggaaggagcacacagccaacacauuucaugggugcacaaaagcacuuugaagagauagggaaucaaaccauugaggacacaccaacuauggcaggcugaagagggaggaugggaccaggugcaacaaggagcaucgacaccucagggugaggaagaguauuuuuaauagccaaagauggacacuagaggagaauuucagaucagucacccuugaggucaccaucccagucuuauagaccuagcuggggaauuucaacuucagcucuacagaauggaguucucauaaggauaccucaaauucauuaaccaaaaagacuuaagagcuacuaaccuuacuuaaugguuuuuaaagcauuggguuuugacucaagaagaccagccucugaggcucccauuccuauggcacaggaaugcaggaaugugggccuagaguccacaggcuucucccucccgcaggcaauacccggcugauucuccuggcuuaugugucuguuucaauuagacuucauuaggaaaauuugcuuuggaugauugagguugccugaaaaggugaacaacacaauccccucaaauucaaauaauauucaggccccgaagccccugggugccuacaauucccaccaugaguuacagaaaucuuacauagccuuucuauuaaaucuaaccgccuucugggaucccagcccccacuccuuccaccccagcccgccccuccggcagacaccuccccugauuguuucucucaucugcaacaggcacuucucccucguggauucagcugcauucucagcuguucauguggacaccuugugcaggcacagguggcaggagcauggcaagcuaaggcacaauuugguggcucuuccacaaagaaagccauugauaucaagccacugcuaauaagccugagggaggggccugcccuuuaucguggcuuuucauccagaguugaccagcuguauucauaaauaucauuucaucccccuaacaugagccccacaucagucccuaguccaguaucuugcccuaucugcuagagacaucuucccuuuaauuagcauuugucucaaacaggccagccacacagccccuucugcagagcugcugccuccaccggccaaggcuugcagagaugauggcagggagguggggggagggcugcagcagucuuaauugaacaguaauuaauugaacagcuucaaagucuuauugcuacucagggaaacacucagaaaaccuuugucauugggaggcugagcgacuuaguguuugccugaauucuuuuucuaucuucucuuuuucugcaucugguuccuuugccugaaaauuaaugggacacauauguacuauaggcagagaaggcuccuuauaaggcugccccuuccccaaagccauaaaccaaaagaaaccuuacugccaauggucuugcuauuccuggcuucugcauccccccccccccaccaucuugcucacuccacccucccuucuacccaagggaccuuuccuacuuggcuuucucuuuugcggccacagggauaaaucaaagacguuaagaagcaguuacuugggguaucuggaugggccuugggcuuuuagcagaaaacaaaaaccccaaagggggaaauauuauauauacacauaaagcccuaaaauguaaauauaaauacaacuguuguuguaaacaagcacccagcccagggcaccacagaaaagugggaccacgccuuuuuagguaaggaagcugaagccgagggagagucagcuucuuuaugguuggugugacuuucaaaaggucaccugauuauuucugacuugagcgucugggccaacugcacugagcaagcugccuuuccucagagaagcagagcccaauggaaacaggggcacuccuuaccaguccuuucuaauacggaaagagccuccucuccaccugacacaccaucucucucauagccugucacucuagcauacacuguguggauggucgaggcccccaggcuuagcuucugccuuucccaccuaguaagccuuccucugcacccacuccuuucccacccacagcuuuugugacucgccgguggcuuuguuuuacucacaucucucagcauuuaccuccccccaucacaaccauuacagagucagcuggacuagggaugacauaucuuuugccagggagcugaggagaugggcaaacaaaggcgccugauucauggaaccuacacgacaccagaauuagccccaacaaguugucuucugaccuacgcgugaaugcacgcgugcgcgcauacacucacccgagcacacacacacacaacuaagaggggagggaaaagauccuuuccuaguguagaguuguaaugugggaccauuagaaaccucacuccuaguaggguaaggccccaggccaggcacucaccaauugugucagacauguaucgaggcagccagaucaccaacaucaacaggcaccagacagugaaacccaguaaggugacuccaagccaacuuguccacucaucaccuccaucucuuaaccauucuggacuccccaaguccuuuggccaggccauacaguuaccuucugcuacaggcccucuugaacuugcugcuuguguacagcagagccuuuguacuuaggucuaugccaccauaggaaauugagagcacagggcagggcauaaucaggauuaaaucccgagcucuguuuuucccaguaugaauuuaccuuuaaauuaaagugccuuuuuaaaaaaaaauuauuuuuuauuuuuaaagucaauguaaagacuuucucagcuuuuccagccaggggcaacucuguaucagaggccaucuguacaaacucugaggacauugauauuauucauacuaaggggaugucauuggcaccugguagguuuagacuagagaagccauauaauauccugccucacacaggacagucaccauaacaaaacauuaccuauuaccugccccaaguccccagugcgaggcuaagaagccaugaugcacacacaagggcugcucccacuucagccucuggagccugcccugcucucucucucuccuucuggccucuccuuggcuguaucccuccacuggagaaauuuuaucugguucauuuaucucaaaccuuaguaaggcugauggacaauuugaauuuuugccuuguacccuucuccuaaacuucagaccuuuccuucccaggaauuuauuguaaguguauguguauauguguguguguguguauauauauauauauauauauauauauguauauauauauauguauauauauauauacacacacacacauauauauacauauacacauacauauauauauauaguaaauauauauuguauauuguguguguguauauauauauauguauauauauacauauauguauaucaaaucguccaucuuccuuucaauucugccaugucuaaaauuaaaaaaaaaaaaaaaaaagccucuaccucagcaccagccccuccccgacucuauguaauucccaguguccaaaacccaggugguagucuuugauuccuccgucuuuugugacuugucuaauacgagugcuuccaggaagccucuggaacccuuaagucucuuuuauccacugugucugggucucucuucucucagggcuuccgcggcugcagcuucuuugugcacagcccuuccuuuguucccuuuaucggaaccacccuccauguugguucuguccuuucuaaaagcuugauucaaauccugaucugagaaggagggagaaacacacaccuuucaccaucuaccccauuuccuccucuccacuuccugcccaaagagcccggaugcugcauggacgccucagaaagcacauccauuuucucccuucuuucccacugcuccuacaggagcaaagguguccguccgaucauuuauguaaccagaccccacacuuccuuacauuggacccuuuguuccagauaggugaaggugugcccgcucugccccgccccuucuauucagucaagacaucuugcuauggagacccauuccaggcgccauuuucuccaucuggucuuugcaaccccuccuauuggaggccuucucuuuccauuuucaugccguucugcucuuucacaaggagacuggcaugcucuggagguuucucccugucagagaagcacgauauaagaaagaauguggaacaaaggauucucacagaucauaagaaugucugaacaaagagaaccugaaaccauuuuuuuuuccuuuuggaugaauggugcuuuagggaugggugugagaggccuggagagcccacaagacccgcguggcggucuccuugggucgccaaccucagcgucuacugaccuuucaccuugugcaggguucagcaucucugggaaaugaaaucuguccaucuuguacugcucgucugcaucggagcaguaagcucucuuucuccauaggccuggcccaccaccuccaggcccuggaaaagccucucuccgcggugccucggcgauagcccucucuguguagugaguuagccuaccgccaucaugagcccaagggaugguccaugggggucccugaccuucccaccuugccuuggcgauuuagggcaucaaaaagcuuggcccccaaggcacucacggcgaccguggccuucuaggccuggccgccauacgcccgcccgccaaccgcuuccaaccaacccagcaagcacaaccucuuugggcguuccaacgcggcgcccccuauuggaccucccacccauauccgguuuccgguccgaagcccccugcucauucgccaggcauccuugauuggcgugaccccagcccaauagcugaccugucgcuggggucggaggggagugggcuagugguugagacccaguuggccuauucgguguauguucaaaccguuucgccauuuugaguguguguguguguauaugugggggaggguaguuggccaaacuuuggaccaaaguucaaaguguccggcaugcaguguguucagccguagaguugaggugacacgccuucggcaggucgcaggcauucucuggggguucacuuugucugcuuucuucuacucagggugaccacguggacgcuguaggcaaggggcuguagugugccgagccuguagugagaagagggacauguuagacuucagagaauuaaaucugccgcggcacacagcaugcaucuugcaauauacccaucugcauggugcauaauugccgcagccugcuuuauguaccacuucauacucucuuuucucaggguccugcaggccagaccugcccacugccuagcuguauugcaacaaaagacaaugccucgcgccaucgccauuaccuacuggcaaaauguccgcggugugcgcgugccgcgggcgcgcggcaaaacaaaaaaaaacagaaccccaaaggcaaacaauuaacaaaaaaacccugcccaggaauaaucugcagaucccagaccuaaagcauuuuaugauuauucgcugagcccaccgggcaaugugacuguauaaacuccugcagcucugagcccaccccggcaccgcaaggggcgcgcagccgcaggcuuugugaccgcgcuuaauuucgccuggguggacuguugcaguucaacguauagcaaaugcucuauggugcucacaacagaaggaggaggggauaaaagggggcuggagaagggcuugagagaggaaaugaacacggaauccgcagcuggcgcugguggcuggaagaugcgagucucggcagcuguugccaccauggcacgguuggucgguggguuaagugcauuucagguuuucuagucugcgagaccacccuaaaugggccaucaacuacaccccaaaucuccuuuugccuuuacccagaagacagaaguacaagaccugagcuagguggggggucuuccgguaagccuuaagcccccuccccuauuugcacgaaagcggcaaacaugaauaacuccuaagggggcuuugcuugauuuucugcagugcacugcugagaccuuuauuucuacugcaucaccguccauauaaacagagcaagcccugacuacaacacacuauaccacuguugagagcuccgagguguaauggggaugggggacauugaagggauuugcuggagccauccccaacaaacagcaaacauaaacauuaaaaaaagaaaaaaaaaggaaaaaaaagaaauaaagaaaaguacccuagagcauuuacgaaacaaauugcguguuuacauucggcacuuccucacccugucucuacccuuccggugggcucacgaccaccugucgcauuugugugugugugugccucuaccccuuuccuuguauccuaaagccuccauuuccugacuuggagaugaguauggguaauugccugagugugggguccuuagauaaggaauuuaccgcauacugggguaaucuggggugauaaagcccuccugcagucccuccuccccucgagaagaaucagauggggagggaggcuuucagcgucuguacucuaacagaccaaugcccacgucuugcgucacgugucccagcaacgcaagagagcucgcucgcucucuggccagggaaaaagcgagcuagagagacucggaaucaguccgggagaggagaggacggagccgaacgucccuacaaggccuccgcucaucagcccccuuacccaaagucgggagcagccggcaccgggagccagcucccggagccggcucagcacugagaccugcguccucuggcggcagagaaagaguucuauuuacgauuuucgagacgaaucggcacgcucuuaaaugccaagaaggcggagcuaaaguacagcaaaguacgaagagagaacagaaaaguuccuaaaguuguuggccgaccacagcccgaagggguaaguguaacuaggaaggugacagacuucaccagcaagagaugacucacuucagccaugguccuggguucuagccccugauuaucuauccuuacaaaguuuggaaacugaggcuggagaacuuuccaacaaaaauuugaauuuuuuaaaaaaaaauuuuuuuucacccuaguuuggcugggugcuccgucuuacggggccccaaauuuauuuugaaaagucgccaccguguuaugggcauguucaacugccuccacggcaauaauaugucaggacaacacgauauccccccugaagucggggagcagcccgagcaagaaccuuuggaagccccaggggcagcugcccccggugcuggggcuggcccagccgaagaaauggcgaccgaaccggacuccgaaccgucuaacaaugagcccguccccgacgagacuggcagugagaucaguggacccccagaagacuccaaaucugacauccaaagccccugccaggccuucgaggaaguccgaguggguggagacuacagcccaccuccggaggaagccaugccauucgagacacaacagcccagccugggagauuucuggcccacccuggagcagccaggaccaucugggaccccaucaggccuccaagccuucaacccagcgauuuuggagcccgggacccccacuggcgcgagcccaggccugggagccuauacccccccaccagaagaagcuaugccauuugaguucaacgagccugcccagggagaccauagccagccucccuugcaagucccagaccuugcgccaggagguccggaagcauugguccccagagcucuucccgcggagcccgggaacaucagauuugaaaacgcuggcuuccgagaagacuacagcccucccccugaagaaucugugccauuucaggucgguggagaagaauucgggggcgauagcccacccccaggacucccgcgagucaucccacaaaucggcauuggcggcgaguucccgacagucgcggucccgagugcgcucugccucgcucccgccgagaacgcgccuccccucuggguccgaggcgccauugacagaccauuccgcgaggcugucagaucuccuccuaacuucgcaugcgacagccccccgauggagaucaccagaccccugcuugagauuggcagagccuccauuggggucgacgacgacaccgcugucaauauggacagccccccaaucgcaagugauggcccgcccaucgaagucucgggagccccagauaagagcgagugcgcagagagacccccaguugagcgagaagcagccgagauggaaggaagcccuaccaccgccacugcgguggaaggaaaaguccccucuccggagagaggggacggaucuuccacccagccugaagcaauggaugccaagccagccccugcugcccaagccgucucuaccggaucugaugcuggagcuccuacggauuccgcgaugcucacagauagccagagcgaugccggagaagacgggacagccccaggaacgccuucagaucuccagucggauccugaagaacucgaagaagccccagcuguccgcgccgauccugacggaggggcagccccagucgccccagccacuccugccgaguccgagucugaaggcagcagagauccagccgccgagccagccuccgaggcagucccugccaccacggccgagucugccuccggggcagccccugucacccagguggagcccgcagccgcggcagucucugccacccuggcggagccugccgcccgggcagccccuaucacccccaaggagcccacuacccgggcaguccccucugcuagagcccauccggccgcuggagcagucccuggcgccccagcaaugucagccucugcuagggcagcugccgcuagggcagccuaugcagguccacuggucuggggagccaggucacucucagcuacucccgccgcucgggcaucccuuccugcccgcgcagcagcugccgcccgggcagccucugcugcccgcgcagucgcugcuggccggucagccucugccgcccccagcagggcccaucuuagaccccccagccccgagauccagguugcugacccgccuacuccgcggccuccuccgcggccgacugccuggccugacaaguacgagcggggccgaagcugcugcagguacgaggcaucgucuggcaucugcgagaucgaguccuccagugaugagucggaagaaggggccaccggcugcuuccaguggcuucugcggcgaaaccgccgcccuggccugccccggagccacacggucgggagcaacccaguccgcaacuucuucacccgagccuucggaagcugcuucggucuauccgaguguacccgaucacgaucccucagccccgggaaggccaaggauccuauggaggagaggcgcaaacagaugcgcaaagaagccauugagaugcgagagcagaagcgcgcagauaagaaacgcagcaagcucaucgacaagcaacuggaggaggagaagauggacuacauguguacacaccgccugcugcuucuagguaaugcggcagcuucugccccugggcaguagggccgcccgggccgcccggggaggggguggcagggccuuccgguggggcuugggccuugcccgcgggaggaggggguccggaaacccuguuagaaguuccagggagggacccccaacucugcccuggggugggagaggggccuuuuggagaguucggguggccgaacuauaugcccuccagggagaaaaguggugccgagcgacacugagggucguuaccggccggaggccagcgccagcgccagcgaucguaggcuggacaggcgggggcgugaggugagcccagaacugcuggggugggcccuucggggcucccccggcucgauuguucgugaccgcggugggcuagggccauccgggugcgcgcccccgccucgccuggcacggcugcuucgacucagacagcuuguuguugguguguguugguguccauuuucuguguucgccugugcaugacaugcucagugugucccaguauccaucccaggcacuuucaacguacccgccgauuuuauauuuguacucuaaaauagguuaccuugugauuugcgccauggcgcggccaaaacuuuccgugcugguacacucuguaauaaccugugugcagacucucugcagcgagcagagggaaaacgcgcaggcaacgguggcguggcauccuggguaaucugcugggccgaugacuggggggaguggggccugccgccgcgggccuccauaaccuuuucccgguaugucucucucucucuuuuccccuuugcgcuaagcauauccucacuucucaauacguaugucaaacccucccgccuuaacgguugaaaaaccagacacucagggcuuugggguuguucaaaacauguguauuuuguauucugugcacaugcacacacauacuggauccaccugugggggggggggaguagagcaggaggaagguuugggggggguaccuuagcccugcuggcaaggccacauucaaaacacacaggguuaguuucaagggagugggcguggcuggauuuaaauauauaucuauauauauaaaauaauuuucuccuuagcgaagagcccgagguaaggcaaucacuuauauuuuuacaauucguggcaggaagggccuaguuuaagaagguugggaguuguauguugggaguacaaucuugccuuuguauuuuaauugcaauuaaaaauaaaaauaaauaaauacuaaaugugugaacacugcaugggaagcuggggauagccuugugaacuguguauauguuugcaugucgaucuuuuuuucaagcagcuuuagcugaggacugaagguaagaaauucuaugcaucaguugaggaugaaaaaaaauaaagauuuuuuuuuuuaggaugacgauuaaagaaauguuaugccagccagauagguaccuuuugaggcccucaucuuccaccgcccacuccccagcucuccauguccccagcucuucauguccccuccccucgcagaaaccccuccccucauccugcagucagagccccucccaccacagacuucucauuuccaaccugagucguucauucuucuugccagauuaaucaaaacagcaauuaacaauggucuguaucuauagcuuaaauaaaaucuucaugagugaaucuccacaauuaauuuauuuauuuucucaaaccugucaagggaaucucaggauuacagugucuaaggcugugcuccauuugccugugagauauucgauaaucugugaugguauuuauuaaagacauugauggugugacuguguugcugugaugugccacaaaucauuaucuuagacgggauggucauuuuauuuaugccuaccugggggaaguauugguaucauugaaucaaacacacggaaaggggaaguugcuauaaauuucaaaugccccuguuacgugaaaagcauaguccccuacaugacaaggcuuggacuucacugcagguccauuuccauacucugagaagcugaccugugaguugggggugggugggggggacagaugucugcagguagaugaccuaagugacucugcacaucugaaucccgguuggucccuuauacucugaggccuuagucgccucguuugagaagcaaagcucucccaggaaauuuucauucaaguguccugcaguaacaggacuugggucuucugucuuagcccccacccccaauauaggaagaaggagcuuggaaguuuauacucucugcuaaugcagcucucugcaccaaacaucagaucugaggccagcuucuuucagaauagcaaacguuucccccuuauaucccuuagauuuuuuuuuccuggaggggauuauuaaacccaaacagaagcacauuuuggggagggggggggguaccauggcacuggccugucugcccuuuguggaucucagccacucugaccuuucuaugcagcgucauccagaaagcaggcugcucagccuuggccuaggccucgccugagccucuaagauggccacugcucccugcugccugugacugcaguagcgcugucugucaaagcaggcugcaguuucccacuaggcugcuuucauuucgcugaaguaacaagagagggauuguaucugggucccuguuauugauuggggagggucgaagcagaaggagaggauuuacucacaguuaugagacuuuuucacuaacugucuagcuucauuacguuaaacgagguaucuaugccuucugcccccugaaaacguagaucaaaugaccauccugaagcucuucacguaucacauccacagucaucuguugcuuuaaaaaaaaaacauuuuucugugugcauacucuguuuuuauugcccaaacaucauagugcuagaauuauuuuuaaagauagaugauagauagaaaaauagaaagauaauaauucaauaaaaauucuauaaugucuagagagcugaggcuuuuuaacauaauguaaucaaggccuguuuucauguuucuguuaguuuaaaaucuguggauuuuuuuuuccuuucuuuucaaaacuucacuuagauauuauuucuugguuuagaauugcaaggggcuacuagaucagucuauuuuaguaucucuugccuuuauuacaagcagguaaagcacucugaauaauaugaccacuauaguaaugccucauuuuuauagcaaaucauaauuaauuauauaauaauuuauuuggcugccaagugguacgguacugcacugcaauucaccgugcagauuguuuuuuuuuucccccuguauuuuuuuuuaaugcagccauuuucuuuuucuaaauucagaaggccuccacugaauuguuuggugcagugggaagcccauagugucccugacccccaaauuuagaaguuaaggaaaauuugcaucuuauuucccaauaacaucugcaagaauaacauguuuuacagagauccuuuaaaaaaauuucaacuccucucaaaaacauuuuuuucuaaauagguaauuuuauuuuuaucuaacucauaugaucuacccugaggagaugguaugaaccauagggaagggggucacccccaguauuggaaagggggguggcucaugcuuuuaacauuguuaguggccaucaaugauaaugaugacauguuuuaauugcauuuugcauuuuuuaaagucuucuguuuagucacaucagcccuuugaaagaguucugggcaguaagagcacuucaguaccccauuucaugagcacuucaguaccccauuucaugagcacauccacuccacucacacagauuaaaggccagggccucuuuuguuuuuuccucccaaagguagcaagguaaguaugugaaggacccaggccucuaacucugaggugcuaacgcucaccgagcccauuugaaaaauucuauauggcuuucucaaagaugagagcaugacaguuggaguguucucugugaucuuaaaaucccuuguuaaaugacaggugucuaacagucuguugcuuucugaauucuagccagacccugacagaccacugacuguaaaugucuauugagugaacaugaaauguaagcugcccauuugggggaagccauuuuguggaggcuuaguacucauguuugcuucacugcuucccaacauaacacacacauauacauacacacccacauauucacauacauacagcacauauacaacacacauacauauacacacagcacacacacauacacacacaacacaugcauauacccacacacacaacacacacaaugcauacacauauauaccacacacaacacaacacacacauacacacauguacacauacaacacauacauauaacuacacaacacacacaacacacauauacacacaacacacacauacacacauguacacauacaacacauacauauaaccacauaacacacacaaaacacacacaauauaacauaaacaaacacacacaaauacacacauaaaacagacauaauacacacauaacauauguacagagaacacacacacacagaacauacaacacacacauaugcaacacacauaccacaccacacacaaacagucacacacauaccacacauacaacacacacauacacauauaacacaacacacaaacacacacauauacacauaacacaccacacacacauaugcacacaacacauuugcuucaccccacacacaaacacacacacaagcuuuuuuuuuccuuuuguucuuguuuuuguauauaauguagcuuuucuuugacaucuuuuccgagaaaaaaaaauccccgaauaguuuucuuuagcagagcucaagcuuauaacaacaucaacaucaguaacaacaacaacaacuauuauuauuauuaauuauacaauuauaguaaauaacaauaaugauacuacagugcaguuguuuuuguaugcacaucccuggaugcgcagugccacaguacacaaacaggaucuccaauagcuuuucucuuccuuauuuuuaguuuacaacuaagucccauuuuuuuauuuaucaagaauccaugcaugauuuugaaaagcauuugcuuuguugauuuauuuugaugcaggacauuuaaaauuuuuuaaaagagaggauagcauaguugauuaaaauugaaacccucaacucuaggcacauucccccuuuuuuuuuuuuucaaucaguuu

SEQ ID NO: 2 - RNA, 34200 nt, Mus musculus
aaacugauugaaaaaaaaaaaaagggggaaugugccuagaguugaggguuucaauuuuaaucaacuaugcuauccucucuuuuaaaaaauuuuaaauguccugcaucaaaauaaaucaacaaagcaaaugcuuuucaaaaucaugcauggauucuugauaaauaaaaaaaugggacuuaguuguaaacuaaaaauaaggaagagaaaagcuauuggagauccuguuuguguacuguggcacugcgcauccagggaugugcauacaaaaacaacugcacuguaguaucauuauuguuauuuacuauaauuguauaauuaauaauaauaauaguuguuguuguuguuacugauguugauguuguuauaagcuugagcucugcuaaagaaaacuauucggggauuuuuuuuucucggaaaagaugucaaagaaaagcuacauuauauacaaaaacaagaacaaaaggaaaaaaaaagcuuguguguguguuuguguguggggugaagcaaauguguugugugcauaugugugugugguguguuauguguauauguguguguuuguguguuguguuauauguguauguguguguuguaugugugguaugugugugacuguuuguguguggugugguauguguguugcauauguguguguuguauguucuguguguguguguucucuguacauauguuauguguguauuaugucuguuuuauguguguauuuguguguguuuguuuauguuauauuguguguguuuuguguguguuaugugguuauauguauguguuguauguguacauguguguauguguguguuguguguauauguguguuguguguguuguguaguuauauguauguguuguauguguacauguguguauguguguguuguguugugugugguauauauguguaugcauuguguguguuguguguguggguauaugcauguguuguguguguaugugugugugcuguguguauauguauguguguuguauaugugcuguauguaugugaauauguggguguguauguauauguguguguuauguugggaagcagugaagcaaacaugaguacuaagccuccacaaaauggcuucccccaaaugggcagcuuacauuucauguucacucaauagacauuuacagucaguggucugucagggucuggcuagaauucagaaagcaacagacuguuagacaccugucauuuaacaagggauuuuaagaucacagagaacacuccaacugucaugcucucaucuuugagaaagccauauagaauuuuucaaaugggcucggugagcguuagcaccucagaguuagaggccuggguccuucacauacuuaccuugcuaccuuugggaggaaaaaacaaaagaggcccuggccuuuaaucugugugaguggaguggaugugcucaugaaaugggguacugaagugcucaugaaaugggguacugaagugcucuuacugcccagaacucuuucaaagggcugaugugacuaaacagaagacuuuaaaaaaugcaaaaugcaauuaaaacaugucaucauuaucauugauggccacuaacaauguuaaaagcaugagccaccccccuuuccaauacugggggugacccccuucccuaugguucauaccaucuccucaggguagaucauaugaguuagauaaaaauaaaauuaccuauuuagaaaaaaauguuuuugagaggaguugaaauuuuuuuaaaggaucucuguaaaacauguuauucuugcagauguuauugggaaauaagaugcaaauuuuccuuaacuucuaaauuugggggucagggacacuaugggcuucccacugcaccaaacaauucaguggaggccuucugaauuuagaaaaagaaaauggcugcauuaaaaaaaaauacagggggaaaaaaaaaacaaucugcacggugaauugcagugcaguaccguaccacuuggcagccaaauaaauuauuauauaauuaauuaugauuugcuauaaaaaugaggcauuacuauaguggucauauuauucagagugcuuuaccugcuuguaauaaaggcaagagauacuaaaauagacugaucuaguagccccuugcaauucuaaaccaagaaauaauaucuaagugaaguuuugaaaagaaaggaaaaaaaaauccacagauuuuaaacuaacagaaacaugaaaacaggccuugauuacauuauguuaaaaagccucagcucucuagacauuauagaauuuuuauugaauuauuaucuuucuauuuuucuaucuaucaucuaucuuuaaaaauaauucuagcacuaugauguuugggcaauaaaaacagaguaugcacacagaaaaauguuuuuuuuuuaaagcaacagaugacuguggaugugauacgugaagagcuucaggauggucauuugaucuacguuuucagggggcagaaggcauagauaccucguuuaacguaaugaagcuagacaguuagugaaaaagucucauaacugugaguaaauccucuccuucugcuucgacccuccccaaucaauaacagggacccagauacaaucccucucuuguuacuucagcgaaaugaaagcagccuagugggaaacugcagccugcuuugacagacagcgcuacugcagucacaggcagcagggagcaguggccaucuuagaggcucaggcgaggccuaggccaaggcugagcagccugcuuucuggaugacgcugcauagaaaggucagaguggcugagauccacaaagggcagacaggccagugccaugguaccccccccccuccccaaaaugugcuucuguuuggguuuaauaauccccuccaggaaaaaaaaaucuaagggauauaagggggaaacguuugcuauucugaaagaagcuggccucagaucugauguuuggugcagagagcugcauuagcagagaguauaaacuuccaagcuccuucuuccuauauugggggugggggcuaagacagaagacccaaguccuguuacugcaggacacuugaaugaaaauuuccugggagagcuuugcuucucaaacgaggcgacuaaggccucagaguauaagggaccaaccgggauucagaugugcagagucacuuaggucaucuaccugcagacaucugucccccccacccacccccaacucacaggucagcuucucagaguauggaaauggaccugcagugaaguccaagccuugucauguaggggacuaugcuuuucacguaacaggggcauuugaaauuuauagcaacuuccccuuuccguguguuugauucaaugauaccaauacuucccccagguaggcauaaauaaaaugaccaucccgucuaagauaaugauuuguggcacaucacagcaacacagucacaccaucaaugucuuuaauaaauaccaucacagauuaucgaauaucucacaggcaaauggagcacagccuuagacacuguaauccugagauucccuugacagguuugagaaaauaaauaaauuaauuguggagauucacucaugaagauuuuauuuaagcuauagauacagaccauuguuaauugcuguuuugauuaaucuggcaagaagaaugaacgacucagguuggaaaugagaagucuguggugggaggggcucugacugcaggaugaggggagggguuucugcgaggggaggggacaugaagagcuggggacauggagagcuggggagugggcgguggaagaugagggccucaaaagguaccuaucuggcuggcauaacauuucuuuaaucgucauccuaaaaaaaaaaaucuuuauuuuuuuucauccucaacugaugcauagaauuucuuaccuucaguccucagcuaaagcugcuugaaaaaaagaucgacaugcaaacauauacacaguucacaaggcuauccccagcuucccaugcaguguucacacauuuaguauuuauuuauuuuuauuuuuaauugcaauuaaaauacaaaggcaagauuguacucccaacauacaacucccaaccuucuuaaacuaggcccuuccugccacgaauuguaaaaauauaagugauugccuuaccucgggcucuucgcuaaggagaaaauuauuuuauauauauagauauauauuuaaauccagccacgcccacucccuugaaacuaacccuguguguuuugaauguggccuugccagcagggcuaagguaccccccccaaaccuuccuccugcucuacucccccccccccacagguggauccaguaugugugugcaugugcacagaauacaaaauacacauguuuugaacaaccccaaagcccugagugucugguuuuucaaccguuaaggcgggaggguuugacauacguauugagaagugaggauaugcuuagcgcaaaggggaaaagagagagagagacauaccgggaaaagguuauggaggcccgcggcggcaggccccacuccccccagucaucggcccagcagauuacccaggaugccacgccaccguugccugcgcguuuucccucugcucgcugcagagagucugcacacagguuauuacagaguguaccagcacggaaaguuuuggccgcgccauggcgcaaaucacaagguaaccuauuuuagaguacaaauauaaaaucggcggguacguugaaagugccugggauggauacugggacacacugagcaugucaugcacaggcgaacacagaaaauggacaccaacacacaccaacaacaagcugucugagucgaagcagccgugccaggcgaggcgggggcgcgcacccggauggcccuagcccaccgcggucacgaacaaucgagccgggggagccccgaagggcccaccccagcaguucugggcucaccucacgcccccgccuguccagccuacgaucgcuggcgcuggcgcuggccuccggccgguaacgacccucagugucgcucggcaccacuuuucucccuggagggcauauaguucggccacccgaacucuccaaaaggccccucucccaccccagggcagaguugggggucccucccuggaacuucuaacaggguuuccggacccccuccucccgcgggcaaggcccaagccccaccggaaggcccugccacccccuccccgggcggcccgggcggcccuacugcccaggggcagaagcugccgcauuaccuagaagcagcaggcgguguguacacauguaguccaucuucuccuccuccaguugcuugucgaugagcuugcugcguuucuuaucugcgcgcuucugcucucgcaucucaauggcuucuuugcgcaucuguuugcgccucuccuccauaggauccuuggccuucccggggcugagggaucgugaucggguacacucggauagaccgaagcagcuuccgaaggcucgggugaagaaguugcggacuggguugcucccgaccguguggcuccggggcaggccagggcggcgguuucgccgcagaagccacuggaagcagccgguggccccuucuuccgacucaucacuggaggacucgaucucgcagaugccagacgaugccucguaccugcagcagcuucggccccgcucguacuugucaggccaggcagucggccgcggaggaggccgcggaguaggcgggucagcaaccuggaucucggggcuggggggucuaagaugggcccugcugggggcggcagaggcugaccggccagcagcgacugcgcgggcagcagaggcugcccgggcggcagcugcugcgcgggcaggaagggaugcccgagcggcgggaguagcugagagugaccuggcuccccagaccaguggaccugcauaggcugcccuagcggcagcugcccuagcagaggcugacauugcuggggcgccagggacugcuccagcggccggaugggcucuagcagaggggacugcccggguagugggcuccuugggggugauaggggcugcccgggcggcaggcuccgccaggguggcagagacugccgcggcugcgggcuccaccugggugacaggggcugccccggaggcagacucggccgugguggcagggacugccucggaggcuggcucggcggcuggaucucugcugccuucagacucggacucggcaggaguggcuggggcgacuggggcugccccuccgucaggaucggcgcggacagcuggggcuucuucgaguucuucaggauccgacuggagaucugaaggcguuccuggggcugucccgucuucuccggcaucgcucuggcuaucugugagcaucgcggaauccguaggagcuccagcaucagauccgguagagacggcuugggcagcaggggcuggcuuggcauccauugcuucaggcuggguggaagauccguccccucucuccggagaggggacuuuuccuuccaccgcaguggcggugguagggcuuccuuccaucucggcugcuucucgcucaacugggggucucucugcgcacucgcucuuaucuggggcucccgagacuucgaugggcgggccaucacuugcgauuggggggcuguccauauugacagcggugucgucgucgaccccaauggaggcucugccaaucucaagcaggggucuggugaucuccaucggggggcugucgcaugcgaaguuaggaggagaucugacagccucgcggaauggucugucaauggcgccucggacccagaggggaggcgcguucucggcgggagcgaggcagagcgcacucgggaccgcgacugucgggaacucgccgccaaugccgauuugugggaugacucgcgggaguccugggggugggcuaucgcccccgaauucuucuccaccgaccugaaauggcacagauucuucagggggagggcuguagucuucucggaagccagcguuuucaaaucugauguucccgggcuccgcgggaagagcucuggggaccaaugcuuccggaccuccuggcgcaaggucugggacuugcaagggaggcuggcuauggucucccugggcaggcucguugaacucaaauggcauagcuucuucugguggggggguauaggcucccaggccugggcucgcgccagugggggucccgggcuccaaaaucgcuggguugaaggcuuggaggccugauggggucccagaugguccuggcugcuccagggugggccagaaaucucccaggcugggcuguugugucucgaauggcauggcuuccuccggaggugggcuguagucuccacccacucggacuuccucgaaggccuggcaggggcuuuggaugucagauuuggagucuucuggggguccacugaucucacugccagucucgucggggacgggcucauuguuagacgguucggaguccgguucggucgccauuucuucggcugggccagccccagcaccgggggcagcugccccuggggcuuccaaagguucuugcucgggcugcuccccgacuucaggggggauaucguguuguccugacauauuauugccguggaggcaguugaacaugcccauaacacgguggcgacuuuucaaaauaaauuuggggccccguaagacggagcacccagccaaacuagggugaaaaaaaauuuuuuuuuaaaaaauucaaauuuuuguuggaaaguucuccagccucaguuuccaaacuuuguaaggauagauaaucaggggcuagaacccaggaccauggcugaagugagucaucucuugcuggugaagucugucaccuuccuaguuacacuuaccccuucgggcuguggucggccaacaacuuuaggaacuuuucuguucucucuucguacuuugcuguacuuuagcuccgccuucuuggcauuuaagagcgugccgauucgucucgaaaaucguaaauagaacucuuucucugccgccagaggacgcaggucucagugcugagccggcuccgggagcuggcucccggugccggcugcucccgacuuuggguaagggggcugaugagcggaggccuuguagggacguucggcuccguccucuccucucccggacugauuccgagucucucuagcucgcuuuuucccuggccagagagcgagcgagcucucuugcguugcugggacacgugacgcaagacgugggcauuggucuguuagaguacagacgcugaaagccucccuccccaucugauucuucucgaggggaggagggacugcaggagggcuuuaucaccccagauuaccccaguaugcgguaaauuccuuaucuaaggaccccacacucaggcaauuacccauacucaucuccaagucaggaaauggaggcuuuaggauacaaggaaagggguagaggcacacacacacacaaaugcgacagguggucgugagcccaccggaaggguagagacagggugaggaagugccgaauguaaacacgcaauuuguuucguaaaugcucuaggguacuuuucuuuauuucuuuuuuuuccuuuuuuuuucuuuuuuuaauguuuauguuugcuguuuguuggggauggcuccagcaaaucccuucaaugucccccauccccauuacaccucggagcucucaacagugguauaguguguuguagucagggcuugcucuguuuauauggacggugaugcaguagaaauaaaggucucagcagugcacugcagaaaaucaagcaaagcccccuuaggaguuauucauguuugccgcuuucgugcaaauaggggagggggcuuaaggcuuaccggaagaccccccaccuagcucaggucuuguacuucugucuucuggguaaaggcaaaaggagauuugggguguaguugauggcccauuuaggguggucucgcagacuagaaaaccugaaaugcacuuaacccaccgaccaaccgugccaugguggcaacagcugccgagacucgcaucuuccagccaccagcgccagcugcggauuccguguucauuuccucucucaagcccuucuccagcccccuuuuauccccuccuccuucuguugugagcaccauagagcauuugcuauacguugaacugcaacaguccacccaggcgaaauuaagcgcggucacaaagccugcggcugcgcgccccuugcggugccggggugggcucagagcugcaggaguuuauacagucacauugcccggugggcucagcgaauaaucauaaaaugcuuuaggucugggaucugcagauuauuccugggcaggguuuuuuuguuaauuguuugccuuugggguucuguuuuuuuuuguuuugccgcgcgcccgcggcacgcgcacaccgcggacauuuugccaguagguaauggcgauggcgcgaggcauugucuuuuguugcaauacagcuaggcagugggcaggucuggccugcaggacccugagaaaagagaguaugaagugguacauaaagcaggcugcggcaauuaugcaccaugcagauggguauauugcaagaugcaugcugugugccgcggcagauuuaauucucugaagucuaacaugucccucuucucacuacaggcucggcacacuacagccccuugccuacagcguccacguggucacccugaguagaagaaagcagacaaagugaacccccagagaaugccugcgaccugccgaaggcgugucaccucaacucuacggcugaacacacugcaugccggacacuuugaacuuugguccaaaguuuggccaacuacccucccccacauauacacacacacacacucaaaauggcgaaacgguuugaacauacaccgaauaggccaacugggucucaaccacuagcccacuccccuccgaccccagcgacaggucagcuauugggcuggggucacgccaaucaaggaugccuggcgaaugagcagggggcuucggaccggaaaccggauaugggugggagguccaauagggggcgccgcguuggaacgcccaaagagguugugcuugcuggguugguuggaagcgguuggcgggcgggcguauggcggccaggccuagaaggccacggucgccgugagugccuugggggccaagcuuuuugaugcccuaaaucgccaaggcaaggugggaaggucagggacccccauggaccaucccuugggcucaugauggcgguaggcuaacucacuacacagagagggcuaucgccgaggcaccgcggagagaggcuuuuccagggccuggagguggugggccaggccuauggagaaagagagcuuacugcuccgaugcagacgagcaguacaagauggacagauuucauuucccagagaugcugaacccugcacaaggugaaaggucaguagacgcugagguuggcgacccaaggagaccgccacgcgggucuugugggcucuccaggccucucacacccaucccuaaagcaccauucauccaaaaggaaaaaaaaaugguuucagguucucuuuguucagacauucuuaugaucugugagaauccuuuguuccacauucuuucuuauaucgugcuucucugacagggagaaaccuccagagcaugccagucuccuugugaaagagcagaacggcaugaaaauggaaagagaaggccuccaauaggagggguugcaaagaccagauggagaaaauggcgccuggaaugggucuccauagcaagaugucuugacugaauagaaggggcggggcagagcgggcacaccuucaccuaucuggaacaaaggguccaauguaaggaaguguggggucugguuacauaaaugaucggacggacaccuuugcuccuguaggagcagugggaaagaagggagaaaauggaugugcuuucugaggcguccaugcagcauccgggcucuuugggcaggaaguggagaggaggaaaugggguagauggugaaagguguguguuucucccuccuucucagaucaggauuugaaucaagcuuuuagaaaggacagaaccaacauggagggugguuccgauaaagggaacaaaggaagggcugugcacaaagaagcugcagccgcggaagcccugagagaagagagacccagacacaguggauaaaagagacuuaaggguuccagaggcuuccuggaagcacucguauuagacaagucacaaaagacggaggaaucaaagacuaccaccuggguuuuggacacugggaauuacauagagucggggaggggcuggugcugagguagaggcuuuuuuuuuuuuuuuuuuaauuuuagacauggcagaauugaaaggaagauggacgauuugauauacauauauguauauauauacauauauauauauacacacacacaauauacaauauauauuuacuauauauauauauguauguguauauguauauauauguguguguguguauauauauauauacauauauauauauacauauauauauauauauauauauauauacacacacacacacauauacacauacacuuacaauaaauuccugggaaggaaaggucugaaguuuaggagaaggguacaaggcaaaaauucaaauuguccaucagccuuacuaagguuugagauaaaugaaccagauaaaauuucuccaguggagggauacagccaaggagaggccagaaggagagagagagagcagggcaggcuccagaggcugaagugggagcagcccuugugugugcaucauggcuucuuagccucgcacuggggacuuggggcagguaauagguaauguuuuguuauggugacuguccugugugaggcaggauauuauauggcuucucuagucuaaaccuaccaggugccaaugacauccccuuaguaugaauaauaucaauguccucagaguuuguacagauggccucugauacagaguugccccuggcuggaaaagcugagaaagucuuuacauugacuuuaaaaauaaaaaauaauuuuuuuuuaaaaaggcacuuuaauuuaaagguaaauucauacugggaaaaacagagcucgggauuuaauccugauuaugcccugcccugugcucucaauuuccuaugguggcauagaccuaaguacaaaggcucugcuguacacaagcagcaaguucaagagggccuguagcagaagguaacuguauggccuggccaaaggacuuggggaguccagaaugguuaagagauggaggugaugaguggacaaguuggcuuggagucaccuuacuggguuucacugucuggugccuguugauguuggugaucuggcugccucgauacaugucugacacaauuggugagugccuggccuggggccuuacccuacuaggagugagguuucuaauggucccacauuacaacucuacacuaggaaaggaucuuuucccuccccucuuaguugugugugugugugcucgggugaguguaugcgcgcacgcgugcauucacgcguaggucagaagacaacuuguuggggcuaauucuggugucguguagguuccaugaaucaggcgccuuuguuugcccaucuccucagcucccuggcaaaagauaugucaucccuaguccagcugacucuguaaugguugugauggggggagguaaaugcugagagaugugaguaaaacaaagccaccggcgagucacaaaagcugugggugggaaaggagugggugcagaggaaggcuuacuaggugggaaaggcagaagcuaagccugggggccucgaccauccacacaguguaugcuagagugacaggcuaugagagagauggugugucagguggagaggaggcucuuuccguauuagaaaggacugguaaggagugccccuguuuccauugggcucugcuucucugaggaaaggcagcuugcucagugcaguuggcccagacgcucaagucagaaauaaucaggugaccuuuugaaagucacaccaaccauaaagaagcugacucucccucggcuucagcuuccuuaccuaaaaaggcguggucccacuuuucuguggugcccugggcugggugcuuguuuacaacaacaguuguauuuauauuuacauuuuagggcuuuauguguauauauaauauuucccccuuugggguuuuuguuuucugcuaaaagcccaaggcccauccagauaccccaaguaacugcuucuuaacgucuuugauuuaucccuguggccgcaaaagagaaagccaaguaggaaaggucccuuggguagaagggaggguggagugagcaagaugguggggggggggggaugcagaagccaggaauagcaagaccauuggcaguaagguuucuuuugguuuauggcuuuggggaaggggcagccuuauaaggagccuucucugccuauaguacauaugugucccauuaauuuucaggcaaaggaaccagaugcagaaaaagagaagauagaaaaagaauucaggcaaacacuaagucgcucagccucccaaugacaaagguuuucugaguguuucccugaguagcaauaagacuuugaagcuguucaauuaauuacuguucaauuaagacugcugcagcccuccccccaccucccugccaucaucucugcaagccuuggccgguggaggcagcagcucugcagaaggggcuguguggcuggccuguuugagacaaaugcuaauuaaagggaagaugucucuagcagauagggcaagauacuggacuagggacugauguggggcucauguuagggggaugaaaugauauuuaugaauacagcuggucaacucuggaugaaaagccacgauaaagggcaggccccucccucaggcuuauuagcaguggcuugauaucaauggcuuucuuuguggaagagccaccaaauugugccuuagcuugccaugcuccugccaccugugccugcacaagguguccacaugaacagcugagaaugcagcugaauccacgagggagaagugccuguugcagaugagagaaacaaucaggggaggugucugccggaggggcgggcugggguggaaggagugggggcugggaucccagaaggcgguuagauuuaauagaaaggcuauguaagauuucuguaacucauggugggaauuguaggcacccaggggcuucggggccugaauauuauuugaauuugaggggauuguguuguucaccuuuucaggcaaccucaaucauccaaagcaaauuuuccuaaugaagucuaauugaaacagacacauaagccaggagaaucagccggguauugccugcgggagggagaagccuguggacucuaggcccacauuccugcauuccugugccauaggaaugggagccucagaggcuggucuucuugagucaaaacccaaugcuuuaaaaaccauuaaguaagguuaguagcucuuaagucuuuuugguuaaugaauuugagguauccuuaugagaacuccauucuguagagcugaaguugaaauuccccagcuaggucuauaagacugggauggugaccucaagggugacugaucugaaauucuccucuaguguccaucuuuggcuauuaaaaauacucuuccucacccugaggugucgaugcuccuuguugcaccuggucccauccucccucuucagccugccauaguugguguguccucaaugguuugauucccuaucucuucaaagugcuuuugugcacccaugaaauguguuggcugugugcuccuucccgggccuccauagcauguucuuuuacucccuggguccccacaacccuuuuugcuccccucaccuuggggcagccacauccccuugcuaguguguaacauguuuacccuaaaauaggcucauaggaaaaaacauaggaaugugcacauuugagcuccccuggggccucccgccucuguggcugagcacuaucaauaagugauguugcucugcacugcagacaccugcacucaggggauccaagucacuaggcuaugucuguccucugguccucaccaugccagcuguucugcuucauggcugggcuggggcucccuaucuaggagacuuggagaaaacaaacacuaguaaaauuagaccaaauuuuuaaaugccccaaagggguuaaaacaugaaauaaauaaauggucaauaaaaagucaauuugcagagccgauuauugggagaaguguuugcuuuguuugccucagcaguggagccaaauuuggcuguguguuugugucugggggugagugugugguguaugucugcugugcauaugaguguggguguguaugaguguggugugcuugcuugugugugucugguguguguguguguguauguauguauacauacauaugggggagugaguguggguguguuuguguguguaugaguauggugugcuugugugaguggcuguguuuauguguaugaguggguacauuuguauaugagugucugguguguguauaauugugggugugcuuguguguaugaguguguguguaugaguaugucuggugugcuugugagugugugugguguaugacugugauguuuguguguguguguguguggaugagugugugcuugugugugagcaugagugucugucguguguuuguggaugaguaggugcaugugucggguauguguguggaugagugugugcuugugugugagcaugagugucugucguguuuguggaugaguaggugcaugugucggguauguguguggaugagugugguguuugugcaugugagagguaucugggguaugaguauugagugucugguguguuuguaugaguacgugcauguguuugauacgugugugcauguuuguggugugugugagagugagcuuagcuauuaccaggccuugcagcauauaaaaagaugugaguacuaaaacuggagacaggaaccacuggcuggauauggcuggaaaaaaagccccugggagggaaugauaauggacaggaggugaaacacuuccccguuuaucccaacuaucuagagccucuaagccauuacuuaaccuguacugucagcuugcugucucccauauuucguagcuagcaucccuaaugggcuuguaccaacuggguucuggaagguucauucuagacacuaaccacagggggagaauucgggaacagcacaacauagcauugauaggugcucuuaggagugcucgcucacacuccccaaccccgcccccaggacuggacgcagugagucuugacaacacaaacacacuucuucacaguuagugcuuuuuauuuagucaaacauuugagauuugggaacgucgcuggagcuagaggugcggcucugcccuucugacaccagagagagaacgauuuuguucugcuagcacacuuuaagaagaaacugaggcagaggggugugagggaagaccggaggcagucagcaaggugggaaagaggcacccugggcucacccaguaucuuaugccuuuugucucagucugcugguuucucauucugucuggguuugggaguuagguuaauuaguggccaaaccccacaacaggacauuccuucccucauguggagcacgggaucaaagguauggccugaguuucucaucuuguuacuaagugggacuucagaggaagcaguauuugagcuaacaaggugacaucacuggucucuggcccugaacaauugauuaucaugacuugcuuuuguugcuuuugugaugggcugcuguccugcuugcccccacaccguugucucugcucaguuuccucauccucuuuucuuuugacaugacaaaaggagaaauuaaguaaauccauuaaaaaaaaaaaacuuuauucuuaccaguucugauguuucaaguuucucguuaaggggacacagcugcuaaaauguaggcuaaagagucaaagguuguaagcaaucccagaggauaaaaggcuucaggcacauaaaaaagcaaacaaaaaaacacacuuacaaaucaauccuagaguuuacaccucccaucucauucuccaauucucacaaauaaaauuaaaaguuuuacugauaaacuaaacaguacuuacaucuggcauuugccaccacacgguauuugaacauugccacauaauuuuaaaaaagaaaaucacuuaaaagacacucaauaaucgcacccuuccaccacagaaggaaguuuucccauuaagcaaacgauuaaugcagcuaaagauccaaaagcucuuggaaggcaguuuaacuagcuuugucaccgacccccacuugucccacgugcaucucccucagccagucuaccuacggagggaaagggcuugccaguccauucaaaugcuaaccccgcuuuaacagggugagacaaagggcuaguuagggauguuugaggaccugcuagaaaagcccuggaaaaguaaaauccugagccuagugagcgaaugaacuauuucacagaaaauggccuugggauggguguuuuaucaaaaccucuugugugggugguggggcucucccaaggguggugugcuccuauauagcccgccgagguuuuuuuaccuggagucaggauggcgcuagggagggggaggugcugagagggaggggaggguugugcgggccgguagcaggcuggacuaaagcgucugcugugacucagguagacagugcaagguuacuaauagaaagcaaaaugcgcguuccuguuugaauaccccggguaugagccucucuuacacugcucacuugggcuucuuuuguagcuauuguuguguuguuuuuaaauuugguuuguuggcggggggagaggguguuuguuuuuguuuuuucccggaaacgggguuucucugugcaguccuggcaguucgggaacuugcucuguagagcaggcuggccuagaacucacagagauccaccugccuccccauccccacccgacccccgcugagauuagagguuugcaccaccuugccaggcucuaggcuucuauaagaacagcgugagguggugguuauagaaacuggagacacuuuuaaauuuuuauuuaucccagcaacaaggcagcauccuaauuuuuagcuaaugaaaaaaaaaucuaacugcugaaaaaaaagugcggcuucuccaccuguuaacuagaaaccuguugcuugguaaacucaggcuacauuacaagacauaaagguaccuaacgucaagaaaacgucacgucaucuuuuucguugccgagcauuuuaacuuaggaaaaauaaugucucacuuaggcaauuucacgcuuucaacccaaaagcccccgccuccuuuccgcaagcuaccggcucauucucuacccacugcuaacaaacugcuuccugcuguugaccaaagucgcaauuagccgcagugcgcacagcccacccucacuuaaauucugggggcugcgacgccaucccaggaaagaggguagguccuggaaggagacuacguaauguguuccuucuagcaccauucuccucuuaggagcucaggagcccagccggcuuugauuucaagcuuugaaacugcguuucuuaaccagauuucccaaaucaucccaucaaaauaucucaagccgccgcaagaccagccgcgcacacuuaaaaaaaaaaaaaaaguuucuaaaugggugagauacaguaggugcguuuuacuuaagaucagccuuuccgcccaaggcuggaggggaaagcauucuaaggugcguuacgugcuuggugcuggggcagaucaccggugggugaucuccccucccccacagguuacagguuccaaaaacagccccacccgagcugaagauggccaaaauggcuguagcgcauccucccugccaccucucaguccaaagcgcaggauccgacaucuucccagcuuaggaagugccacgaucuuuggguacaccuuugaaggugucagagugauagccacgaccuccguacucagccugugccuugacccgcuuuaccuuuccucccaagaccacuucuuauugcucucauuccuucucuccugccucuauggccuaggcgcacagucccggaccucuccggacaagucggaucugccuaaccagcugcgcgauaccccgaugugauccuagcugucugccaacccagguagcccagaagggcacccguaaagaacccuauaccaccacugaguguccuccaagcacuauccacuaucaagaaacuccuuucugcgcgggaagguuggcuuuaggacgcacgggagaggugcgcgcgccccuuuucacgaucucaggccuccucgaaccuccagaggugagcgguauuaaccaagacuacuugcacggcguggggggaggcacuggcuccagggucccgcggccccaaauuggccaugccgguacccgauuuccaggcuccgcgccggcugaaugccacgugcgauuuaggcuccagaguugucacccaaucccaaacgcaguuacuuucugcgcauugcaauacuguagcuauggcgcagcagucucagaucgccaaaguuggugcgugcaccuccauaucgagcccagugggcucuaccuaaagccaacuccguugcugaagacuaacuucuguaggaggggagagaacauagaaaacaagugacuuaccuuugccguuuauguauguaacuccaaaccuggggcgcgcugggaauucaguguggcacaccgaauucaauguugcgcaccggguaucagcucggggaccucagguugucuccagcgaggcgccagaaaugccucaccguccaacaaaccuuuggccucccaagcgccccugggugcccuggagagacuugaagagcccucucuccuuuuccggggugcauuucgggcugauuaaugggcaccgcucccuucccaccuugccucccaucugucucuuuccucccacccuacugucucagggaccccaguuuggucagggcaacuaaccuuuauccaugaaaacaaggagaaucuggacggagucacccauuagugacgccggauggggaugggccccuuucugggaggggacuccggggacuggucgcgacggcgggcuggccuccuggucuugcagcggcggggcugccuguuuuccuccuugcgcuccucuggcuccuccucggggucccgaggauccugaucuaagggcccucgcuggggcuccucccccucgcuugcgcucucaggcuccugaguggugggcugcgcacgucucggggaggcgucggcgcucugcaacuucagagcgugcagacgcugagugagugacugguugaagguggcaccccgggggccgcgcucguccucuggcucggucucuggcucgguuucuggcucggucucuggcucggucucgauuucggucucggauucgauaucggacucaggcucggucucagaaucggucucggucucguagucguccugaucguacucuaggcacucggggcgggccagcucaggcucaaccuccucgugcucgugaucagacucagauucagaggacucagggaguaccugugcggcagcugcagcggcagcggagcgguggugggcguuaaggaagcuccggcgcugggcagcacgcugcugggcgcgggcguuggaagaggcuagggcgcggaggagagcaauggagcaggagagccagaggagagcgguggcagcccggcggccuaugggcgggcacaggucguuguaauuauggcgagcucggcgccacugcugagcccgggaccugcgauccauucucuuaggugcucaccgagaagccgacucacccucuggcucugcagagaguggccccacugcgcaaggacuguuggggccgaaaaggauuaaccuuaugaggagagaagcuggggucugaagaccccaaucucgccucggggcaaaaagaagggauguaccuaccuucaaaccacugcgaacuuucuaaagcuccgcgccucagcuuguggcuguaaguaaaagaaagggauggguaaagaagagagaaggagucuccucgaggcuccucucgcuaagucucagacucugaagucuaagacuccgagaggugccuccacugauccucucgucugggagaggauagaggagacugaggagagauggggcaauggggcccuauaaaguugcgcggacuucugccgggcaugugcaguagggagguguuugggggcgggagugccuccccgcgagcugugcguuggcgcauagcucauggcgcagacccuagugggccggcagguggcaggcgggaaccuuguuugaguagauuuggccaaagcaugggggguggggggcuggauaucgaggucuagcgagcgaagggaguaagauagcuacagguuagcggauuuuagaagccaaguauagauucccacgggggguuguccccacuccucaacuuuuucuccaugagcauagccaccaaacaauugaaaaccagaacgcaaaauuguaaauauucaggggaaugaggauccguacgugaaugaguguuaaugaccgaagagcgugaaugcuugaggaucagagccucaaguaaacacuaaccuuaucaaaggugguuacuuuugucagggcuguuaaaguaacuguaauuaauuagagcagccuccaagaagguaugaaccccacuggcaaacaaccccgccccccgcggcuguagauguaggaauuugcaagccgacagucagcucauggugaacacuguuccacugaggugugcuggaagaccauaggaagcugagagugaguauccacgagaaugcccuucaacugcugcucuccguguggguuuuuaggguagucuuugagccacggacucaugcauuucagcugaggguucaaccaacacacuugaguucccggcacucgcggagcucuguucuaggugcugaagauagcgaggaacaggagcaggucuuggauuagagaaaggggucuugagggguuaauauaucuuaaccagagcaucagcucauucuuccagcaucauuacuucaucuagcucacgcuacaugagaaaaacagguacgucagcaagagcaucauggcuagggggcggccagagaccacuggauccugcuguuggacucggaagaacaagguaaaacgaccugcuuguuccagagcgcgcuuggaagagccgauggacucagguagguccaggaggggauggagcccugugggaaguggguguggggcucguuuaucuugccuuuugccuuguuaaauauagaguaccuuaaaaaaaaaaaagcauaacacuagcagaguuguguuauagggaugcaugaagucuuggcaggguguuuuaguuguuggguuuuugguuuugagguuuuuuugauuuguuuuuuacauggaacacaugucacacggugggcuguuugguuuuuuguuuuucccuugaguccaugugaagagucacaagagguacugcugccucuccaagcugcucccccaggguuccuuccuggagguggaauugugaguuaugucuugaagcaggugcugguccuaggucacuuacuuacccucacacacuugcaccucagagucaggcucccagaugcagugucacagacuuagguccuaggugcccugcaugguuggagauuauagaaucucucugucuugacuguuggugcugcaucuuguggucuaggaguucauguacagccuuaaaugcuggugagauagagugggguuggaucagcagaucucaugaacaaauguguggcuguaaucuagauguucugcugacucuuagugcauugcugugacucuugagccccuguuugggguugagaucucagauccuuaucucugccuuuccacccugaugaauggggguaucugagggguccgaccgcuuccauacacuuaaccuuauuuuuuuuuuuuuucaguuaaaacaguucugccaacaucauauggagcacaaagacauuggucuagccaauuuuagggcacacagagagaggaaaacaggacugugggugcugguaaaugcccguuugauggaaacugaugccagcugucagcagugagguggaugaugguuuuuagugugugugggaaagugccucauuuuucaggggaaagcuuuaugcccgugauagagauggcagcccacauccuaugcacuaguacagaaacaccaggacugcccacauuauuaaaaacuaugcauuacauaauacauaucuuggaccaggguucugcauuagcacugcucuuucuugcaagaugcguuugaaucagcuauggacaguuaacaaagcauacgcuuccgagccccggucaucuguacaguuacaaauucauuucagcacgugcucagcacggacuccaggaggagcagggcugcaccaaaagacagcuccaucuugcacuuagugccgagguugagcaaauggaucugcacagaaaaugcucuuuaaaaugcauuaugugcaggacuuuaaaaagugcuugcugcagagugaauuucaaaaggggccaaguaggugaugaacgaccucaguuguuaccagcugggguacaagggguucucuguguuugcagguaaauaaaguguggucauauauuaccuuuagacuuucaggaaggaggcuucuagaccaguugggcaggaaggcaguuuccaguugcuuacaguaucauauagaaggguucuuauuuggauguauugggaagaagauucuuuugagcuuagaggacuguccuguggaaauggcuucacuaguuauuugacauagcuccagggggcaaaaugagggccuagaugggugcuguguacagguaggcuucagcccaaggaggaauauucuagcaaguaggacucugaaggagaauggacucggcgucggcaggagcuaugcuaagucaaaggacagaugacuacauguuagauagagguuuccauggagcuugugaaacugcuagagcuaagacaagguuugaccacggcccucuguaguugcucccccagggcuguaggagagggcuugggguggggguggggguuucaagccucccacucugccucaguuucguucucacuccuggagccaaggugucagucagggccaucuauucauuacauuggccucugggccuccccuccuggagcugucuuggaaauuacaaaauaaaauuggcuauuuaguggucaugaauugagucacuuuuaugaccuagcgcuguuccuagcauuguggagagauggaagucaaugaggaugagcagcagcugcuggccagcgacguggaccaugugagaccacagguaaaguucuuccaguucgucuguuuggcuuuuauuuuucaaacugagaggauugccccuauucuaccuguuugaugugcagagcaacauacugggaaccagugugucacaugagucugggggcuugcaggcuaucgucacagagcuacagguaccagaccuacaauagaggcugggcucugcucugccuggccagcaggcacaagcacucucgaacguggcuuuuagacagucacuggaggggaacaugguuuuuggaaauggagagcuuucuaaacuuuccuuuggagagaaaugaauugagggacuuugaaguauuccccaccucucccuguggcagucagccagaaaugcucaaccaacugagaauuuggcaugggccccuucccuccugugccgcaaguugacgaggcagcauggggacauguggucugucucuccaggugcugcuuugcuguacucagaccacacugaucuuaguugacuaacuguuagaaaugaugaaaacuccaaacuccugauuuuguaauuuagggggaaaggccagcuaaagccaaaaagggggggggggguaucuauaggaugugucuggguucugcccugaccaucauuggguuuaucuguguuguuccugucaggaguaagauggggucagagcugaacccauagacccaccuuuccugcccuccacuguaugcagaucaacacagaaccaacagaaucugucugucccucucuguggagugaguaaugucuacacuugggagguccuucccucacagagcuugcugcacaggcccgcugaaaaguguguguguguccuuguuggguuuuguuuggcccuagagcuuggccuuucugggcucugaugauuguuuuguacuguagaggucagaaaugggcucugccugcuucccagccagacaccaguguguaagaugaguccaggugcuucugaucuuggauaucgucugccucagcuucuaccuagaauggcgucuuggggcagaaacacuguuggcuacucuggacuugcuacccaaaaggcauuacuccuagcuaggcuuuuguucaacuuuucugagcaacucacuccccccuccagccaccauggacagagagccuccuuugccugagguucugagucacccuucagaccugggggagggagccagggagugggcgagccucgagccagaggaaagaagcccuuaguggugucgugguucaggcucgggcucauagaauccuuucagcuugagcucuucaaacgaugauuagaccaauuuuacaugucuagucacugaggccgcaguagauugggacucuuucuauaugugcaaagugaaguggagaauugaggcaauuaucuucaggcaaaugagucuaggcucuguaaucagccuguccugauaacugggcaacaucggccucaugcacagagcuuugcuuugcuuugagguaaagaggauucugaggcauguguucguuucucacuuggcuuuguuuucaaaggcugucugcuggaccucccagcccagcccacccuaugcaggaguugggcugagccccaccccugugggcucagcucaggugugcauauggcugugugaucugucccaggcuccuuuaaccagccucugccaugcuguguuuaccuuucucuggacaccacccugagauccugagccaguuuacugacguacaguguuaggaugacaugauuccuaauggaacuuaugacgacuuugcaugguacacaaugaagcuuaugacuggagugucaucuuagguccagaaaugaaggcaacagucccaguccucccuguugugauuauuaaacccuucauuaauugugagcuuuuucucauacuggcaauggcuacccuccugacccauccaccaccugugagggaagaacccuugcaugguggagcaggaugaaaacguaaaguccuguagucucccguggcuuccuucucugggagccacagucgcaugggaaggcccugugguaguuugggugcccaccgaaaggugugacagagcaggcagaauaugugugggcacagcgucccucccucgcacaacagcacaauuagagaacacugugucuuaaucugcugccuuugacuguaagugcuuuaggaauggaggacuugaaauggacuugggaaagguaaauaggaaaggcugcuuucccuucagagucagaaaauagccaucuuguccccuugacauuuucugaugucucucuuaugaaaaagaaagcggggguaggaggagcaugaaucuugcgucuauccugggcuaaguggguuuugaaggagauuuuugucuccaaggguugacucauccuguggucugcacuuucuuacugugaucuugucuauucccggugaguuuguuagauuguacugucuucccggugugucccucaguugcuuuacagccuguccuucguuguuuuaagaccugcuggacagagccuguggcuuccuccugcacacugcguccucgcucucugagcuuuuugcccauuuauuuuucuauacaaauuuaaaaaccauuuuuaucaaguucuguaauggccuuggugguauuuugccuggaacugcauucagucaauaaauuaaaugaggaagcaccgugaucucgucugcauuuagucuuaagccugaagucuagucucuauguauucaagucuuucccacauuaagaguuuguauuuucuuuauacaauuugaauauaaaauguggcauuugaugcuugaagaaauggcacacauagguuucucaggcauuugauacuuguguugcuuugugaauggguauauuuuucauuggguuuuuaggcuguuuauaauguguuuaugggaugauauugguuuuuguacacuucccucauauucugcuacaucuagaauugucugguggaugaggcuuccaguagcuagcucuccagugcaugcucugcugacuccuggagggagugcggagugcucagcuccuccaccacugaaugcccagcacugcugguaggaagagagacacauagacagggcuuugaguuuucgugccaagacuaauuuagggagggacuaaccuuuacugaggcuaccuaagccucuuuccuaccuuuuagguuuuuauccuauuuuguuuucuagaaggacagaagaugauuauuagaaguuuuauaugguaaguuuuuagauauuuuaaauuaagugggaaauuuuguuuuuaaucaaacugaauucuacuacuccccaaauaauuuaaaagagagcugauauuaagacacaagacaagccuuaacaaauauaggaaaaugaaugaauuucuugugauagacaggugagugaggggcaaaagaggaaaucaagaaaccccaagaagcaaguggaaauaaauacaacaaacauagucacuggcucauaaugaagagguuuccagagcauuuauagaucugagugcuuccuuaaggaaaaggucggcaggcaucagacuaauucagucuccaggacccauguggucaaaagagcugacugaccuuccucaaguuguccuaugauuuccaucgguagguguguauguguguguacagacacacaaaauguuuuuuaaagccccacgaaauucugaacaaacagcucacugaagacgaacaguugaaccaagcugaguaaccugcagacaggugucucagggcagaagccaacaucgaggggaaaaaaaaaaaaacaaagaaucaauggaagaaagagcuggaucguugaaaagaugaguaagauuggcaggcuuuuaaccaaauuaacccaaagaugaguaagauuggcuuuuaaccaaacuaacccaaagaaaaggauaaagagcaggcuaguaauuagccaggaaggugacauuacaucuaauugugugcauccugugacagcagaagugacaaaggcggcaaacacauaauuccggaagcaaauagaguccacuaaacuaggaaauacaaagaaagugguuugaaauuuucuuuuugaauacaaaauuuugaauuuguauugcaugugacugaccaacgucaaacccagaugagguaaauaauuuaaacaaaucuauagcgaguggugauguuggugcgguaauaauaaucuccugacucagaaacaauuaggcuuagauagauucacugugcauaugaccagaccuaacacaagaaccaagcaccaggacuuaccgcauuccuccauggaacaggguaggcaggaacauuaccaagcucccuuuuaagaaaccaguauucuucacauaccaaguuggccacaggaacacacacaaauuauagaccaauuuuacacaggaauaaaaaugccuaacaaaauacucagaggggccagugggauggcuuaguggguaagccugcugccaagccugaagaccuagccacccacccauguauacuggaaggggagagcugaauccuacaacuuguucugugguccuuccuccaugagccauggcacaggcacaccccacauguaauacccaaguauacuuuuaaaacuuuaaaaccauauuuuaaaaaaaaagauaucacaauuucauagacuucacuucagggaaguagggguaauuaaagacaugcacagaguauuuuaagugugugacaucacagaaaugaacucccaaggccauuucauaaacucucaacaucccuuuguaauaaacuccuugaaccagccagaagcagcuguguguaguguaacaaaggccauagaugacagaucugcagccagcauucuacuacguggggacaaaucagaaccuccauuauggucuaggccaagagcaacgagagcagagaagcaagcacaagcauggcucauggagaggaggaaguggaagcauucuuagcagaugacaugguuccacacagaagaccuuagcccaggggaaacccugagaaccaacacugucagcacaggacaggacagucacaaaccugacacaucaugugcuccagcaacagacccaaggagaccagagaaauggucucuucgaguugcuuccaaaacaaaacaaaucagcccuugcaauaggcuuuuuuuuuuuuuuuuuuuagguaauuuuuguuuugcuuaacaccauagauuucuuuugaaauuuuaucaucauaaaaucucaggguaggaccucucagcucagugugcucuuggguagaguucagccuuugguaggccugagcgucuuuuacuguaaaauuguuuucaugucauucuucugguuuguucucauccagcagucgguugucaacuuguggauuguaugcgauccuguuagggucaaagggcccuuuuagggucacacaagaccaucggaaagaauguagauauuuacauuaugauucauaacagcagagugauaguuauaaaggagcaaugaaaauaauguuaugacuuggauaagcacagcaugaggaacuguguaaaaggguugcaaaguuaagguugagagcggcugcucuagucaguuggaugccaucuaguuaggcuucugcuuuuauucuucugaguuuuuucuaauuacuucacccuuaauuuaugacucacuguguuuucugaaauuacacaagagaggagcagucuuguuugacuugcuuuuuaaagagcuuuuucucuccagucacugcuuucugcguguuaggugguugguguuagcauugaugcugggaacgggggcgguaaugccuauaaagguguuaagcccauggccgagguggugggaagggaaggggacuuaaucaucuuggguagaaagagccccaacggucagacccagccaagcugcauugugucugugugaaauacaacucuaauuuccuuucaguggguuugcuuguuuuugagacaagauaggccauggaauagagagaacccagagugagguuggaugguggucgucuguuguagagccugccucccuacucuucuugucggggcaucaugcugcagaguggcuuaugcaugccaaggugcuacagagccuccaaaggagcagugguuuauuucuagggcacacagcacagggagcuaaccgauacuuggauauaccaggagaugccuuccugggaauguguccugugcacuugagcugaggcugaaggcugauccugugguggcaggggugguacaggcagucagcaggauugugggacagcgggaugagucugggaguguuguugagugguaggaagcccuuacccugggaccaggaggugccuaaucaaguuuguuucaaagcucuuaucugguaccagguuuaagagauaaaugggaaaaccagaguugguggugacuacagaaauauaugagaugggaggugguaagagagcuucagugacuaaugcagaagccagccacaaagcuugaggacaacaucccaacacccauguugggauggaucuguguauccuucauugagugagagaaauagggaacacagcugguugugugauagcacuccaaguucccacaugcugagcauccuucugcacuaaccugugggguucgaaguagucuugggccccacaggaaaaggcaucagaugcugcagaguuucagucuggcccuugauggagagaaguaggaaagccggugccaaggaacccaccuuugcgugcuccacauuacuucuggcuuguuggucuugcaaguucuagaacuagaagagaccagagagacccagccuuagccacccucaguuuacaaguaaggacacaggcugggagagggaagggagggagggucuuagagucuaggaaagccagcacgugagcucaguuugcauagucugaacucucucucagauuuuaaugcaccacaggaagaguggcccagcacucagaugccagcccucuugacaucagaucuauuucuuucuacaaccaaauggacacuugacaguuccacauucuuuucuugaucacuucagugcugacauuccacuggcuccuuuuugaaaaggcaggaacuuagaagugccuuggaggcuagaaauagaacuauacuaugccccaguagucaagccuggccaagucuacacaaggccagaaggacuuggccaaggcaaaagcugauguaguucggugguguacuuuuucugcugguuauucaaaagucuauccaucuccuaaagcucccaugauuacuuaaaccucgcaccagacaguggagguacaaaaaggcgagccugcugugucucaagaugucugcuccaugaacccauggcagacuagaagcuccacuggguauaugugguugucuaaaugauauguacuaucuaauaacuucacaaaaaccacauagagcuaaggcuuaagucacuuugugcucagagucucugcgugggagagggcugggauuguuuuccuugcuuguggggcuagggcgugaccuuggcuuaaucacucuuugcccaucagagagguagguuaaugucagcaaacaguauuucugagcuuugcugugaauggaaagugaggaaggacuuggaggaguggguagugguggggucuagggaaggaacggggagcucuagguuguggguucauuuucuuuagucuggggggugaccggacuuguacaaggccauuugccaaccuugguggugacuccuaaagagcucacucggaucacaggcacucaccccuccuuuaauagcaccaaagcccaaaagagacccccccucuucuaauccuggaucuagacauuugaagcuaggaauggccacaauuuaaagaaugcgcucaaguuuagaagucaagguccuuguccccagccccaccugcugccucuccccuggcauuguugaguuagucacaguguaaguagaguagugguggucauuacagacgacuauugucguauugcucucagugcauuuaacagaguaagcugccuguuccauaaccccuuugcuuucuccuagacaggguuucacucuguagccccggcuaucacaugcucacuuuguagaccaggcuggccuugaacucagagaucugcccuccucuaccuacccagugcuggauuaaagauuuaugccaccauacccagacugauuuuuuuuuaauugacuuaugcguggugguagugggggugggggcacacauguacagaggucacaggacaguuguggguuuuggaaauggagcucaaguucucaacagcagagcagacaucgauccugucccccugccagccgccuccugacgcccagcggggauguuaacgcucuggggaagaggagacggauucuaguucuaauaaguugaauugcaaccaggauaaauggcuugggccuauuuucuuuccuugacauuugccuccuaauaauacauggaagaagacauugucuugagggacuuggcugugacauuuaccaucuuuggacacguuuacuuugcagaggaagcagccuuuaucauaaaaugcuugaccuguggccuuuggcuucagggagcugcuuccuagauuccuugggccaggaaaggcccugcuuccagccagagccuuuacaugagucuuucaaaauauuuccagaauccuauuuucauguacacauucuuacgccuauuaaggcgguuuuuaaguauaccaaguacaggugaggcuagcaagcccaggugauggcugugcaucuccccuggagccuuucaagguauagaaagcacgaagcucccuugguagucugggacaacagugacuuuccuuauccuccaguuaauggucuuuugguucuuuggauaaguagaagccacccucagccaggcggcgguggcgcacaccuuuaaucccagcacuugggaggcagaggcagguggauuucugaguucgaggccagccuggucuacagagugaguuccaggacagccagggcugcacagagaaacccugucucggaaaaaaaaaaaaaaaaaagcagaacccaccuucucuguccccuagagagaaaguagggagcauuugagcagccgccccauguuccuugugaggugccaucucccaggaugggaacugccuugggccucaagugcagauaaaagccuuaagagcucccuguagcuaccccuuggacagccuccagauuggucuuuggcagucucuguuuuuuccaaggccaagucaauguauguucaguagcaggcaccaggcacauccagcucugcccuuuugggaagaaugugugguggggacacuuggaguccaccuaaugacaguugucgcuaucuguguggaaagauuuuguccuagccaguugcuaggccucuuuguauuauauuaauagcagggccauggggucuacugggguuggaagccaaggagaagaggacagcuguggcggacaucacaccaugcucuaggcaugugcucccauaucacaggcacacagauggccuacaccuuguccugccgcucaaaacgcccccaguccccugccuggcuucuccuuauaggggcaggaaugggcuugugugggccauccgugaggugaaggagccaaauuaagaaagccugacuggaaagggguuugacuggccugagcugucagucaacaagcaagugugcugggggccaggcauguggagccaaggaaggcagcaguagcccgacaacugcgagcauuggcuccuguguggcuuuaaaugucacaggccaaaugguugcucaguuggcagcaggguggagggagggggcuuggaggaugcauucgcuaugacuagauauggucagaauuagggacugaacaaugcccggucugagaagaggagccaugagaacaacgaauaacccggagacagggacagaugaggaguaggagcuggggccaagug

SEQ ID NO: 3 - RNA, 82424 nt, Mus musculus
aagacccucccucccuucccucucccagccuguguccuuacuuguaaacugaggguggcuaaggcugggucucucuggucucuucuaguucuagaacuugcaagaccaacaagccagaaguaauguggagcacgcaaagguggguuccuuggcaccggcuuuccuacuucucuccaucaagggccagacugaaacucugcagcaucugaugccuuuuccuguggggcccaagacuacuucgaaccccacagguuagugcagaaggaugcucagcaugugggaacuuggagugcuaucacacaaccagcuguguucccuauuucucucacucaaugaaggauacacagauccaucccaacauggguguugggauguuguccucaagcuuuguggcuggcuucugcauuagucacugaagcucucuuaccaccucccaucucauauauuucuguagucaccaccaacucugguuuucccauuuaucucuuaaaccugguaccagauaagagcuuugaaacaaacuugauuaggcaccuccuggucccaggguaagggcuuccuaccacucaacaacacucccagacucaucccgcugucccacaauccugcugacugccuguaccaccccugccaccacaggaucagccuucagccucagcucaagugcacaggacacauucccaggaaggcaucuccugguauauccaaguaucgguuagcucccugugcugugugcccuagaaauaaaccacugcuccuuuggaggcucuguagcaccuuggcaugcauaagccacucugcagcaugaugccccgacaagaagaguagggaggcaggcucuacaacagacgaccaccauccaaccucacucuggguucucucuauuccauggccuaucuugucucaaaaacaagcaaacccacugaaaggaaauuagaguuguauuucacacagacacaaugcagcuuggcugggucugaccguuggggcucuuucuacccaagaugauuaaguccccuucccuucccaccaccucggccaugggcuuaacaccuuuauaggcauuaccgcccccguucccagcaucaaugcuaacaccaaccaccuaacacgcagaaagcagugacuggagagaaaaagcucuuuaaaaagcaagucaaacaagacugcuccucucuuguguaauuucagaaaacacagugagucauaaauuaagggugaaguaauuagaaaaaacucagaagaauaaaagcagaagccuaacuagauggcauccaacugacuagagcagccgcucucaaccuuaacuuugcaacccuuuuacacaguuccucaugcugugcuuauccaagucauaacauuauuuucauugcuccuuuauaacuaucacucugcuguuaugaaucauaauguaaauaucuacauucuuuccgauggucuugugugacccuaaaagggcccuuugacccuaacaggaucgcauacaauccacaaguugacaaccgacugcuggaugagaacaaaccagaagaaugacaugaaaacaauuuuacaguaaaagacgcucaggccuaccaaaggcugaacucuacccaagagcacacugagcugagagguccuacccugagauuuuaugaugauaaaauuucaaaagaaaucuaugguguuaagcaaaacaaaaauuaccuaaaaaaaaaaaaaaaaaaagccuauugcaagggcugauuuguuuuguuuuggaagcaacucgaagagaccauuucucuggucuccuugggucuguugcuggagcacaugaugugucagguuugugacuguccuguccugugcugacaguguugguucucaggguuuccccugggcuaaggucuucuguguggaaccaugucaucugcuaagaaugcuuccacuuccuccucuccaugagccaugcuugugcuugcuucucugcucucguugcucuuggccuagaccauaauggagguucugauuuguccccacguaguagaaugcuggcugcagaucugucaucuauggccuuuguuacacuacacacagcugcuucuggcugguucaaggaguuuauuacaaagggauguugagaguuuaugaaauggccuugggaguucauuucugugaugucacacacuuaaaauacucugugcaugucuuuaauuaccccuacuucccugaagugaagucuaugaaauugugauaucuuuuuuuuuaaaauaugguuuuaaaguuuuaaaaguauacuuggguauuacauguggggugugccugugccauggcucauggaggaaggaccacagaacaaguuguaggauucagcucuccccuuccaguauacauggguggguggcuaggucuucaggcuuggcagcaggcuuacccacuaagccaucccacuggccccucugaguauuuuguuaggcauuuuuauuccuguguaaaauuggucuauaauuuguguguguuccuguggccaacuugguaugugaagaauacugguuucuuaaaagggagcuugguaauguuccugccuacccuguuccauggaggaaugcgguaaguccuggugcuugguucuuguguuaggucuggucauaugcacagugaaucuaucuaagccuaauuguuucugagucaggagauuauuauuaccgcaccaacaucaccacucgcuauagauuuguuuaaauuauuuaccucaucuggguuugacguuggucagucacaugcaauacaaauucaaaauuuuguauucaaaaagaaaauuucaaaccacuuucuuuguauuuccuaguuuaguggacucuauuugcuuccggaauuauguguuugccgccuuugucacuucugcugucacaggaugcacacaauuagauguaaugucaccuuccuggcuaauuacuagccugcucuuuauccuuuucuuuggguuaguuugguuaaaagccaaucuuacucaucuuuggguuaauuugguuaaaagccugccaaucuuacucaucuuuucaacgauccagcucuuucuuccauugauucuuuguuuuuuuuuuuuuccccucgauguuggcuucugcccugagacaccugucugcagguuacucagcuugguucaacuguucgucuucagugagcuguuuguucagaauuucguggggcuuuaaaaaacauuuugugugucuguacacacacauacacaccuaccgauggaaaucauaggacaacuugaggaaggucagucagcucuuuugaccacauggguccuggagacugaauuagucugaugccugccgaccuuuuccuuaaggaagcacucagaucuauaaaugcucuggaaaccucuucauuaugagccagugacuauguuuguuguauuuauuuccacuugcuucuugggguuucuugauuuccucuuuugccccucacucaccugucuaucacaagaaauucauucauuuuccuauauuuguuaaggcuugucuugugucuuaauaucagcucucuuuuaaauuauuuggggaguaguagaauucaguuugauuaaaaacaaaauuucccacuuaauuuaaaauaucuaaaaacuuaccauauaaaacuucuaauaaucaucuucuguccuucuagaaaacaaaauaggauaaaaaccuaaaagguaggaaagaggcuuagguagccucaguaaagguuagucccucccuaaauuagucuuggcacgaaaacucaaagcccugucuaugugucucucuuccuaccagcagugcugggcauucagugguggaggagcugagcacuccgcacucccuccaggagucagcagagcaugcacuggagagcuagcuacuggaagccucauccaccagacaauucuagauguagcagaauaugagggaaguguacaaaaaccaauaucaucccauaaacacauuauaaacagccuaaaaacccaaugaaaaauauacccauucacaaagcaacacaaguaucaaaugccugagaaaccuaugugugccauuucuucaagcaucaaaugccacauuuuauauucaaauuguauaaagaaaauacaaacucuuaaugugggaaagacuugaauacauagagacuagacuucaggcuuaagacuaaaugcagacgagaucacggugcuuccucauuuaauuuauugacugaaugcaguuccaggcaaaauaccaccaaggccauuacagaacuugauaaaaaugguuuuuaaauuuguauagaaaaauaaaugggcaaaaagcucagagagcgaggacgcagugugcaggaggaagccacaggcucuguccagcaggucuuaaaacaacgaaggacaggcuguaaagcaacugagggacacaccgggaagacaguacaaucuaacaaacucaccgggaauagacaagaucacaguaagaaagugcagaccacaggaugagucaacccuuggagacaaaaaucuccuucaaaacccacuuagcccaggauagacgcaagauucaugcuccuccuacccccgcuuucuuuuucauaagagagacaucagaaaaugucaaggggacaagauggcuauuuucugacucugaagggaaagcagccuuuccuauuuaccuuucccaaguccauuucaaguccuccauuccuaaagcacuuacagucaaaggcagcagauuaagacacaguguucucuaauugugcuguugugcgagggagggacgcugugcccacacauauucugccugcucugucacaccuuucggugggcacccaaacuaccacagggccuucccaugcgacuguggcucccagagaaggaagccacgggagacuacaggacuuuacguuuucauccugcuccaccaugcaaggguucuucccucacaggugguggaugggucaggaggguagccauugccaguaugagaaaaagcucacaauuaaugaaggguuuaauaaucacaacagggaggacugggacuguugccuucauuucuggaccuaagaugacacuccagucauaagcuucauuguguaccaugcaaagucgucauaaguuccauuaggaaucaugucauccuaacacuguacgucaguaaacuggcucaggaucucagggugguguccagagaaagguaaacacagcauggcagaggcugguuaaaggagccugggacagaucacacagccauaugcacaccugagcugagcccacagggguggggcucagcccaacuccugcauagggugggcugggcugggagguccagcagacagccuuugaaaacaaagccaagugagaaacgaacacaugccucagaauccucuuuaccucaaagcaaagcaaagcucugugcaugaggccgauguugcccaguuaucaggacaggcugauuacagagccuagacucauuugccugaagauaauugccucaauucuccacuucacuuugcacauauagaaagagucccaaucuacugcggccucagugacuagacauguaaaauuggucuaaucaucguuugaagagcucaagcugaaaggauucuaugagcccgagccugaaccacgacaccacuaagggcuucuuuccucuggcucgaggcucgcccacucccuggcucccucccccaggucugaagggugacucagaaccucaggcaaaggaggcucucuguccaugguggcuggaggggggagugaguugcucagaaaaguugaacaaaagccuagcuaggaguaaugccuuuuggguagcaaguccagaguagccaacaguguuucugccccaagacgccauucuagguagaagcugaggcagacgauauccaagaucagaagcaccuggacucaucuuacacacuggugucuggcugggaagcaggcagagcccauuucugaccucuacaguacaaaacaaucaucagagcccagaaaggccaagcucuagggccaaacaaaacccaacaaggacacacacacacuuuucagcgggccugugcagcaagcucugugagggaaggaccucccaaguguagacauuacucacuccacagagagggacagacagauucuguugguucuguguugaucugcauacaguggagggcaggaaaggugggucuauggguucagcucugaccccaucuuacuccugacaggaacaacacagauaaacccaaugauggucagggcagaacccagacacauccuauagauaccccccccccccuuuuuggcuuuagcuggccuuucccccuaaauuacaaaaucaggaguuuggaguuuucaucauuucuaacaguuagucaacuaagaucaguguggucugaguacagcaaagcagcaccuggagagacagaccacauguccccaugcugccucgucaacuugcggcacaggagggaaggggcccaugccaaauucucaguugguugagcauuucuggcugacugccacagggagagguggggaauacuucaaagucccucaauucauuucucuccaaaggaaaguuuagaaagcucuccauuuccaaaaaccauguuccccuccagugacugucuaaaagccacguucgagagugcuugugccugcuggccaggcagagcagagcccagccucuauuguaggucugguaccuguagcucugugacgauagccugcaagcccccagacucaugugacacacugguucccaguauguugcucugcacaucaaacagguagaauaggggcaauccucucaguuugaaaaauaaaagccaaacagacgaacuggaagaacuuuaccuguggucucacaugguccacgucgcuggccagcagcugcugcucauccucauugacuuccaucucuccacaaugcuaggaacagcgcuaggucauaaaagugacucaauucaugaccacuaaauagccaauuuuauuuuguaauuuccaagacagcuccaggaggggaggcccagaggccaauguaaugaauagauggcccugacugacaccuuggcuccaggagugagaacgaaacugaggcagagugggaggcuugaaacccccacccccaccccaagcccucuccuacagcccugggggagcaacuacagagggccguggucaaaccuugucuuagcucuagcaguuucacaagcuccauggaaaccucuaucuaacauguagucaucuguccuuugacuuagcauagcuccugccgacgccgaguccauucuccuucagaguccuacuugcuagaauauuccuccuugggcugaagccuaccuguacacagcacccaucuaggcccucauuuugcccccuggagcuaugucaaauaacuagugaagccauuuccacaggacaguccucuaagcucaaaagaaucuucuucccaauacauccaaauaagaacccuucuauaugauacuguaagcaacuggaaacugccuuccugcccaacuggucuagaagccuccuuccugaaagucuaaagguaauauaugaccacacuuuauuuaccugcaaacacagagaaccccuuguaccccagcugguaacaacugaggucguucaucaccuacuuggccccuuuugaaauucacucugcagcaagcacuuuuuaaaguccugcacauaaugcauuuuaaagagcauuuucugugcagauccauuugcucaaccucggcacuaagugcaagauggagcugucuuuuggugcagcccugcuccuccuggaguccgugcugagcacgugcugaaaugaauuuguaacuguacagaugaccggggcucggaagcguaugcuuuguuaacuguccauagcugauucaaacgcaucuugcaagaaagagcagugcuaaugcagaacccugguccaagauauguauuauguaaugcauaguuuuuaauaaugugggcaguccugguguuucuguacuagugcauaggaugugggcugccaucucuaucacgggcauaaagcuuuccccugaaaaaugaggcacuuucccacacacacuaaaaaccaucauccaccucacugcugacagcuggcaucaguuuccaucaaacgggcauuuaccagcacccacaguccuguuuuccucucucugugugcccuaaaauuggcuagaccaaugucuuugugcuccauaugauguuggcagaacuguuuuaacugaaaaaaaaaaaaaauaagguuaaguguauggaagcggucggaccccucagauacccccauucaucaggguggaaaggcagagauaaggaucugagaucucaaccccaaacaggggcucaagagucacagcaaugcacuaagagucagcagaacaucuagauuacagccacacauuuguucaugagaucugcugauccaaccccacucuaucucaccagcauuuaaggcuguacaugaacuccuagaccacaagaugcagcaccaacagucaagacagagagauucuauaaucuccaaccaugcagggcaccuaggaccuaagucugugacacugcaucugggagccugacucugaggugcaagugugugaggguaaguaagugaccuaggaccagcaccugcuucaagacauaacucacaauuccaccuccaggaaggaacccugggggagcagcuuggagaggcagcaguaccucuugugacucuucacauggacucaagggaaaaacaaaaaaccaaacagcccaccgugugacauguguuccauguaaaaaacaaaucaaaaaaaccucaaaaccaaaaacccaacaacuaaaacacccugccaagacuucaugcaucccuauaacacaacucugcuaguguuaugcuuuuuuuuuuuuaagguacucuauauuuaacaaggcaaaaggcaagauaaacgagccccacacccacuucccacagggcuccauccccuccuggaccuaccugaguccaucggcucuuccaagcgcgcucuggaacaagcaggucguuuuaccuuguucuuccgaguccaacagcaggauccaguggucucuggccgcccccuagccaugaugcucuugcugacguaccuguuuuucucauguagcgugagcuagaugaaguaaugaugcuggaagaaugagcugaugcucugguuaagauauauuaaccccucaagaccccuuucucuaauccaagaccugcuccuguuccucgcuaucuucagcaccuagaacagagcuccgcgagugccgggaacucaaguguguugguugaacccucagcugaaaugcaugaguccguggcucaaagacuacccuaaaaacccacacggagagcagcaguugaagggcauucucguggauacucacucucagcuuccuauggucuuccagcacaccucaguggaacaguguucaccaugagcugacugucggcuugcaaauuccuacaucuacagccgcggggggcgggguuguuugccagugggguucauaccuucuuggaggcugcucuaauuaauuacaguuacuuuaacagcccugacaaaaguaaccaccuuugauaagguuaguguuuacuugaggcucugauccucaagcauucacgcucuucggucauuaacacucauucacguacggauccucauuccccugaauauuuacaauuuugcguucugguuuucaauuguuugguggcuaugcucauggagaaaaaguugaggaguggggacaaccccccgugggaaucuauacuuggcuucuaaaauccgcuaaccuguagcuaucuuacucccuucgcucgcuagaccucgauauccagccccccaccccccaugcuuuggccaaaucuacucaaacaagguucccgccugccaccugccggcccacuagggucugcgccaugagcuaugcgccaacgcacagcucgcggggaggcacucccgcccccaaacaccucccuacugcacaugcccggcagaaguccgcgcaacuuuauagggccccauugccccaucucuccucagucuccucuauccucucccagacgagaggaucaguggaggcaccucucggagucuuagacuucagagucugagacuuagcgagaggagccucgaggagacuccuucucucuucuuuacccaucccuuucuuuuacuuacagccacaagcugaggcgcggagcuuuagaaaguucgcagugguuugaagguagguacaucccuucuuuuugccccgaggcgagauuggggucuucagaccccagcuucucuccucauaagguuaauccuuuucggccccaacaguccuugcgcaguggggccacucucugcagagccagagggugagucggcuucucggugagcaccuaagagaauggaucgcaggucccgggcucagcaguggcgccgagcucgccauaauuacaacgaccugugcccgcccauaggccgccgggcugccaccgcucuccucuggcucuccugcuccauugcucuccuccgcgcccuagccucuuccaacgcccgcgcccagcagcgugcugcccagcgccggagcuuccuuaacgcccaccaccgcuccgcugccgcugcagcugccgcacagguacucccugaguccucugaaucugagucugaucacgagcacgaggagguugagccugagcuggcccgccccgagugccuagaguacgaucaggacgacuacgagaccgagaccgauucugagaccgagccugaguccgauaucgaauccgagaccgaaaucgagaccgagccagagaccgagccagaaaccgagccagagaccgagccagaggacgagcgcggcccccggggugccaccuucaaccagucacucacucagcgucugcacgcucugaaguugcagagcgccgacgccuccccgagacgugcgcagcccaccacucaggagccugagagcgcaagcgagggggaggagccccagcgagggcccuuagaucaggauccucgggaccccgaggaggagccagaggagcgcaaggaggaaaacaggcagccccgccgcugcaagaccaggaggccagcccgccgucgcgaccaguccccggaguccccucccagaaaggggcccauccccauccggcgucacuaaugggugacuccguccagauucuccuuguuuucauggauaaagguuaguugcccugaccaaacuggggucccugagacaguagggugggaggaaagagacagaugggaggcaaggugggaagggagcggugcccauuaaucagcccgaaaugcaccccggaaaaggagagagggcucuucaagucucuccagggcacccaggggcgcuugggaggccaaagguuuguuggacggugaggcauuucuggcgccucgcuggagacaaccugagguccccgagcugauacccggugcgcaacauugaauucggugugccacacugaauucccagcgcgccccagguuuggaguuacauacauaaacggcaaagguaagucacuuguuuucuauguucucuccccuccuacagaaguuagucuucagcaacggaguuggcuuuagguagagcccacugggcucgauauggaggugcacgcaccaacuuuggcgaucugagacugcugcgccauagcuacaguauugcaaugcgcagaaaguaacugcguuugggauugggugacaacucuggagccuaaaucgcacguggcauucagccggcgcggagccuggaaaucggguaccggcauggccaauuuggggccgcgggacccuggagccagugccuccccccacgccgugcaaguagucuugguuaauaccgcucaccucuggagguucgaggaggccugagaucgugaaaaggggcgcgcgcaccucucccgugcguccuaaagccaaccuucccgcgcagaaaggaguuucuugauaguggauagugcuuggaggacacucaguggugguauaggguucuuuacgggugcccuucugggcuaccuggguuggcagacagcuaggaucacaucgggguaucgcgcagcugguuaggcagauccgacuuguccggagagguccgggacugugcgccuaggccauagaggcaggagagaaggaaugagagcaauaagaaguggucuugggaggaaagguaaagcgggucaaggcacaggcugaguacggaggucguggcuaucacucugacaccuucaaagguguacccaaagaucguggcacuuccuaagcugggaagaugucggauccugcgcuuuggacugagagguggcagggaggaugcgcuacagccauuuuggccaucuucagcucggguggggcuguuuuuggaaccuguaaccugugggggaggggagaucacccaccggugaucugccccagcaccaagcacguaacgcaccuuagaaugcuuuccccuccagccuugggcggaaaggcugaucuuaaguaaaacgcaccuacuguaucucacccauuuagaaacuuuuuuuuuuuuuuuaagugugcgcggcuggucuugcggcggcuugagauauuuugaugggaugauuugggaaaucugguuaagaaacgcaguuucaaagcuugaaaucaaagccggcugggcuccugagcuccuaagaggagaauggugcuagaaggaacacauuacguagucuccuuccaggaccuacccucuuuccugggauggcgucgcagcccccagaauuuaagugagggugggcugugcgcacugcggcuaauugcgacuuuggucaacagcaggaagcaguuuguuagcaguggguagagaaugagccgguagcuugcggaaaggaggcgggggcuuuuggguugaaagcgugaaauugccuaagugagacauuauuuuuccuaaguuaaaaugcucggcaacgaaaaagaugacgugacguuuucuugacguuagguaccuuuaugucuuguaauguagccugaguuuaccaagcaacagguuucuaguuaacagguggagaagccgcacuuuuuuuucagcaguuagauuuuuuuuucauuagcuaaaaauuaggaugcugccuuguugcugggauaaauaaaaauuuaaaagugucuccaguuucuauaaccaccaccucacgcuguucuuauagaagccuagagccuggcaagguggugcaaaccucuaaucucagcgggggucggguggggauggggaggcagguggaucucugugaguucuaggccagccugcucuacagagcaaguucccgaacugccaggacugcacagagaaaccccguuuccgggaaaaaacaaaaacaaacacccucuccccccgccaacaaaccaaauuuaaaaacaacacaacaauagcuacaaaagaagcccaagugagcaguguaagagaggcucauacccgggguauucaaacaggaacgcgcauuuugcuuucuauuaguaaccuugcacugucuaccugagucacagcagacgcuuuaguccagccugcuaccggcccgcacaacccuccccucccucucagcaccucccccucccuagcgccauccugacuccagguaaaaaaaccucggcgggcuauauaggagcacaccacccuugggagagccccaccacccacacaagagguuuugauaaaacacccaucccaaggccauuuucugugaaauaguucauucgcucacuaggcucaggauuuuacuuuuccagggcuuuucuagcagguccucaaacaucccuaacuagcccuuugucucacccuguuaaagcgggguuagcauuugaauggacuggcaagcccuuucccuccguagguagacuggcugagggagaugcacgugggacaagugggggucggugacaaagcuaguuaaacugccuuccaagagcuuuuggaucuuuagcugcauuaaucguuugcuuaaugggaaaacuuccuucugugguggaagggugcgauuauugagugucuuuuaagugauuuucuuuuuuaaaauuauguggcaauguucaaauaccgugugguggcaaaugccagauguaaguacuguuuaguuuaucaguaaaacuuuuaauuuuauuugugagaauuggagaaugagaugggagguguaaacucuaggauugauuuguaaguguguuuuuuuguuugcuuuuuuaugugccugaagccuuuuauccucugggauugcuuacaaccuuugacucuuuagccuacauuuuagcagcuguguccccuuaacgagaaacuugaaacaucagaacugguaagaauaaaguuuuuuuuuuuuaauggauuuacuuaauuucuccuuuugucaugucaaaagaaaagaggaugaggaaacugagcagagacaacggugugggggcaagcaggacagcagcccaucacaaaagcaacaaaagcaagucaugauaaucaauuguucagggccagagaccagugaugucaccuuguuagcucaaauacugcuuccucugaagucccacuuaguaacaagaugagaaacucaggccauaccuuugaucccgugcuccacaugagggaaggaauguccuguugugggguuuggccacuaauuaaccuaacucccaaacccagacagaaugagaaaccagcagacugagacaaaaggcauaagauacugggugagcccagggugccucuuucccaccuugcugacugccuccggucuucccucacaccccucugccucaguuucuucuuaaagugugcuagcagaacaaaaucguucucucucuggugucagaagggcagagccgcaccucuagcuccagcgacguucccaaaucucaaauguuugacuaaauaaaaagcacuaacugugaagaaguguguuuguguugucaagacucacugcguccaguccugggggcgggguuggggagugugagcgagcacuccuaagagcaccuaucaaugcuauguugugcuguucccgaauucucccccugugguuagugucuagaaugaaccuuccagaacccaguugguacaagcccauuagggaugcuagcuacgaaauaugggagacagcaagcugacaguacagguuaaguaauggcuuagaggcucuagauaguugggauaaacggggaaguguuucaccuccuguccauuaucauucccucccaggggcuuuuuuuccagccauauccagccagugguuccugucuccaguuuuaguacucacaucuuuuuauaugcugcaaggccugguaauagcuaagcucacucucacacacaccacaaacaugcacacacguaucaaacacaugcacguacucauacaaacacaccagacacucaauacucauaccccagauaccucucacaugcacaaacaccacacucauccacacacauacccgacacaugcaccuacucauccacaaacacgacagacacucaugcucacacacaagcacacacucauccacacacauacccgacacaugcaccuacucauccacaaacacacgacagacacucaugcucacacacaagcacacacucauccacacacacacacacacaaacaucacagucauacaccacacacacucacaagcacaccagacauacucauacacacacacucauacacacaagcacacccacaauuauacacacaccagacacucauauacaaauguacccacucauacacauaaacacagccacucacacaagcacaccauacucauacacacacaaacacacccacacucacucccccauauguauguauacauacauacacacacacacacaccagacacacacaagcaagcacaccacacucauacacacccacacucauaugcacagcagacauacaccacacacucacccccagacacaaacacacagccaaauuuggcuccacugcugaggcaaacaaagcaaacacuucucccaauaaucggcucugcaaauugacuuuuuauugaccauuuauuuauuucauguuuuaaccccuuuggggcauuuaaaaauuuggucuaauuuuacuaguguuuguuuucuccaagucuccuagauagggagccccagcccagccaugaagcagaacagcuggcauggugaggaccagaggacagacauagccuagugacuuggauccccugagugcaggugucugcagugcagagcaacaucacuuauugauagugcucagccacagaggcgggaggccccaggggagcucaaaugugcacauuccuauguuuuuuccuaugagccuauuuuaggguaaacauguuacacacuagcaaggggauguggcugccccaaggugaggggagcaaaaaggguuguggggacccagggaguaaaagaacaugcuauggaggcccgggaaggagcacacagccaacacauuucaugggugcacaaaagcacuuugaagagauagggaaucaaaccauugaggacacaccaacuauggcaggcugaagagggaggaugggaccaggugcaacaaggagcaucgacaccucagggugaggaagaguauuuuuaauagccaaagauggacacuagaggagaauuucagaucagucacccuugaggucaccaucccagucuuauagaccuagcuggggaauuucaacuucagcucuacagaauggaguucucauaaggauaccucaaauucauuaaccaaaaagacuuaagagcuacuaaccuuacuuaaugguuuuuaaagcauuggguuuugacucaagaagaccagccucugaggcucccauuccuauggcacaggaaugcaggaaugugggccuagaguccacaggcuucucccucccgcaggcaauacccggcugauucuccuggcuuaugugucuguuucaauuagacuucauuaggaaaauuugcuuuggaugauugagguugccugaaaaggugaacaacacaauccccucaaauucaaauaauauucaggccccgaagccccugggugccuacaauucccaccaugaguuacagaaaucuuacauagccuuucuauuaaaucuaaccgccuucugggaucccagcccccacuccuuccaccccagcccgccccuccggcagacaccuccccugauuguuucucucaucugcaacaggcacuucucccucguggauucagcugcauucucagcuguucauguggacaccuugugcaggcacagguggcaggagcauggcaagcuaaggcacaauuugguggcucuuccacaaagaaagccauugauaucaagccacugcuaauaagccugagggaggggccugcccuuuaucguggcuuuucauccagaguugaccagcuguauucauaaauaucauuucaucccccuaacaugagccccacaucagucccuaguccaguaucuugcccuaucugcuagagacaucuucccuuuaauuagcauuugucucaaacaggccagccacacagccccuucugcagagcugcugccuccaccggccaaggcuugcagagaugauggcagggagguggggggagggcugcagcagucuuaauugaacaguaauuaauugaacagcuucaaagucuuauugcuacucagggaaacacucagaaaaccuuugucauugggaggcugagcgacuuaguguuugccugaauucuuuuucuaucuucucuuuuucugcaucugguuccuuugccugaaaauuaaugggacacauauguacuauaggcagagaaggcuccuuauaaggcugccccuuccccaaagccauaaaccaaaagaaaccuuacugccaauggucuugcuauuccuggcuucugcauccccccccccccaccaucuugcucacuccacccucccuucuacccaagggaccuuuccuacuuggcuuucucuuuugcggccacagggauaaaucaaagacguuaagaagcaguuacuugggguaucuggaugggccuugggcuuuuagcagaaaacaaaaaccccaaagggggaaauauuauauauacacauaaagcccuaaaauguaaauauaaauacaacuguuguuguaaacaagcacccagcccagggcaccacagaaaagugggaccacgccuuuuuagguaaggaagcugaagccgagggagagucagcuucuuuaugguuggugugacuuucaaaaggucaccugauuauuucugacuugagcgucugggccaacugcacugagcaagcugccuuuccucagagaagcagagcccaauggaaacaggggcacuccuuaccaguccuuucuaauacggaaagagccuccucuccaccugacacaccaucucucucauagccugucacucuagcauacacuguguggauggucgaggcccccaggcuuagcuucugccuuucccaccuaguaagccuuccucugcacccacuccuuucccacccacagcuuuugugacucgccgguggcuuuguuuuacucacaucucucagcauuuaccuccccccaucacaaccauuacagagucagcuggacuagggaugacauaucuuuugccagggagcugaggagaugggcaaacaaaggcgccugauucauggaaccuacacgacaccagaauuagccccaacaaguugucuucugaccuacgcgugaaugcacgcgugcgcgcauacacucacccgagcacacacacacacaacuaagaggggagggaaaagauccuuuccuaguguagaguuguaaugugggaccauuagaaaccucacuccuaguaggguaaggccccaggccaggcacucaccaauugugucagacauguaucgaggcagccagaucaccaacaucaacaggcaccagacagugaaacccaguaaggugacuccaagccaacuuguccacucaucaccuccaucucuuaaccauucuggacuccccaaguccuuuggccaggccauacaguuaccuucugcuacaggcccucuugaacuugcugcuuguguacagcagagccuuuguacuuaggucuaugccaccauaggaaauugagagcacagggcagggcauaaucaggauuaaaucccgagcucuguuuuucccaguaugaauuuaccuuuaaauuaaagugccuuuuuaaaaaaaaauuauuuuuuauuuuuaaagucaauguaaagacuuucucagcuuuuccagccaggggcaacucuguaucagaggccaucuguacaaacucugaggacauugauauuauucauacuaaggggaugucauuggcaccugguagguuuagacuagagaagccauauaauauccugccucacacaggacagucaccauaacaaaacauuaccuauuaccugccccaaguccccagugcgaggcuaagaagccaugaugcacacacaagggcugcucccacuucagccucuggagccugcccugcucucucucucuccuucuggccucuccuuggcuguaucccuccacuggagaaauuuuaucugguucauuuaucucaaaccuuaguaaggcugauggacaauuugaauuuuugccuuguacccuucuccuaaacuucagaccuuuccuucccaggaauuuauuguaaguguauguguauauguguguguguguguauauauauauauauauauauauauauguauauauauauauguauauauauauauacacacacacacauauauauacauauacacauacauauauauauauaguaaauauauauuguauauuguguguguguauauauauauauguauauauauacauauauguauaucaaaucguccaucuuccuuucaauucugccaugucuaaaauuaaaaaaaaaaaaaaaaaagccucuaccucagcaccagccccuccccgacucuauguaauucccaguguccaaaacccaggugguagucuuugauuccuccgucuuuugugacuugucuaauacgagugcuuccaggaagccucuggaacccuuaagucucuuuuauccacugugucugggucucucuucucucagggcuuccgcggcugcagcuucuuugugcacagcccuuccuuuguucccuuuaucggaaccacccuccauguugguucuguccuuucuaaaagcuugauucaaauccugaucugagaaggagggagaaacacacaccuuucaccaucuaccccauuuccuccucuccacuuccugcccaaagagcccggaugcugcauggacgccucagaaagcacauccauuuucucccuucuuucccacugcuccuacaggagcaaagguguccguccgaucauuuauguaaccagaccccacacuuccuuacauuggacccuuuguuccagauaggugaaggugugcccgcucugccccgccccuucuauucagucaagacaucuugcuauggagacccauuccaggcgccauuuucuccaucuggucuuugcaaccccuccuauuggaggccuucucuuuccauuuucaugccguucugcucuuucacaaggagacuggcaugcucuggagguuucucccugucagagaagcacgauauaagaaagaauguggaacaaaggauucucacagaucauaagaaugucugaacaaagagaaccugaaaccauuuuuuuuuccuuuuggaugaauggugcuuuagggaugggugugagaggccuggagagcccacaagacccgcguggcggucuccuugggucgccaaccucagcgucuacugaccuuucaccuugugcaggguucagcaucucugggaaaugaaaucuguccaucuuguacugcucgucugcaucggagcaguaagcucucuuucuccauaggccuggcccaccaccuccaggcccuggaaaagccucucuccgcggugccucggcgauagcccucucuguguagugaguuagccuaccgccaucaugagcccaagggaugguccaugggggucccugaccuucccaccuugccuuggcgauuuagggcaucaaaaagcuuggcccccaaggcacucacggcgaccguggccuucuaggccuggccgccauacgcccgcccgccaaccgcuuccaaccaacccagcaagcacaaccucuuugggcguuccaacgcggcgcccccuauuggaccucccacccauauccgguuuccgguccgaagcccccugcucauucgccaggcauccuugauuggcgugaccccagcccaauagcugaccugucgcuggggucggaggggagugggcuagugguugagacccaguuggccuauucgguguauguucaaaccguuucgccauuuugaguguguguguguguauaugugggggaggguaguuggccaaacuuuggaccaaaguucaaaguguccggcaugcaguguguucagccguagaguugaggugacacgccuucggcaggucgcaggcauucucuggggguucacuuugucugcuuucuucuacucagggugaccacguggacgcuguaggcaaggggcuguagugugccgagccuguagugagaagagggacauguuagacuucagagaauuaaaucugccgcggcacacagcaugcaucuugcaauauacccaucugcauggugcauaauugccgcagccugcuuuauguaccacuucauacucucuuuucucaggguccugcaggccagaccugcccacugccuagcuguauugcaacaaaagacaaugccucgcgccaucgccauuaccuacuggcaaaauguccgcggugugcgcgugccgcgggcgcgcggcaaaacaaaaaaaaacagaaccccaaaggcaaacaauuaacaaaaaaacccugcccaggaauaaucugcagaucccagaccuaaagcauuuuaugauuauucgcugagcccaccgggcaaugugacuguauaaacuccugcagcucugagcccaccccggcaccgcaaggggcgcgcagccgcaggcuuugugaccgcgcuuaauuucgccuggguggacuguugcaguucaacguauagcaaaugcucuauggugcucacaacagaaggaggaggggauaaaagggggcuggagaagggcuugagagaggaaaugaacacggaauccgcagcuggcgcugguggcuggaagaugcgagucucggcagcuguugccaccauggcacgguuggucgguggguuaagugcauuucagguuuucuagucugcgagaccacccuaaaugggccaucaacuacaccccaaaucuccuuuugccuuuacccagaagacagaaguacaagaccugagcuagguggggggucuuccgguaagccuuaagcccccuccccuauuugcacgaaagcggcaaacaugaauaacuccuaagggggcuuugcuugauuuucugcagugcacugcugagaccuuuauuucuacugcaucaccguccauauaaacagagcaagcccugacuacaacacacuauaccacuguugagagcuccgagguguaauggggaugggggacauugaagggauuugcuggagccauccccaacaaacagcaaacauaaacauuaaaaaaagaaaaaaaaaggaaaaaaaagaaauaaagaaaaguacccuagagcauuuacgaaacaaauugcguguuuacauucggcacuuccucacccugucucuacccuuccggugggcucacgaccaccugucgcauuugugugugugugugccucuaccccuuuccuuguauccuaaagccuccauuuccugacuuggagaugaguauggguaauugccugagugugggguccuuagauaaggaauuuaccgcauacugggguaaucuggggugauaaagcccuccugcagucccuccuccccucgagaagaaucagauggggagggaggcuuucagcgucuguacucuaacagaccaaugcccacgucuugcgucacgugucccagcaacgcaagagagcucgcucgcucucuggccagggaaaaagcgagcuagagagacucggaaucaguccgggagaggagaggacggagccgaacgucccuacaaggccuccgcucaucagcccccuuacccaaagucgggagcagccggcaccgggagccagcucccggagccggcucagcacugagaccugcguccucuggcggcagagaaagaguucuauuuacgauuuucgagacgaaucggcacgcucuuaaaugccaagaaggcggagcuaaaguacagcaaaguacgaagagagaacagaaaaguuccuaaaguuguuggccgaccacagcccgaagggguaaguguaacuaggaaggugacagacuucaccagcaagagaugacucacuucagccaugguccuggguucuagccccugauuaucuauccuuacaaaguuuggaaacugaggcuggagaacuuuccaacaaaaauuugaauuuuuuaaaaaaaaauuuuuuuucacccuaguuuggcugggugcuccgucuuacggggccccaaauuuauuuugaaaagucgccaccguguuaugggcauguucaacugccuccacggcaauaauaugucaggacaacacgauauccccccugaagucggggagcagcccgagcaagaaccuuuggaagccccaggggcagcugcccccggugcuggggcuggcccagccgaagaaauggcgaccgaaccggacuccgaaccgucuaacaaugagcccguccccgacgagacuggcagugagaucaguggacccccagaagacuccaaaucugacauccaaagccccugccaggccuucgaggaaguccgaguggguggagacuacagcccaccuccggaggaagccaugccauucgagacacaacagcccagccugggagauuucuggcccacccuggagcagccaggaccaucugggaccccaucaggccuccaagccuucaacccagcgauuuuggagcccgggacccccacuggcgcgagcccaggccugggagccuauacccccccaccagaagaagcuaugccauuugaguucaacgagccugcccagggagaccauagccagccucccuugcaagucccagaccuugcgccaggagguccggaagcauugguccccagagcucuucccgcggagcccgggaacaucagauuugaaaacgcuggcuuccgagaagacuacagcccucccccugaagaaucugugccauuucaggucgguggagaagaauucgggggcgauagcccacccccaggacucccgcgagucaucccacaaaucggcauuggcggcgaguucccgacagucgcggucccgagugcgcucugccucgcucccgccgagaacgcgccuccccucuggguccgaggcgccauugacagaccauuccgcgaggcugucagaucuccuccuaacuucgcaugcgacagccccccgauggagaucaccagaccccugcuugagauuggcagagccuccauuggggucgacgacgacaccgcugucaauauggacagccccccaaucgcaagugauggcccgcccaucgaagucucgggagccccagauaagagcgagugcgcagagagacccccaguugagcgagaagcagccgagauggaaggaagcccuaccaccgccacugcgguggaaggaaaaguccccucuccggagagaggggacggaucuuccacccagccugaagcaauggaugccaagccagccccugcugcccaagccgucucuaccggaucugaugcuggagcuccuacggauuccgcgaugcucacagauagccagagcgaugccggagaagacgggacagccccaggaacgccuucagaucuccagucggauccugaagaacucgaagaagccccagcuguccgcgccgauccugacggaggggcagccccagucgccccagccacuccugccgaguccgagucugaaggcagcagagauccagccgccgagccagccuccgaggcagucccugccaccacggccgagucugccuccggggcagccccugucacccagguggagcccgcagccgcggcagucucugccacccuggcggagccugccgcccgggcagccccuaucacccccaaggagcccacuacccgggcaguccccucugcuagagcccauccggccgcuggagcagucccuggcgccccagcaaugucagccucugcuagggcagcugccgcuagggcagccuaugcagguccacuggucuggggagccaggucacucucagcuacucccgccgcucgggcaucccuuccugcccgcgcagcagcugccgcccgggcagccucugcugcccgcgcagucgcugcuggccggucagccucugccgcccccagcagggcccaucuuagaccccccagccccgagauccagguugcugacccgccuacuccgcggccuccuccgcggccgacugccuggccugacaaguacgagcggggccgaagcugcugcagguacgaggcaucgucuggcaucugcgagaucgaguccuccagugaugagucggaagaaggggccaccggcugcuuccaguggcuucugcggcgaaaccgccgcccuggccugccccggagccacacggucgggagcaacccaguccgcaacuucuucacccgagccuucggaagcugcuucggucuauccgaguguacccgaucacgaucccucagccccgggaaggccaaggauccuauggaggagaggcgcaaacagaugcgcaaagaagccauugagaugcgagagcagaagcgcgcagauaagaaacgcagcaagcucaucgacaagcaacuggaggaggagaagauggacuacauguguacacaccgccugcugcuucuagguaaugcggcagcuucugccccugggcaguagggccgcccgggccgcccggggaggggguggcagggccuuccgguggggcuugggccuugcccgcgggaggaggggguccggaaacccuguuagaaguuccagggagggacccccaacucugcccuggggugggagaggggccuuuuggagaguucggguggccgaacuauaugcccuccagggagaaaaguggugccgagcgacacugagggucguuaccggccggaggccagcgccagcgccagcgaucguaggcuggacaggcgggggcgugaggugagcccagaacugcuggggugggcccuucggggcucccccggcucgauuguucgugaccgcggugggcuagggccauccgggugcgcgcccccgccucgccuggcacggcugcuucgacucagacagcuuguuguugguguguguugguguccauuuucuguguucgccugugcaugacaugcucagugugucccaguauccaucccaggcacuuucaacguacccgccgauuuuauauuuguacucuaaaauagguuaccuugugauuugcgccauggcgcggccaaaacuuuccgugcugguacacucuguaauaaccugugugcagacucucugcagcgagcagagggaaaacgcgcaggcaacgguggcguggcauccuggguaaucugcugggccgaugacuggggggaguggggccugccgccgcgggccuccauaaccuuuucccgguaugucucucucucucuuuuccccuuugcgcuaagcauauccucacuucucaauacguaugucaaacccucccgccuuaacgguugaaaaaccagacacucagggcuuugggguuguucaaaacauguguauuuuguauucugugcacaugcacacacauacuggauccaccugugggggggggggaguagagcaggaggaagguuugggggggguaccuuagcccugcuggcaaggccacauucaaaacacacaggguuaguuucaagggagugggcguggcuggauuuaaauauauaucuauauauauaaaauaauuuucuccuuagcgaagagcccgagguaaggcaaucacuuauauuuuuacaauucguggcaggaagggccuaguuuaagaagguugggaguuguauguugggaguacaaucuugccuuuguauuuuaauugcaauuaaaaauaaaaauaaauaaauacuaaaugugugaacacugcaugggaagcuggggauagccuugugaacuguguauauguuugcaugucgaucuuuuuuucaagcagcuuuagcugaggacugaagguaagaaauucuaugcaucaguugaggaugaaaaaaaauaaagauuuuuuuuuuuaggaugacgauuaaagaaauguuaugccagccagauagguaccuuuugaggcccucaucuuccaccgcccacuccccagcucuccauguccccagcucuucauguccccuccccucgcagaaaccccuccccucauccugcagucagagccccucccaccacagacuucucauuuccaaccugagucguucauucuucuugccagauuaaucaaaacagcaauuaacaauggucuguaucuauagcuuaaauaaaaucuucaugagugaaucuccacaauuaauuuauuuauuuucucaaaccugucaagggaaucucaggauuacagugucuaaggcugugcuccauuugccugugagauauucgauaaucugugaugguauuuauuaaagacauugauggugugacuguguugcugugaugugccacaaaucauuaucuuagacgggauggucauuuuauuuaugccuaccugggggaaguauugguaucauugaaucaaacacacggaaaggggaaguugcuauaaauuucaaaugccccuguuacgugaaaagcauaguccccuacaugacaaggcuuggacuucacugcagguccauuuccauacucugagaagcugaccugugaguugggggugggugggggggacagaugucugcagguagaugaccuaagugacucugcacaucugaaucccgguuggucccuuauacucugaggccuuagucgccucguuugagaagcaaagcucucccaggaaauuuucauucaaguguccugcaguaacaggacuugggucuucugucuuagcccccacccccaauauaggaagaaggagcuuggaaguuuauacucucugcuaaugcagcucucugcaccaaacaucagaucugaggccagcuucuuucagaauagcaaacguuucccccuuauaucccuuagauuuuuuuuuccuggaggggauuauuaaacccaaacagaagcacauuuuggggagggggggggguaccauggcacuggccugucugcccuuuguggaucucagccacucugaccuuucuaugcagcgucauccagaaagcaggcugcucagccuuggccuaggccucgccugagccucuaagauggccacugcucccugcugccugugacugcaguagcgcugucugucaaagcaggcugcaguuucccacuaggcugcuuucauuucgcugaaguaacaagagagggauuguaucugggucccuguuauugauuggggagggucgaagcagaaggagaggauuuacucacaguuaugagacuuuuucacuaacugucuagcuucauuacguuaaacgagguaucuaugccuucugcccccugaaaacguagaucaaaugaccauccugaagcucuucacguaucacauccacagucaucuguugcuuuaaaaaaaaaacauuuuucugugugcauacucuguuuuuauugcccaaacaucauagugcuagaauuauuuuuaaagauagaugauagauagaaaaauagaaagauaauaauucaauaaaaauucuauaaugucuagagagcugaggcuuuuuaacauaauguaaucaaggccuguuuucauguuucuguuaguuuaaaaucuguggauuuuuuuuuccuuucuuuucaaaacuucacuuagauauuauuucuugguuuagaauugcaaggggcuacuagaucagucuauuuuaguaucucuugccuuuauuacaagcagguaaagcacucugaauaauaugaccacuauaguaaugccucauuuuuauagcaaaucauaauuaauuauauaauaauuuauuuggcugccaagugguacgguacugcacugcaauucaccgugcagauuguuuuuuuuuucccccuguauuuuuuuuuaaugcagccauuuucuuuuucuaaauucagaaggccuccacugaauuguuuggugcagugggaagcccauagugucccugacccccaaauuuagaaguuaaggaaaauuugcaucuuauuucccaauaacaucugcaagaauaacauguuuuacagagauccuuuaaaaaaauuucaacuccucucaaaaacauuuuuuucuaaauagguaauuuuauuuuuaucuaacucauaugaucuacccugaggagaugguaugaaccauagggaagggggucacccccaguauuggaaagggggguggcucaugcuuuuaacauuguuaguggccaucaaugauaaugaugacauguuuuaauugcauuuugcauuuuuuaaagucuucuguuuagucacaucagcccuuugaaagaguucugggcaguaagagcacuucaguaccccauuucaugagcacuucaguaccccauuucaugagcacauccacuccacucacacagauuaaaggccagggccucuuuuguuuuuuccucccaaagguagcaagguaaguaugugaaggacccaggccucuaacucugaggugcuaacgcucaccgagcccauuugaaaaauucuauauggcuuucucaaagaugagagcaugacaguuggaguguucucugugaucuuaaaaucccuuguuaaaugacaggugucuaacagucuguugcuuucugaauucuagccagacccugacagaccacugacuguaaaugucuauugagugaacaugaaauguaagcugcccauuugggggaagccauuuuguggaggcuuaguacucauguuugcuucacugcuucccaacauaacacacacauauacauacacacccacauauucacauacauacagcacauauacaacacacauacauauacacacagcacacacacauacacacacaacacaugcauauacccacacacacaacacacacaaugcauacacauauauaccacacacaacacaacacacacauacacacauguacacauacaacacauacauauaacuacacaacacacacaacacacauauacacacaacacacacauacacacauguacacauacaacacauacauauaaccacauaacacacacaaaacacacacaauauaacauaaacaaacacacacaaauacacacauaaaacagacauaauacacacauaacauauguacagagaacacacacacacagaacauacaacacacacauaugcaacacacauaccacaccacacacaaacagucacacacauaccacacauacaacacacacauacacauauaacacaacacacaaacacacacauauacacauaacacaccacacacacauaugcacacaacacauuugcuucaccccacacacaaacacacacacaagcuuuuuuuuuccuuuuguucuuguuuuuguauauaauguagcuuuucuuugacaucuuuuccgagaaaaaaaaauccccgaauaguuuucuuuagcagagcucaagcuuauaacaacaucaacaucaguaacaacaacaacaacuauuauuauuauuaauuauacaauuauaguaaauaacaauaaugauacuacagugcaguuguuuuuguaugcacaucccuggaugcgcagugccacaguacacaaacaggaucuccaauagcuuuucucuuccuuauuuuuaguuuacaacuaagucccauuuuuuuauuuaucaagaauccaugcaugauuuugaaaagcauuugcuuuguugauuuauuuugaugcaggacauuuaaaauuuuuuaaaagagaggauagcauaguugauuaaaauugaaacccucaacucuaggcacauucccccuuuuuuuuuuuuucaaucaguuuccccuccaaauaagauguguccacucacuucuuagcaagacuaugcagcuuuucaaauguugcugugucuucuaggaggcacagaaacagcaaaugaaaauuaguuucuggauuuuuuuuuagccuaugacacagguuaaaugcaccuuccucuucccacaguuuucaugaacuuaaaauuaguaugcuuuuugccucuuuuaaacuaaaacuucacagaaagaggagaacuuuuccaagcagaaacaacagggccacagugagcagaggccaagaacuguggacacuggaauucgguguccaugggccuauggucagcagacaccaagucucugucugacgcccaccuauuaaggucuuuaguccgcuggauggagugcccguuguuacaucacauuccuaggcugaccuauggaccccugaccuagggucaagcucuucagagagacuagaaagaaaauggguccggccuuuccuuuggaguuucagaugaaaaaucuuugaggccuuuaugcagcuuaagaauacuuagugggcaguuucagaugcaagcugccagagggggcuuaguuuccagaagacucugagagaaggauuucuucuucuucuucuucuccuccuccuccuucuucuuucuuuaaagggagagccagauccugggugaagcuuuuuaucguguaagagcuagaguguuucacaugugagcucccccaaauguuaaguuuacaacuucuuuuuuuccccuucucuauuucaagugaggcuuuauuuuauuuuuguauauuuucccugagagaccguuaacuugagccuaggcacuccacacuuccggcuucuacauuuuauaguucacuccuuguuacaggguuuguaaccacaaguuaacucaaacaauagacaaaugacaucuugccaaauuuaggaugauacgauaauguggcagaagaaagagaaaacccuaagagggucauuuuccccccuccugaacaaguaccaucugccauuccugcuuguuccuccucuaccuccccugggauuagcuaccuauguauauacuaguucaggauuguuagauagcucaggggucaaugugguuguuuuacaaaaaaaguugucucuaguuucccuucccauaaccagaucaccgcagaggcagagcagcugaugggagcguggaagaggacaagaccccaagagagagguaaggaccuauuccccuccccccagcccccaaaauguuaacuuuucaaugauugccaaccaccacagacuugaggggacgcggaaugcucuggucucugacacaagaccuuugaaguuagaauuauuggaaguauuuugcaugugccacacuggaagcgguaaccaaggagcaucaggcaagugaucuaugagaggaccagaaauacuaaagaagugugcuuccgggguccugagguaaaaccccaaacugcccuacagagugaguuaugaaggcucaggagaauucaggaauauuuugcguuaagaguccuucccacuaaacccaaauaauggaucuugcuaaauuugaaugauuuaguuaggggugaggagagagguauaaaaguuacaauugguacccgauuuaaaauuugaugugaaucaguugguguuucugacagucacacacauuuugugugggggacagugcaagcacuuaaacuuugucuccuuauucuuugauaaugggaagggggaaaacgcuuaugugccugccuucucaggagugucacggucgagcaugcucacugccaccgcuaacggagagugaccucuuaugaagacuucagaauggccagcuggagccucucuucugacuugcuggcucuugccuguccuucugucaaagguucugaauaccucucuccuccuacauaaccaguuugucccucaccaaacugguuguuaacguguaaacaacuccgaagacauuccuacagguaaccugcacccagguaaguccaaaacugcauuuuuuuucccacaacaaaugucaacaugaauggucaugaugacacacaaaacccaaagcuaggcacagaugagucuaggaccccagagcuguaaaggaagugagagcagguauccuagauauauugaguccccuggggcuucugagacccauccugggccugaaccccagauuuuaaggcaguaaaaguagauuaccggucucacugaucccuucauuccccaaaggauacagugucaagagcagguggcauuccuggggaagugcacagguguauaguugcauaguggauucaaacauguccuuucagaacagcacucucuucaaccuuuuauuacacguggucauccuuaaguguccaagggccaggaccaaagcccaaaaggucacuucuugggaaaggcagaguuuauuuguaauuugucucuuaaguuguuguauguugguguuacuauuuuuagcaugucuggaaaguguacgucuuaauuccuugcauuugcaucgaauggcucuguugggccuaguguaugcuuagauagcuuaucaauaaaaucaugagucacccaggagccuccugccugcugucuccuggguaaucauuuuuuugguggugggcuuuagaaaagucuagagucaguaacuaaggguugauauuucagguggccacuagauggugagaggguauaaggcaggagagagaggacagggaaggccagcaaggugggaaggacucuacuuuacuuucauucuuugcccgcaccuccacauuuuguauauuuugagcuaugacuuauucuuuuuagcuaugcacugagacuauaggaacauuuaaaggguaucuauuuaacaaagggaucuucuaagcaacuccauugacauuuugucacgggggcugggaccuguucugugcacuguagauaucuaauaucagacacacauaaacgugcacacacauacacacacacaagcacacacacauguacacauauacacacauauguacaugaacauacaaaccaccaccaugaucaccaaaagcuaccacuacacacauuuuacacauacauacuacuacuaacaacauauuaacaacagccaccacuacacacaucacacacccacacacagacacacacacacacacacacacacacacacauacacacacacacacacaccaccaccaccaccaccuucccacaauuaaguaugauagcccaaaucuuucuaguguccacuaaaugucacacaugguugagaguuccccucuaucccuuguccugaggaagcuagacaucgcacaugguauagcuuguucaucuacugauaagccaucugaaggaaaguugucccuuuuacuaaccaaucagcaaugugcacacuaaucuuggacacuacauucuugaauagaagcaauuuccacacaugucugagagugacccccagaugacccuaaauaggagagaagaagaaauuauuucaggcaaauaaacaauguauuggucuaggacucugauagguuaauaccuaacuagucaguggguagccaguaucaggggcauacauugauuuuuuuuaacuuuauaguuguacauagggcucuuuaaguuguaauaauuagcaucgugcuagccuguucccucugccuggugugcacugguaaauucuguuacuguagaagggauaugaauauccagacaacaagggagggaccuguaccucccguguacucacagauacuaaaaguaccuucacuuaaccugugcacaccagccuuaaugagguacaugccaaagacagccauccacccacggaaaggugaccugccaccuuugugugugguaaugaaagugaggugaccaccacagugaggagggggaagaggaggaagaagaaggaggagauugucagaaaggaaacagugguuccagaagaaguuccugaccaaagacauuuucuggucaaaaggauugcauuuagggcuuugauaaaaugguugcuauguccccaccuaaaaguagcaucagcaucuauccccaugucuacccuucaggucaaggcuuaguugucacuuuagugggcccaagucaccaaccagcaccuuaucugucucaguucuuuaguuccuggggcugaaugcaaggcuuuaugccaugcugauugggacuguacucccagcuucuaacuucuuaaaagcaaaggcauuuuccaguauuuuccucgucuucaagaacuuaagauuuucauaucuuaaagugagcuaucaggguaaagauuagggugaaucagucaaaacagauugggucugagcaguuagaugccggccaugucagauggggaaccagcauuugacauccaaacuucuugcagauucgcuuagagaauuucagguucugcuaagcaaagugccccaaaaaccuccucacugccucaaugcacaauccuagaaauuaaaaccucagaauguugauuuugagauuuugccugggaccaaguacaacaucuuuccaaggaaaugcuuagaagacucaaggcagaacucagaauccaaugccagauguuagggggaaaguuuuuuuuuuuuuuuuuaaguuggguagccaaaaaacucugggcuauuuauacuucagcauucaugugacuucaguuucuuucauuuuugcucuuaggaggagagcacagaaggucauuuuguuuugccaagcagauaugcaagugaggauuuaagauguacacuuaggagggaaucccacuuucuagugggaguauuuggaaauguuccauguuaucacuuuccuauguugucucaauggggaagaaaguccaauaguugggggagugguguacagagaaucuccaguguuugcagaggguccuaggaugauggagagagcacugguuuaagcucagggguuuugcugggaccuugguugauucuaacacuugaguuuagaguuccaugugcuugcuugccaagugauguccaggaaagacugaugauacaucuugaaguauucaagcuuaccugagguucugccauggccaaagagguaccaaauuucaugaguuccuuuaagaggaagccagaaacuucccaugucucccaggucuauguguaugaaguacucacaagggguuuuaggccaggaacaucuggagaaaguggggcacagaguagaaacucaauuuauuuggcagacaaaucuaaaaccaauguagcgaaagcucacccccagacucaaggugcccagaaguaaaacacuuucacccgggggaguccuugagguagcucccagcgggaggaaggaaggaagagccugauugccuuaaguagaaaagggagcccaucucauuugcaccccaaguucacagcaggagggaggaaacaaaagguccuggggcauuuuaccuguuuguucuuuuccuguucucucucucuucuuguuuuauuuuucuuuucauuuucagauuuuuuucuuuuaaaguaggaucuuuuucuagggagaaccuuucugagccagaauuuauaaaauacauauauacuuuaaaggaaagaagggagcccacuguuuagggcugggaaguaggaaaaucgaaacaaaggagggcuguucagaacuggcuggcagauggcgcuccgaguuuacaauugagagccugguguuagaaaauucaagccugcgccugcuucaggcagcccccucccuuuaucuuccuucccagggacguagcuccgccccaggccuaagaauguguuguuuuggguuuuuuuuguuguuguuguugcuuuuuguuuaagguuucaggacagcaauugauaucuggugacaaguauccccacuuuguagaccuuaggaggucagaaagauaaaauacaguggggugcaaaccuggaagccccuucucucccccccgcuuuggcuuucuguguaacagugcuaagcucuccuucugccaggaacaguucugagacccuaaacauccuucugucuuuuggggaaaagguugggggugggguucuuucccaguuuagaaucuuuuaauucuguuaggagaacuuuuaaauagaagguguugguuagcaucucugcuccccccagguauaacacacacacacacacacacacucucucucucucucucucucucucucucucucucucacacacacacacacacacaccuuuguccuuaccaaaauggcaggugguguaggaaaaacaucuuaggccaucuuuuguccuuuaacaaaugacuauuucuggguccccugccuggagcuaucuuguguagcagcagaggucacaaaguucaucccuuuucacccagccaagggcuggaaaagaaaugcauacauaaggacuaggucccaaagacagugcuuuguacuugcccugaucccacugcccugccuccuccacagcuacugaggaagguacaugggccuuccuagaaggggcugcagacucugcugggaacuuacccucggccacuaaggccagccuuaguacuucauucuccauagcuucuucuauuucucuucuaaaauguaacaaucagagaaauaagauacaaaauauuaguucaggcuaacauuucuguacucugcuagucaauucuuuucaaacuuuguuacaacuuuccuucucucuugcccgcuuuuguuuaucuuuuguuuucuuuuccugaagguuuaaaaggguguuuuuuuccauuucuuuucuuucuuuccuucuuucuuuucuuuuucuuuuucuuucuuucuuuuuugauucuuuacccccacuuucagggcuucugauaugugaacuucaaggcuguccccagguguuagugauauggguauagguaagcagccuguucuaguaccgaugggccuacccaccagaggucagcaaagagcucagaauagcugggucugcuugcaaaugugggaacugguagaauucucuagaucaaauguagacaaccuaaacagaaaaccgccccauauuucaaagguggggguggguggggaggagggaucauccugucuugggucccugggcacuuaguuugaacacacuggaggggaugaaguuuugaucugcugugauuugauggcguucuuucucagaccaacuccaagcacacaaauccuugccuuaacagguaccucacccuccuagagccccuaaucccgucuggggacacaaugcccacuuucacuucccacaggacugaaaacuuucccaugccucagaguuggccuggcccuuuuucuuuuaggaguaauguuauuguuaaaaugaagucauaagauuauaaccccgccccuagcccugacccccagccccaaaccucacuccagccccugcccuguugugaguguccuuaucucuggcuccucacccagauguguagcuaagaaguauuuauuaaccaugggucccaggguucuuuauuuggcuucccccaccccaggcguauguacagaggccaguucccuccuucugccaucucuucacagauccuugacuuaguuuaaccuucucacucugguaggaaacaggggaaaggagucuggauuccucucccccccuugcuuccuuuuuuucugagcuuuugaagucuauggggccuuaagaacuacuugucaguaagaucacuucccuuagcuaguucuuuauuguuggguggugggagggaaaggggagagagggguacaaagggcaugagaaaaagaagccccagaaugauguaugagaagaagagucaagccaagggagaggagagagagcagaaguaaagacuuugccaugucagugcucuaguccagaugaagucccugcccuagggaaacuucaagucuuggagaacaucaggguuucgaguagugaucgcugcccaagcagagauggacggcuaucagugaacaggaauugagcacaucgaggcuuggcugggcuuaauuaaacaaggaggaagaaaagagaaggcucagagggugacuagauuucaagacccacuugggaaagcagcaaccaggaggcuggugguggauccaggaugucaccauggcccuguggggucuggccacuggcuucucugucccaacaggccccauuugcuuucuucagaguuucuuaccugaauccaaaugauuuuguuuaauugucacguuaggcucuccccccccccccccuacacacacaccccuucugccacaaccugauuuucugaguguuuccacaugcuucgcccacugagugguuuuguucuauuuuguuuuaagcaaucuggcacaccauggaccuuuuuugucagaaacagaaaaacaaaacaaaacaaaaaaacaacccacucuaucuuugugaguccuuuguuucaauaauuauccagaacaaagccagggcaguccuauggguggacgugagcacuuuguccacugaacaugcauuucagagauuaaggaaauccugagaauuuuguagguugauggccccaagaauuuggcaccagccagguuccauauggacacuguuuucugucauuuuuuccccuuccuuccucccuuccuuccuuuuuuccaccccaccaccucgcuuugaaaaacaacuuuugaaggucugucuccuggguaccuucaguugggaggagauaauucucuccaguaaggaagaguaagggggaaaagaaggggguacguuaagccagaggacaaggggacaggauugauggcucagcacuggggucagggcacaggcuggaagacaccauaaccagacaauagucaaaagagugcagccucggcuuccuggcuguagucaggaaaauauucugucaaguuuaacaaaacaaaacaacucaaaccccagcccaguugguuaugcuaggacccuauucuuccacauuuggucuuuagauuuggcuccuucucaugauugagauucccccaccaggaaaaguuguugacccucccugacaagcgccaagaguuagaaauguguugcuaauugauuugagcugaauuuguauugcuuugagacuuagcaaaagcggccugagguugaggggagcacaggguugcuguucucauaagccgagagauggacaccuccccaccgcccccaccgccccaccgccccaccgccccacucauacagggaaccuucugugacacuuuggaaucuuuggaaugggggcaucacagugguucugagaaagaaaagggggagauuaaaugggaauuuagcauaaaaucgaugugccagcuuuaggcagagauucacucucuaacaugguuccaaaugaaaacaguugucaccaguuaacguuuccacaguuuugaccauuggcagaccucggguuuacuccucuguagguuuuguuaaccuuggcaaagagcaugggaaacuagucuccuauacauaugagcccauuuucccucccugauaaguugcccccaaauuuccaaucaacauguauguuaaauguucuuguuucuugucugcuugccuaguagccuuacuacgcaugcaguagcugcccacgugucuaccacaccucucaagaggaugaguccugcucaggucggugagucugccuggauuugggcauuuuuauucauucauucauucagucagucaguccauucaguacauaaacacggaaaugugcccuucccugaguggaagccaaaggucuaagacaugguucuccccuuaugguccugugguuaaaaaucagacacaggaaguagacaaugguggguaauuucuaggaaggcauucugugagaguagcuacagaacgcaugcaaagaugguuucaguggcccuucaagagcguucuaacccaagucagcaaacuaaaucagaacugaaaugacaugaugcuguucuaauaaguaagcugcaggaaacccaggagaacuuaucucugagggucagaauaaacagacaucugccucuaggacaaccaacucuucacaucuucgugucagccugaggcugaggaaaguagcuaugguuggcagccagaguacuuucauacugccacagccuucugcccuccuucuuagcucugauccaccaucuuagauccuggccugcccuccaucuuagcucugauccaccaucuuagauccuggccugcccuccaucuuagcugugauccaccaucuuagauccuggccugcccuccaucuuagcugugauccaccaucuuagauccuagccugcccuccaucuuagcugugauccaccaucuuagauccuggccugcccuccaucuuagcugugauccaccaucuuagauccuggccugcccuccaucuuagcugugauccaccaucuuagauccuggccugcccuccaucuuagcugugauccaccaucuuagauccugaccuuuaggacucuuuuuuucuguucccuaaaacagaaagucugcauucaaaugcugccauuaauucuauagaaugaaaauuaucuagaauuugcuuccagguuuucuuucacaaauauuuguagguuaccuauauauucuucuuggaauucaauaucuuaaucuauuccuuucuaauguuuagccuggguagguuccauauacacuuauauguaucuuuaaaauguguauguuugcauacaguuagguuuuguuuuuguuuuuuguuuuuguuuguuuguuuguuuuggcagaugacugaaccaaaagaacuccuaagucaguauucuauaauaaaccaaauuuauaggauccuaaacuucuccuuuacagucucuaccuuucaaagagaacuagaacagggccaugugccuugcuccuuccggauguuuggggaugaguucacagugaauuugagagguggggauuuggcccaggccucuuuccagggcugcagguggcuguguucaguucaguuaaucccaucagcugccaaaggcuuauaagguuacucuuaauaaacaguucugugaggccaaaaugaggaaaagucacauuuuuaauaaugaaguccccagaaauaggagaggggcagcugggcccucauuaccuguuuuucucaccccauuuuccccugcucaggacugccuagcaaccuccaguacagcagaaugguuuuccucuucuguguuccccggauguagaaccccccacccaccacauccccucagcccccauaccuccagggcaacaugcuguguugguaguauggucacuuugauucuuuuaaacaagaaauggaaaguccaggcauggagaaaagacuaagaagagcuaguaaacaagccacaaaauagccucguuguuagcacgaacggcccccuggcuguguggucacaggcagaggaaaaccuggugcuuaguggcacagguugauugcacaccuuaaccuggcgucacugagaggggcauuagccagcagugacucagcugaagaggccuggaugccuauucugacaugccacauacuaacauacccucuagaaacccggaagccugccagguacgcucccuaguguaacuuaaagggggccuuuccgagguguaugauauuuagggagaggaaauuaagcuaauuucgaaagcuccugacaugugaguuuccuuaaaguguaaguaguugaagacaaggaugaauguuacgaaucgcauccauaacauguguuuaaauauaugucacauuccggcagcagagagagcuccacaccccuuagggauaagguccuuuugguguucguuguuguugguuuucagcuuuuggguuuugaauguuaccuaccuucaagguggcuugcaugaagcucugugaugguuaauaggaagaggguaaccuugucacaagaugagacauuauugcagauagacccuucaguaacucaguguccacaccgcauagaaaugaccuucccugcagcuugggugacacucagcuaggaacaaggugauuaauuaugcguguaaguuacagcuuuauugcaagcuugcagcaggaaggcuggcaacaauaguauacacacacacauauacacgcacauacacagacacacacgcacgcacacacacacacacacacacacacacacacgcacgcacacacacgcuuucccuucaagcauuaaaggcauuuggauuuuaucuuuccugaucaaacuucuccacuuccuucuaaauagcuuccucuugccccuuagcuaagccagcagggagaacggccucuggguuuugcuaaauuguggauccugacaaugacuggucugcaaagccagacauggugaggcuaccauuccccaccaugaaaaauggcugugcaggcaggcaccuugcugcagacacaggccagcucaaagcauggacuuuuuuuuucuccucacccucccaagguuaggauuuugcuuagaauucucugcuuccagcuaagaucuccaucagcaaaggggcugauuucaggcagagaaaggaccacuucagcaaaugagagaaaaggaaagaguggcgagcagguucacuccggcagcagcaaagaaaucagccaugccauuucccugacagcuccuuaauuauggugaaagaacaagauguuuucggcuuuuauagagaagucuuauaguagggaaaagggaaagaccugaaagggacagggguugcuggggugcagggagcagacaacugucaccucugaaugacagaugcccuugauaagagaaucucagccccucccugcagacugugcacccaugcccaagucuacaccauuuugcuuuauucuaccaggaggacacugaaaaaagagccagaaaggcuucucccuuccuucuguagggcaaggugagauuuuaguccucgggccagucuuucuggcuggggccuuucuccgguggcuggaagacuuuucaaguggucugccacauacccccuguugaaaauugugcuuucuuuaaggucaguggcuaggucagauaugccauucccauguacaugccuuagaacugaacaggcccagagacaggagucgcuucaggcagaggcuauguuauagugcuggggaggagucagagaccuaaguguugagucuauauauucaugucaagcaaaacucaggaagguccuuauauuucuucccaccucuggacuuaucucuaauccucugaucucaagcaguugcuuggccugcucaaagcucccaaaagcacucuggcaugucuagaaaagaaauaaaagugaauucuaaaugcuuucuuagagauagaaagagccuugguuucuggaaaugggaagguaagagagaagagaguaaacugagcaugcccaagguuagcugugagaucucuggggaugagaacagcaggugugcacgcacacacacacacacacacacacacacacacacacacacacacacacgguguaagccacucaucucugcagccuuuguguaaccauuacacguagaaugucugcuagaagucaugucgcuuuugagagggaccccagccuuaaauguagcucucaggguuauguuuaucuccuacugacuccaggguacacacuacacagucaccucuuccgagacaaugugugguuuucuuuuuccugcccucuccccuuacuccccucacucaguugacacacugucccauacacgggcgauuuugaugauuauuaaccagcagcugacaauaagccaguaaggacuuagggcuuugugguaggugaauuacugcaaucacaaaucaaaccacuuuguuuucuacacgcaggauuaacaaacagaaugccacaucuaugguaucuucuaggaggagggaaucucagguggucaaggguacugcagggucugcucuccucccagcuaagccagguccaagcagggaauuuauccuaaacacuaugcaggguggcucugccugccacagagaugugggaaggaaugaauggccaucucucagauguuaguggauccauguuaggaaaacacuugaaaauauaauagauaggcccuaguuuguuuuguuuucccauuuuuauuuacaaagcaaugcugggggagcugggggaaagauaacaagggcagcaccccaauuuauugcccuaccugcuuauagguuucauuuuaaaaugguuguuauuugaaggagaaaaaaaauauuccagauaccuucaauauggggcuuaggggucagaaaaagccuguguuagagagucagcauucucagugucagaauaagaaaagaguuagagaguuucaucccuuuuuaacaauaagcaggcacucuggaaaaagaaaacagagagauuuuguauaaacacugagaccaugggauccuaaugaugucugaacgacuggguccucaugucagacuucauguugguagagauuggaugguuguucauuuacauuuuauagggugguagaauaaaggaaggcuguacuuuagcuguagcaucaccaaaccgcugugcacaguacagccugaaagccuccuuuucaucuggguagcuuugcucuggugaauuuugagccguuuggcacaccuuaaaaaccuagguuuuccuugguugaaauauguagcccucucugccaucccuauagccuuccaugguccaccccuguggugaccuuucugacuugaguuuuugucuucuuugacacuaauacauccuaucaagcugcuagaaaguucaauuguaaaaacucaucuggaugucuuguccagaagcaaucagucugccugaauauuuucgcccaucagcuaccaccugcccuaauugcacccacacacagccugcaugccguaaggaagcuuaauuuuuaggaaacagaucuaacuacaaaggcagcugaggaagagagcuuacacaugaacaagauguggacaagaugcaggagucucuugccuucucuggguagcugaagaaagaagcuggggaugaggaagcagguuggucccuacaggcaggugggcagggagaggaaaccguuaggaucccagcagcagcagcagccugagaggcagggucugucuagugccugcagccaucuuugauucagaggaagcaaaaucuguucacccuugcuuugucuuagguaacaccaguuugauccaguucaugggggaaaaaaaggcaaugagaaguguuuuuaaucacaaaagacaaaugucuauaauuuuaguuuggggacaaauugacacccccccccuccauuuuuuauuucacagucuccaaaacugagccaagcuaaucaauucccucuuuucucucaucugcauagauaauuuagcuagucucucucggauucuaccucccccccacuucugucuuaucaaugcaguagaaagcuaggcagguggaagagaagauggcaggucagucucuuugugguuuagucuagcucuguuuauaaacaccucaggcaaaggggaaaugcagacagcauccugcuucaccuuccucauuuuuuccucugggguacaggccaggcagaacccaggugugacuugaauauuuuauuuaacacucacagcccccugaacauguaaguuuagcaguuuaccaaguuuugaauagaaaaacgaaaagguuaagaguuaaaaacguagauuuuucaguuguccuguuaagcagggacucaggauucuaaugagucucugaaaucaaagucuuguuacugaaauggagcaauuggugcugaggcugucacaaaacaggcagguggugggacaagggacaagcaaggcuccacugagauaaauuguuuuuguggugauuuuguuucucuccagggcuucuaggcugcuuguagcuagcuggcuuucuuuccuucucucuuuucccuucccuuccucccuccuuuucucucuacccuccacccagguauacauuuucauuuuucucauuuuugaagaaucgagccucuguguuuucuugucauagccucuucuguauccacuuuaaaaaugaaauauuuguuaaaaguccuccccacacccaccccccaaagcuucacuuucucuuugccaucuguaccaaucaaucuagagggcaugaaaguuuuuuuuuuuuuuaaagauuuauuuauuauauguaaguacacuguaguugucuucagacacacuagaagagggcgucagaucucauuauggaugguugugagccaccaugugguugcugggauucgaacucgggaccuuuggaagagcagucagugcucuuaaccgcugagccaucucaccagcccccgagggcaugaaaguuuuacaaaguuaggggaguaagaacaauggaagcagaugaaacuguaaggcauaguuguaaauuauaguauuaagauugcucagggaucaucuuucuaucuacauuuuuguuaucucuaaccuacuucauugacagaaauuaaacuauagagauuauuuaagaaagccguccuuucggugugacaagucacuuuaaauggcuguacuccagaagcuuccgaggugcuuggauuaaaagcucuagcuaggggccgggcaugcucuuagacaugccaccuucuuuaaugacaccaauuuuggugacaagcuuccucgaacccugagcuugcuccagucacagaaacuccgucagaugagcauuagagaagcuagcugcuuucuucugccuucccucaggaagagucaucccggcuuucugguucugugauuagggagcugcaguucccuucuggcccaaggcugaugcuguuguuaaaauguugaagacugagaacacaugcucugcugugccuguagcuggaggcucuuuccuggauggauguaauguuggcaucaguuaauuguggggaaaaucugaguuagaccuuguaauuucagcuggucugugcaagugaugguacaccugucacucaagcuaguguccaagcuacaagucacagcuguagcgugcuuucagcauuagcugguaucguacuguuccuuaggaaaaagaaacuauuacaugugguuaguguuuugcuuauuaacccuuagggaauuucuugggguccuuuauuuguuuggcuaauaggggcgauauuuaaaaccaaucuguuauccucacccaauuuuaaauuacuuuaucguuuuauguaaauguccucuaaaggcaacacacauuuuuaauacccacccccagauauauaaaaccagucugcuuuguauucuuugugaagucagugacauucuuuuaauuuggggguguaguuagcacaaaaggaauuguaaucugagaauauaguagagacuaauauaagggacagacaggaauguucaagaaagggagagaggccacuugcccaguaaugaguggcaugcagaggcccugggauguggcuguagguacagcuaaggccuguagcucauaagacauguccauuuauccaaucuccaggcuucuuacacaugucugguacuuuggggcuacagaauuuucucuaguuggacacuucaagagcgaggcagagaccucagaaggccacagugccaucugggccuggcugguguugagggcacuaccacuggcuucccagcuagcacugagcaugaguccacacaaggucagacagggacuucuucacaucucccuuccaaagagccuuccucacuggaggggcuguacauucuaugcccugggggaaacagguggaguuaaauaauaauuuuacauuuuuccaauuuaaacgugugugagcaaacacaaaaagaugaaaagguaccuacaccucuagaugaauuaaacaugugauuagguaugucacauugauaacuuaauuugggguuuccuaacagcagacaaagagagcgcuguggaacugaaggaccccuggcucccaucagaaucucaguugucccaaaguaggacuuaucaaaucauucacuauuugaaaaugcuuuuuggucagugaaaaccaaagauauaaauguauacucacaaaguuacauucugcuacaaaauauuugcugccagcuuguguuuuuagcuagccuagcucuuacaauagaacuaauuuugaaaaacugaaugcaagggguuggggaguggggagauuguucagaaucugaagauaauuaaaauauaaacauuuggcagaggcuauuuuuuguguguuuuauugagauaugguauuacucuauagcccaggcuagccucaaacucaaacaacuccucuugccuuaaguucacgaguucugagauuauagucaugaacugccauacccaauguaacaaacuuaccuuaguugaagacauuguauuuuagcggaggguuucaauaccuacucuucuucaugucggaucacaucaccaguugcaccaacuuuuacuuuagggaaaguagcuguuaguugggagaacucuuugauagccuuucacccaguaguacucucugcuaggcugguaucccguugaagcuggugugcccuggguaaauggagcugcccucucuuccuucugcacguugcucaugaggccugugguucaugauuaugcugcucacaucuuccuaguggaucuuucucuucuuuaucucuugcugucuagagugguuagccaggagaaucaaacaccguuuagaguuaaauuucaaagggaagagagcuccuauaaucuccuuccaguccccuauuuuauacguuauagggaggggaauuaggcuuguuucucguacagguggcacuugccuaucugggucacagauagucaaugaaggcuacaaaaaaaaccaaaccaaaccaaaaugcacacacugaaaaaaauggguccaaucaccuuggccaguuggauugaacuagacugagauucuauucuaaguuaaagauauauuauuugaggauuagcugauggauauuauucaacugggaaauuucacgugcuuaguucauucuucaguaguugacuuagaacuugugaaaugacauuuaaauaucuaauguagaaugcauguuuggaguuacuuuguaguugaaauacuaaccaguggauaugacaugaaaaaaaaaugucaugaauggucaugacauuggauguuuuaaaauuuaaaauuuucuaguucugaguauuaaagccuucuuauggagauuagccaggccuagaggagcuccacacaguaccugcuuucaccuucaauauggccaaaguugcaaguaacauuuaucugcagccacaguuccagucaucuagcuaauuaaagugcggaaugugcuuugaagauagaaugcaucacuaaguacuauuauuaaagccuuacagcuaaggguucuguuucaguggaagccuaguuauuguuuccugggcuauuaaaauaauaucauaauuguguuuucucuaggcucuuggaaaguagcuuacaaugaccccaacuaaugaaaggcucaagaaaacauucuugucuuaaaacucagcgacaucauuaaguaguaauacaauuucgaagauucuaaccuauagcaauguuguugcuucugaaagcagaugaaacauucacacucagaaagaaagauacagaagggcugaggaaaaaaaauuacaagccggcagaguucaaaccgcaagcuugaagugugccaucaagcuguauauuaggugacccaguauuucagguuaggaauguguuauuucaacuuuuuggcuuuagcaugagucagggaggagccugcauccucucugccaauauauuuuauggucucacuuggagcguuaagguuucuguaauguccacgugucccugacucugaugagaacacuuucuagugcaguguuccaggaauuaugguaauucauuugcuuuacuuucaaaacaauaauguaagugucuaaagcugcagggcaaucuacuaaaaucaauugguaacucacaaguucuacacugugaguucuaacucuggaagacuuuugaaaagcaaaacauauauguagcuuucagggcuuugggcaggucaaugcuaggccgaaaccguagauggugucagcuaaccauaccaauuaaauaaaaucucuucuuucacuuugugucaagugaaaacagaaaaccgaacagaccacaaagcagcuuguguuucaggcucuugguguccuuugcuuaccuauaaacccucgauuccaccugcugccguuuauuuacaaaguaaauccuuucuuuauggaucccugguuagucauaauaaaauacagguaaaacuuaacaguuaaaauuaaaaaaaaaaaaaagcccucccccgaauguuuaaguuaggaguugaauggagagaacccugacuuuguguuacacauuuccaggacaauggucccaauugugccuugccuacaugugucacuguauuccaucagacacuucacucuuuuuaaagauugggugugauauuuaucuaauaggagaagacccacagccucuucauuacacucagcguaugauuauguuguuaguguagaggcauggaggcuguguuggcuguuguuaacuccuuaccuuuuaaauacaauguaucugugccucagcacacuggaagccggaaggaagaggcuuuugaacaacuggagcggaaccgaaauuuuuggccagguccucucucuucuaagucuuuaauuucacaaaugacagaugaaucaaauucaaucaagaaguuuuuguugacugugugaaaaaguaaaagguagucccugucuucaggcuaucccuugccgagaauuaggaacgcaagcacagcuggagucuucccauccacucugguuagguuaaaaaaaaaaaaaaaaaaaaaaaaaaaagaguaucaaccuggggcaguaguugcuuugagguuuuuggacuuuuuaaaguguguguuguaaugaagagaagccauaaucagccguggauaagaaguaaauuuugaggacacagagaaagucagagacugaguuaaaaucagcaaaggcccauuugauaggcucagcuuccugcucuuaauuccaaggcguccuugguuacuuucaaucgcuuucuguuguucuuucgaaaccguuuuuguuuuguuuuuaaaguagacuggagguagagcuguaguagcaaagaccaagaaaaacagugcgcaggaguuuuauauggugcagccuuucugacuuuugaggugguaaacuugagagaaagaguacccuaaaacugcugagcgagugaucaaaagguguccuccuaguuucaaagauagagcuguccacaauaacuuauucgaagcccuucucccucuccccuucaggccccuggguguguuuguauucagagucuacauuucuauuuccuucuccccagcaucccaaguuuugcgaacuguguucgaaaaugaaaggaagacuacguuagaagagaguuuaugguuacuuagcagaucugggguuacuggcgccugcuuugucccauucagggaaggugccaugucuuagucugacccuuggcucgguccaccugggcacaagguacuugugggccgauuauugaaugaaugaaggaaugaauuguuuccaaauagaccccgguggcagacccucaaguccacccgaggaaggugguucaaaaucuuugacuuagcccggugcucucuaccauguccuagcguggccaaggaguggggcgggacacucuugaguuuugaaacaauucuccaaaaaguucauguucgguaaaguacuuuuccccuuuuauucuagagccccguguggcgcccgagccaggcuaccaccucucccaccuagaaggacuccgugugcaccaccgccauggcucuucuucucggcuguugccucgccugcauaaugcugccugcuucuucuauccgugguagucggguauacauaauacuacuugugaggagauccgaacccccauauggggcauugcgauuaauuagcucgccgccacccacauccacgagcacgcgccgcagggugggaggggugugccgccguccccgcgugcgcuaucugggaagcugagguaagaaggcgcacauggguaagcgucguugucaucgucgcauaguuuccacgcugcccagggcuacaccacuacacggaaaauugggaggcaggucuaggaggcggggucgggugcccaccgucuugggcgugcccguaccccucaauagauuguucuccgcgcccccuacccacacuagaggugcccgcgcauuggaccucaccccccgccugcggagcagcccauuugagcacguccucagugggccgauuuuuugcgcguccccuucgcuuuauaggggccauugccuaugggucgguccucugaagagguuggggcgucaucaggcugguuagaaaaacccgcuccgcggcggggacacucagucgcgucggcaccgcggagcggguugcuucagguggcugguaccagcggcgcucgcuagcucccggcucucugggcucggggcugcagcaccggcuggagcgaacccuugucccagcgcuuggcggcggcaggcagacgggcaggcaggcgcugcuuugcgugugagugcgucucacucacauguaaguccgggagcguggggucuucccgcccaagugcgaggugcccgagcaggcaagagccgggauagggcagaggcgccuggcgccgcugcccugccucgcgccuuucaggcacccuccaauuuucucucuuuucucuuuucucuucuccauuggcauccccaagagcuaacccaaggagcaccuaaggguaauagcaaacucuugucaucugcaccuuugcacuuuccuuucucuuguguuauuuuuuuuauuuuuuuugucuuuucuagacucucuuccccccuuuuugaguuguugggcaguucuuauuucuugcuugcuuuucgguuucuugcuguuguuggguguuuuuuuuguuuguuuguuuguuuguuuguucucgcuuuuuuuguuugcucauccuauuugacgcuaacucuuaggcagccaguccaucagcccccuacgaagcccgggaagccgcacucggugaccccaagacagcacagcggagacugcagcugagccccccgacacggggcgcacaggagccgggaagcccgaggccgggggcaagcagaccgcccgagccaggcgcgaaccaagcaccccgagguggccggggcaccaugcugaagauggccaugaagcucaaagcccgagcggccgagagcgagaggaagacagccgcggcugccgccgaaguggcugccgaagcugccguggcggcugcggugcuggcagaaccguucgcuucgcagaagaacgggauccccgcgaagcccccgaaguccgucaggguccucgugaacgccgggcgcgaugugccgcccgcaaaguugcugaccgacaaagagcgcaagaagauggagaagaagcugcuggagcagaggagaaaggaggagaagaagagagagaaagagaggaagaaguuggagaagauguugaagaagaagaagaagaagaaugugccagaagcuccgccagaggcccgaggccccgagggcgccgccgccaccgccgcaggcgaagacgagggcgccgcgcagggcgccgccggguucggagagggcgccgccaccgggggcgcgaguagggccugggccgaaugggacagugacacugaugaagaagaugaugccuacuacgcgccuccccgcguggggggcgucguguggcggccugggccugccaaggcaggcgcacucagcgcgcacaugccccucgugguguuccugguguucucgguucgcagccccucaugggugcuuaacuuccugcuacagaggcgcacagagcagggccgcggcugcggcuucguguucggggcgaccugcugcuucagaguguuccugggcugcgccuucuucuccuuccugaguggucgcgccaagcgcagaggccgugggcgaucccgggccaggggcaccgggcgccgggggcgcgacgagcggcucaucuagucagccucccccccaccccuccaccaucaucaucuacaucgccaucgaccaccaccaccaacaccaccaacacauccaccaccaccaccuuccaccaccauugcuguguaguguggaucuuuauuagugcuuguguguggacacauuuuccuuuuugguugcucuguccuaugcuuagugcucuccuagcuuuucuccaagcucccugcuuucuggcucucucagugucucccucucucucucucucucuccuuuucgaaauuuuccuaaguccgggcccgcacucccucccuuuccgcccaccccggccccuuggcggcgccugcccgcccugcugcugcaggaggagggggaucgggggccgcccggcccggggguggagcgcuggcaucgugugaggggucgucaccaccgcggggccgcccccuuuuccccccgccgcacggccaggccccggccccgaacugcggguggggcgagggggcgaccccuccguggagccggcccgagccggacgugggugcugggaccccugcccggccucugggcaccgccucccggcgcccgcgcccgcccucccagccgcggcccuccuccuccuccucuucuucccaccccccucgccgccgucgccuccgccuccccccgcucccccgcccgccgcggcgcuuuugggucggggcggcgggcccgggccgaggcaauaagagcggcggcggcggcggcggcggcagcagcucccgcggcuccugcucugcuccgccucggccccggagcgaggggcggagagccgcgcgcuugccuuaguccgagccgccacccuccccgcguuccccgcuuucccggcccgcccgaggccgcccgccccguccccgccgccccgcagcccggccgcgccccgccgccgccaugggcugccucggcaacaguaagaccgaggaccagcgcaacgaggagaaggcgcagcgcgaggccaacaaaaagaucgagaagcagcugcagaaggacaagcaggucuaccgggccacgcaccgccugcugcugcuggguaagggcggcccgggggggagcgggcccggcccgggagugccgcggggcgacccgcaaggccgcgcgcgccgagcccgccccccuccccggcgcucuagcgcucgcucccaggcccuccggcccgcugggccgcgcgcgugcagggggcgaggccgucaaggggaccccggggcggaauucggccgggcgggggcugcaaauugggcgugggacccccucguucggucucguccccucaguuggccacacucccccccgucccuggcuucgcguccucgcgaggccuacuuagugccaggggccagggugcgugucgggagggggaggggaggcucacagggccccucggacugcgacagaguagggcuagggacaggaaacgggccggcgggcccagggagggggacccgccucacuggggugugcgauuuguugggagggggcccaaagagaggccaaggccacuaggggggacucggggaccucggccgggagacucuggcgagggaaguagccgccggggugggggggcgggugacaucagccccucggaaaggacggggcgguaaagguggugcagaggggggagggggcgcgggcaagucguggcgccgaaguggggggggccagggaggagggagcguggcggacucugggcgcgacucggggcgauucgggcaggaccgacugacugugcgcggagcagacguguccugagcuaggccaggccguggaaggaagagaagaagaaucaaaucgaauaagaucaaaaaauuaaaauuaaaauuaaaaaaaaaguacgcaaagugcccagugaagccaaaugacacgucauuuuacaaugugaccuuccccccccccccuucuagacuuacaggcuuuuuugaaaagcaaagaggagcauuaaaugguagcagcugaccccccaacugugcccccucccgugcagccaacaauuaacacacagguuuuccuguuacucggccucuuugggaguggagacacaaguaaaaaauaaaauccuguuuuaaacagacucauaaauaagauaaaacuggaaaaugacauuugucuguaaauggcuucuuaguuucgaaauggcguuuuuaaaauuuuuguccuuuucaaggugggaggggggacucagcgcucugagaagacucugggguggcagcugaugaaaagacaguaauuaguuguuuggcaagugacauuugcuuguuugguuuuucuucucuuuuuuuucacugcggcuuuuccuccuuggcaaaaaaaaaaauaaaagaaagaaagaaaagaaaaaagaaagauaaaaaggaggggggaaucccaagcuaaaaggaugucucuccuuacuuuuuuuaaaguacuggggugggggcagcaaaagcacacagacacacacgaaaauuguugaaaugaccacagaaacaucacacaacacuaauuagaauggaaacuuuccacgucucaguauuuuggcuaucugaauaaauuugugaauucacugggaacagggucacuuuucaacaaaauaguucgauuaucaaaaauaaaauguagaaggcuguguuaauucgcgguggcguuugguuugaucuuuuuggauggggucaagucuuuguucucccugggccacauugaguaaagcagaaaauuguuaauaagugaaaauaauccuguugguguuggugcguuugcaauuucagugauuagaugauauaugggaaacuucuaaaagcguaauucugcuguaaaugugaauauguauacagucugauuucaaaguacacaccuggaaacaucuagaaucuucuguaugguucauucuugcucauaugagugcuuauuuaaguucacuaugauguuaaugauacaucaaauuccuaacaucuuuuuuuguguguguuuacagugauuucaaauguccccacuuauuugagacugcaguucugagcccaccuugccuccuuucaagucucuggucuacauggcugcauugugccacaauuaauugaugaccuuuggcacagaaaucuguugcccuggcuauuggcgacauuuuacauuucuuaaaaaugaaauaauuacccacaaaggaaacuuaauacccccaacuuccuuuucuuuaacccauuuuaacuucuaucagguaaauuaaguaaauuugcagaaccacaaaacaaacaaaagccuggcaguuauuuuucagcccaguuuucuauucuuacaaaaguggaaacugaggcacggaucuaguucugucucugaaaaaaaccuggugucacaaauguucccauuucugaggguggagugcugagggaccugaugaguccucuguuuccuucauggaagccucccaauauugccuuuuauauuuaauuuaugagaauuuugcucauuaggaugguguuugcuuugaaaucaaugcugcuguggaaaccaauuuuaacuuuuacaaaucuugcuuauggacuuguggagggguggaaaagaggaggggugaagaaauggagggguggagaauuucggggagggggaguguugaacugaauagggugggggagugaaugccuuucuaucugggcaccaaaacagaaacaauauggagaaaaagaacaagauuuuuuuaaaaauuagauuguugugggaggaggggaaaaaccauucccacagggaauacgggcugaagaguacauuugcagaaacuugguggaaaugggguggggcuggaggguccuccaaauacuaccuaugaaagaaagaaagaaagaaagaaagaaagaaagaaagaaagaaagaaaggugauuuaaaauggaggccuguguuccuauuuacuuccuuaguuggggaaagccuagaaucuucuuauucaggaccuuccaggaauauuugugcauauaauuaaagucuuauccuuuuuuuuuuuuaaacucuugguacuguugaaguugcauguugccugaugcucaugaggucucaagugccauguuugauaacgaaauguguuuauuuuuuguuuuuugcuuuuuuuuuuuuugcucccccgccccccgcucccgccccucugcugcugacagauaauugauggucuaccauuucccucugcaacauggugguuguauccagagaaaaauguaucuuuagaaagauuccuuuugcaggggaagggaguggauacaguggauacaguguagcccugugguuuuaggguggaccugaagcaugcuugagagcagcugcauuguggcguugggagggaggugcugcagcggggcgugauagugggagacugcagugucuaggcauugucugccauuccuaaguauuuuaaccauaaaaugacuaacaaacaggaaauuagguggcugcugcauagaguaccuuugaccacauuucaauacuaaauucacaguuuugacuuaaaauuuucacccuuccagugacaauuacgucauuccuucaucgccucaugaguuuaaaaaacccaaagagaaaacaaaacaacaacaacaaaacucaaaagggaaaaaaaaagcuauuuaaaaacagcagagcccuuaauucuugcuuguuacucuauggugagauacuucagguagaugcuauguuggaugugucuguuguuuuucacugcgucgucaugugaaggagguuugcaguugugucauugugugucuguugugugcugcuucugcugcuuuccaaggccaucauccaggugaagugugacaagccuguuucuuaacccacgcccucacuuuccuuucucaggugcuggagagucuggcaaaagcaccauugugaagcagaugaggauccugcauguuaauggguuuaacggagaguaagugucaaaucugagcagggcacugagcaggacaggugguauggaccuggccugcaggagacaggacguuugaaggaguguauacuaaccucuagaaagcacagcugcuaauugccacuaaucauuuuuuucuaauuugcauauuagacagcccaagaaagagcugaugggugcacccccacacccuucucaaccuuuggggcaacaaauaggaauaagaguagaagcaccgguguccacccaaagcagccccucgcgcuggaacauggugccugguugcagaggacagugaacagcacuuggccgggugacagcgucucugaggccagguccucugcggccgcagccucgccugcugcagugcagcuccaacauggccgacgggccuuggccaccccuuggccagccagagcuggccagcacaggagguucccacccaccacccugcagguuucacuggagucaacugguguaggguuuuguacucucaggaaaacaucuuuucaguuacaucuucacuuaaaaauuggaauccacaacccuugccgacaggcucuaagcuuccgagucccucccugcuucagaauuggugggauaggcagagacuuauuucucuaauuaaaaaaaaaaaucaauacuucuaccugaacaacugaaaaggagguaugaaaauggcgcagagacagggaguuagcuacuucugcccaauccaggagcuguuuugccuuugaaaugaccuuccuggcuuaagacaauauggcgaggcaauaccacagugagagugacgauuuuucuuaaaaagagacagauacauggcaagcaagggguccugccuuccaugaagaaugcagaccgaggagacagccaaucaguaaggaauuggccuuuccccuuggcccccguuguucucagugcugauaagaaacagcaagggucagggacuuagcugacccuagcgagggggaccagcuucuguccccuaccaugcaccgagugcuggggagacaaaauugagcagcaccuuucaggguaccacaagcgaauguucauggaaacuucuagaauuuguuaguuuaacuaauccgguuuaaaaaacaagaugacaucagccacaugaaagcuuuggguccgugugugcuccuuaaguuacagccccaaaauucauaguuaguuaauaugcagaagggaggggggcuagcucacuggcuuuaggauugacucaauuacuacuuuguaccuauaaucuauuaaauaauucauuguugccuaucagacacaaauucuggaacuauugauuccugauaugccucucucaagaagucuauacaaggagauuggcaccugucagucaacaaaaaagaacccagauaacacccugccccaggugugagggacucuucaauaugaggcugguuaagcaaauauuucuucaaaaauauucguggugaaagcuggaggaggcugcuaagcagcuuuuaaaaugcgguagccauugucuaaccugaugagagccgugucaucccugaggcuuaauugcuucacaaauuucccuaaaaucuuacuuuuuaauauuaguuuucccugaguguuaaugugguggaggauucuaaaccaggacuucucauuucuauuuucucucugaaaagaggaagaagccuucgcaguuugccuuccuugugggucuccaagauguuaaauuuagccugagaaagugauauucaggccuccauggggggcuggauuccuuauuuugacccagucgaacgaugguucucucacugugguauagcaguaaaagcggcuccgucugacccucaccucagucccgcucucaguucuuggacagagcuauuaaauguguccuaacuguccauggccugccuaccacuacauuuuucgagaguagaacauaauauuuauuugaccuucagaaauacagagggcaaaguagauuuuccuaacacagagcuaacuuucugaaguuuaaugccagaagaaaaaaaugaauauugguugagcuaaucgaucucaaggcugagugucaaugcccuguccauagcuccccccaccauagaaaaaagucaggaauaggaaugucccacuugugcuuuggauuggacacggagaagauucugaggagcccuauucucaagaguuaggucugugucucuguucccuggugcaugugcauuuagcgaaagcagaggaaaacaauuacccgucccuccugucuccagccugagucuccugagggcccugcuaaugcaggaaggaagguguggagucucgguagacauccccauuuagccagaaaagcgaccuaaggauuaaccgggaggaugguacgcaggacugucagguuuucuuaccugacuguuuaaagaugcagagacuguguggguuuuguaugaaauugcagugccuugcagauaggugagcuuucaaucucucuuuaaaaggggcggcgaagaggacccgcaggcugcaaggagcaacagcgauggguaggcacauucaaaaacagaaaacucuucuaacaaacaaaacaaacaugaagaccauagcgggggaaacugaggacacagacuggggaacaaagcagagaucaucccagggccaucagccaucuuggugugcauuugcaaaugacgugucaacaaguaaagugcaaaacagagaagguuuuaagaauaacuagauacagccgggggaagguuagccauuucggcuuccgaugagaacuuaagauuuugagucgauguuucccauauggucuuuauuucccccaguucuccauuuaaaccaacagacuugccuuucaaaacugcuaaauucugcccacacaauggucagucugacuuuaaguuuucagaccuauuuggaaaaaaauaaucuuaacuuauuuccucaauuaaaaaaaaauaugccuaaugcugcagcccuuaggcagcaggccguugacaaccucuggccuuagaaauuauuuaaaaaaaaauuuaacuguuaaugcaaggcacuuuacguuacccagcgaacaagagcauuugugacggcaccccacucauuaucauuguuuauuauuuugcuuucucauccccacaaccaucucaugcccacacacauacgcacacgcaugccagacauccaugcagcuccauucgcgcucacuagcaugcaggaugcaggggcuguuucucaugucaauccauagagcagcuuccagccuagaacauggacgaggaaugacuucugagaccgggcacgggcgggucaaaggaucugggggucggggacaaagugacugacacauguuuguucaucuguuucuuuuagagucuauuacccccacuagaugauggcuacaguccuccaucuucgcuauguccuaccccaguuaucccaauuugcaugcuggaauugcccggucuuaggaaacuacuaauaagaauacuauucuguuuuccuggggaugggggggggugggggaggggggaggggucccuaaccuaaccuuuaggcguaaguuaaaaacagaaagaugggaugaagucuuuaauuggcaacagcauaguagaacagcaaucagaaaaggcaucgauauauugauaaucuacuguaccaaaaguuggcauccgagaaguguggcaagccccuacugagagagccuccuauauauugugugcugugcuaaccccuucaaccuuacuaauaccugcacgucuuucuuccuaugacucuacaaguaaaaauaacuauuaacgcuccugauaaauaaaacucucugcauguuucagcaaucccuguaucuugcgucugucuucugucugcucuuuugucugucuuuuccccacaagcacaaagauaggguagagaggaggaggauggguaucacauagccuucccuuaccacuuaacaggagaggggcaggaccuacuaaacaaaaugcuaaccccacuaaucugccuuacacuuuggggggggggagcggggaggggagcaucauccuauagauaccgcccacuccaacuuuccagucaguuagaaucccgaaaccgggcacacaucuugccucuguuaaguaguuuagagacaucuaaggaauuuucucugaauuucacaaucaacguuaaauucauuaagcaguauuacaaaugaggauaaaccugcuggccccagcaagauggcuucaucuacauaguaaucucuucaaugaagagguuuguuuuaguacuacacgcccgaauuagauuuuagauuuucuauuuuagcuguuuuauacuggauacacucccacaccuauucacauacguagaugaaugcugaacacguucucagaauaucuguauuuuaagacuggaagcuuuccaauuaucauacuacuacuuagaacgaaauaucaagcugaauggagacucuucccuggggaaaugcuuccuucuaccuguaugucgacggggguaguuaauacccagcuagccucauuucuuuuuguuauggggccuuaaaaccaggcaucuggggcucaguaccaauggcaggaagccauuuuuuaaaaacagaguagauuagccccaaggcaggauaggggaggcuccucugaacucuccauuagaguacugggggcaucaaacacaugcuucuagacuccgacaucuauagcuagucccagagucuaaaaccaacucagaaaugcauaacuucagagcugagcuucaacgugcgccgccccucucacaccguaacagaaucagccccucugagggugggcacgccgugucucuaaaacacugggugguaccuggagcuuuaagagucugugggccccaagcagcuuuuggguguguacagaucccacauccugagugcuugccccagccccaggauagccccuccugccugcaguggccauggggacucaggguuuccucuugccuucuuuuccuguucugaguggugggcuugcucuaauuacaguguggagcuagaggcagcuugcagggguugggcucugauuuucccacugucauggccaugucaaaauccugguagccgagcucucgcccccucccuccuguugagaacacccccaaccucuaaaccuugcaggcccucaccuaagagauggacaccaauaaaaaauauauagugagaucauucagaacacagggccccucccaaaauacacaagccugcauggaaagaaagccccaaauaucagcuaugauaagucuuuguugaaagaauggguucuuugggugugguccuauuggugggcaugaacaugacccccauauucccacucuauuggcaggcacucacauggccucagacccccaaccaauuugcaggcaugcacaugaccccagaaccccacccaacuuacaggcaugcacaugacccccagacccccacucuugguggguaccccagaaacccccagaucaccacuauuggugggcaccuccagauucccaucccuuugguggguauccacaugaugccagaccccuacucuauuggcagguauccccaugucccccaagucuccacccuauugguggguaugcacauggccucacggacucccaccccauugguggguauacauaugacccccagacccccaccccauuggcaggaaugcacaugccucccagaccccuacccuauuaggagaucuacaugccucccagaccccaccccauuagcagauaucuacaugccucccagaccccaccccauuggcagauauccacaugaucccucagacccccaccccauuggcagauauccacaugacccccaggcccucaccccguugguggguauccacaugacucccagaaccccaccccauuggcagauauccacaugccucccagaccuccaccccauuggcagauauccacaugauccuccagacccccaccccauugguggguauccacaugacccccagacccccacuccauuggcagauauccacaugauccuccagacccccaccccauugguggguauccacaugacccccacuccauuggcagauauccacaugaccccccagaaccccacccuauuggcagguauccacaugccccaagaucucuacaccucugucaggcacauggccccccagaucuccaccugaggccugccugccaccccuccuggcuauaguagccucugguccccaucuugcaacuuuacuaauuaauuuucuacccuguuccauggggagggggcgugauuuaacuuucgcuaucuugugacuucaauuuaaugucaguaaaagcaccucugcccuaccucugucacugccaccuaguccucuaccucaguuuccuuaucagaaagggucuguuccucuccaaugcccuguucugugcuaccaggccucacccugagggugcagugcaugcuggucuucuaaucccccauuggccaugcagaagauuaggcucagacaaaauggagucugcuccaagcagggaaguggggcuuugcugcuccccuaaguacaagcucgagauucucuauggcugugccuggcauauaggcugucuccuaaaagacacagcauuuugaaccacuguaaccuccauaaauuagcauuccuucugggggggacaccauccacccccaaaaccagaagaugugaccugugaccugugggaucgcugacucugacugcauacaaaucaucccagaaaggccacagaaguuaucccagaggcugguuuaaauaagcaaacaucuagccaacuccuccuccaguauccaugaacccaaugcccaccaacaauguggggacccaggacuccuagccacaacugggggccuguucaaaagugcugugagccacagaaccccaaacaacaucuucccucccuggugacagaugcauagauacuuaaauaauuagaucuacaaauauggaaauggaaaacccuaauaucaauaauaaacacuugucaccucugggucucacaaacuacugaaucccaaguucagcauguacuaacccuaccuccauacaacccucccugugcuaaucaagagccacgcaggaagcagcagggugugguuggaauggacaguagaccaggugcaauuucugguccaguuaaucaagaucucgaugccaugucucuaacccagccuuaucaggccuguccucaggacaugauugggaaauuaugauuuauuuuuauuuggaugccuucaaucuauagaucuagcccacaauuccuuggaaaacagaauacuaugcuuuuuaguugacgugucucaaugacgauaacacccuggugggcaggaugcaauaugauuuucuuuuuuuuuuccuuucaaucccacuguagugagaaggccacuaaagugcaggacaucaaaaacaaccugaaggaggccauugaaguaugugucuagcuccuugcucuuaucuuuuagcaagccccucgccccacggugcugccccccccacccccacgccugaccaauuugcuaaacuguuuucagaccauuguggccgccaugagcaaccuggugcccccuguggagcuggccaacccugagaaccaguucagaguggacuacauucugagcgugaugaacgugccgaacuuugacuucccaccuguaagcuccacccuaacccugguuuccucugccccucucaccuuagucccagugggaacacgagggccagacuugcaucaggccagagugaccagacacauaccugccgugugaaugcauaaguuaacuccaggcauaugccuaagacuaaaggaugauaaagacaugauuagggcuuuguccaaaauggaugaacaaaguuccaucaccuuuucuagaccucaaccuaguccuccauuuaucagauagugaguuuuuuuuuauggaggagagguccugagcuaaggcaagcucaauuauuccccucauacacaugaggacagacaaaaccacauguuuguuacacauggcacacaaguccuaauuguccaguuaauccagccuaguacaaauaugcaccuuccaauguucagaucuaaacauaaauuacaaaauggaacauuauaagaaaaaaauuguucucaucagcccuuugccgggagccugacccucuugacaagggucucuuggcuuucuaaaagcuuuuuuuagagaggguagaacugcccugcgucaagcauauguacacuuuaacccuucguggggggagcaaagauuuuuaaagccaaaagaagagacuugucuaaaguuaagaagucauugcugccucuucuuaagcuuuugugggguuuguguuuuuuagauggguuuuggcuacaaacuugugagaaaaauuaguacaggcagguacauuaaaaaaaaaauagcuguugauuaaaacaauaagaacaacagcaacagcaacaacaaaaaccaacccucccaacagggaaacacagcauggauucuauagucaucugauucccaugauucacagagacaaaauggcagccuacccacaaugcaucugaugucauugacaucugcuacucugauaucuggacaauauucuaaccuuggcccaugucccucccacaggguaguacauaucccuccuguacacauaauucuagggggaguuuacucauuugguuugcucccaccccucacaagacuaacagaagcagccacccaagacugugagcacuccccagagaugaaagcaugcuaauucauuauauagauuucugggaguuuaacagaacugcaggcucuuuccaagcgcugguuaacccgggggcucacacuuggacucacauagcgagcgauggccuuagaauuccagggguggggucccugauugguuugagcucagucugucagccaacguuuuuccuggguucucuuucaggaauucuaugagcaugccaaggcucugugggaggaugagggagugcgugccugcuacgagcgcuccaaugaguaccagcugauugacugugcccaguaguaaguagcuguccccccauggcaaaacagaagcucagaagccaggaagcuacaaacccaccaguagucagagaguuccagucugguucauuuguuuuauaaagcuuuuaauugcacuuuauagaccacugauacuguuuuacauaaacaauuaauaccugcuagagcaaggcaaaauacuuacuuguaauaaagugguauaacucacggauaugaacucuaagcauuuaggggcgcacacaguguagcaaacacauacuggccuccucauauaaaauacacagacuuuuuauuguucaguaccuuauaaggcacuucagcuucaugaugggagggggacagugacccuuuccuaggcucacucucccauggggacuuguugcuacauauauagcaugucaugacuuaauacacacaguuauauauucuuucaaggaacugaaaagcagccccacaggccccagcccccacaccuccuccagcaaaguuccugauuuuucucaaaaguuuguacuaaaagcuggaagcacuaauuauagaaacagaaaacaaauggagauccuggaauuguuugugauuuguauuuuggauccaauucaggaguuaaguacagauacaagaugaggaggcucagcuacccgguagggaauugcuggggucaguuuccuaacugauuaacagugauuuagccagguucuuuggggaucacaccacuuuaaggaugucuuguuguugaaagcagugcaaucuacuccugaacacuguaccacguggcaccaacuucaagaaaaagaaaacaacuuucaaguuguguaagaggccucuccccagccugagugcacaguggcccgcucauuugucuaacugccuuuuugcuggaggcacugggccuggaccugguugguucuuaaacugccagguuuguguuuguugagcugcaguuuggcuggccccacuccagaugucuucucacaagauuuggugcuaaggaucuauuuauagaauugugguucuguugccauggcaacaugcuggaggccaggguggcuggggagcuauuugugggccugugcuguaauguaagauugauugggccaguuaguguauccucuaagccagacuaacucggaacugguaaaaaggaaggggaaggagaaaaaaaaaaaaaaacacaaaacaaaaaaacucaggggcuuucuuuaaauagacuaugcuccuuucugguuggucuacuuuaaaagaguucccagcccucuggcccuuggcccccaaauccuccaaacuaguauuaauauuacuuuuucauauuacauuaucucaguccugcaaaaggcaaaaguuaauuuuccuguguuuauagucgagcaacuuuucuuucuucuuguuuuguuuuguuuuuguuuuuuuuaaacuaaaaguuugcuaucucaaacuuuuucuguuucacagacccaguagauaggaagggaacuucgucuuugcuuccuguucaaaguggugaaugcaagaacagccccuuugugcccacagcuugucuuggcucaguucucaauaaugaaugagagucuuccaaagcagacagggagagggcuggcucugcuuuguccuggacagagaccugugcacccuuaaacccgcacuuguacauugcuuuaggaaagggaugaaguuuuaaacuucucuuacaugucaaaagcaagggcggaucccaccaccacuugccuuacgggguacacacuuggcacacacugaccaccgugucuccuuuucuuucaagcuuccuggacaagauugaugugaucaagcaggccgacuacgugccaagugaccagguacgcgugcgccucuguccucaagccugggguuccacguugcugguucuucuccgggcaauuagggugagaccuacugaccccccucuuuguucuaggaccugcuucgcugccguguccugaccucuggaaucuuugagaccaaguuccagguggacaaagucaacuuccaguaagugaaucguugucccgccccaacuaucuggccuggagaguggugggcccaggguaacccaguauuuuccgguuccagcauguucgaugugggcggccagcgcgaugagcgccgcaaguggauccagugcuucaaugaugugacugccaucaucuucgugguggccagcagcagcuacaacauggucauucgggaggacaaccagacuaaccgccugcaggaggcucugaaccucuucaagagcaucuggaacaacaggugcguggggucucccugacuuggcucaaccuguaggucugcagcuugcucuggccccagcucucaccuggccccucucuccucagauggcugcgcaccaucucugugauucucuuccucaacaagcaagaccugcuugcugagaaaguccucgcuggcaaaucgaagauugaggacuacuuuccagaguucgcucgcuacaccacuccugaggaugguacggucauggcgcugguuuagucaggugguucuugggcacaagguguggcugagagucccuagccccucccacuauggggaagccagggacauuuauuucccucauuuucauaggcagagaucaagaguuugggggugaugagcuacaauggugucagacuaggucuucuaagcuaauuagcauaauuaauaauuuuuuuuuuuguagcgacucccgagccgggagaggacccacgcgugacccgggccaaguacuucauucgggaugaguuucuggugaguaggacuuguagucccuuacuccuccucacgaguauucuccagucagugcuggauuuggagacugagcgguccaggccuuccauuguauuguacuaugaguugauggcugguccucuggugguggggugaggggcuccuggagaggguugcuugaccgagccccucucucugccuacagagaaucagcacugcuaguggagaugggcgccacuacugcuacccucacuuuaccugcgccguggacacugagaacauccgccgugucuucaacgacugccgugacaucauccagcgcaugcaucuccgccaauacgagcugcucuaagaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaaaauacgguguugcucuuugauuugcggcaagugggucccaggguccaugggugggauuggucucggcacccacugggagguggagaacaggucccagggcuaaaagugggcugaggaguuggcacuauagacugggggaaccuaguuuuuggcgcaucaaagcuuccacccauuauccugcccccaggcaguugcuagcugcccuuugaccaauuacuuccccgaaugaggcaagcagccuacagagaaggcuggggaugugaugggugggggagaugggaguuauuugggaaacauuugaaagcauucccacuccaagaugaauuagugaaaauuaauuaagcacauuuaaguuaagaguuuugggcauaugauugggcaugugauggggcacauguggggaggccuaacacaugauugggcauaagaugggggcauacgcaugggggcccaacauaugcuugggcaugagaagggggacacaugggggaccaacauaugauugggcaugagauggggcacauguggggaggcccaacauaugauugggcauaagaugggggcccaacauaugauugggugugagaagggggacauauggggaggcccaacauaugauuggguaugagaugggacacaugggggcccaacauaugauugcaugugagauggggcacauguggaaaggcccaacauaugauugugcaugagauggggcacacaugggcaggcccaacauaugauugggugugagaauggggacauauggggaggccaaacauaugauugggugugagaagggggacagaugggggccccgaauaugauuggguaugagauggggcacaaaugggggcccaacauaugauugggugugagaagggggacauauggggaggcccaacauaugauuggguaugagaugggacacauggggcccaacauaugauugggugugagaagggggacauauggggaggcccaacauaugauuggguaugagaugggacacauggggcccaacauaugauuggguaugagaaacgggacauauggggaggcccaacauaugauuggguauagaugggacacauggggacccaacauaugauugggugugagaagggggacauauggggaggcccaacauaugauuggguaugagaugggacacaugggggcccaacauaugauuggguaugagaagggggacauauggggaggcccaacauaugauuggguaugagaugggacacaugggggcccaacauaugauugggugugagaugggggacccaugggggcccaacauaugauugcaugugagauggggcacauguggaaaggcccaacacaugauugugcaugagauggggcacacaugggcaggcccaacauaugauugggugugagaagggggacagaugggggccccacauaugauuggguaugagaugggacacaugggggcccaacauaugauuggguaugagaagggggacauauggggaggcccaacauaugauuggguaugagaugggacacauggggcccaacauaugauugggugugagaaacgggacauauggggaggcccaacauaugauuggguaugagaugggacacauggggacccaauauaugauugggugugagaaacgggacauauggggaggcccaacauaugauuggguauagaugggacacauggggacccaacauaugauugggugugagaagggggacauauggggaggcccaacauaugauuggguaugagaugggacacauggggcccaacauaugauuggauaugagaugggacacauggggacccaauauaugauugggcaugagaagggggacauauggggaggcccaacauaugauuggguaugagaugggacacauggggcccaacauaugauuggguaugagaugggacacaugggggcccaacauaugauugggcaugagaagggggacauauggggaggcccaacauaugauuggguaugagaugggacacauggggcccaacauaugauugggugugagaagcgggaccuaugaggaggcccaacauaugauuggguaugagaugggacacaugggggcccaacauauuauugggugugagaaggggaacaauagggaagcccagagaaaagccuaacuggauuaugacuuggaccugccucaucuuuacccuucagucucauaccccaaguuugugcuuaucauacagggaagagcccagaguugagcccagcauuaacauaccaugucucugaaauggaccaaaggagacauuagucaaguuaauucuguaaccaagaccacaaaguaugccaacuauucuauuauccaaauuaauuaaacccagguagauuaaauuuuauaguuuaucucagauaugguugccacgaagggccacaaaaggaguucuuaccauucacuguaucucucucuaugucuucccaaagcuagaucacacuaccucaaccuaguaauuaaaauaugcagauuuuggugcaaaauaaacccagaacucucucuaaauaauucaaguaaagguggaggcuugcuucgcaaguauccagucaagcccacaaauucccauaaucccucaaaagcauccaguaaauguauauuccaagauggagguuugcugggcaaauagaagacacuccagaauuccuauaauuuuccaaccccucuaguaaucaaaauaaacauucauuccaagggccuguuaugcacacgucagagcaacagacaaacucccacaaucccuccaaacuauccauaaacacaaucuaggauggaggcucaauaugcaaauagcaagaccucuucaaguucccauacucgucuaaagaucccuaauaaacauaauaaacaguccggugacaugcuauccacauagccaaaaagacagaacucaaaauucccacaaucccucaaauauaaacauauauuccaagauggagccuugauaugcacauaggcagaagacaugcccacaaauucccacaguguuucaaaccuauccaauaaaaugcacaauucaagauggcagcuuuuauacaacuaucaagaagacacuuaauaaauucccauaauccuucuuuugcucccccccccaaauaaacauacaauagaaauaaagauggggcugguuaugcaaguagccaaaagacagguccacaaauucucaugauuccucaaaacuagcaaauaaaugcacaaucuaagauagagacuuaauaugcaaauaacuagaaggcacacccaaaaauucccauaaucccucaaagcuuuccaauaaacaugcaacccaugauggagggcuggcaugcaaauagauagaggacacaccuacaauuucccauaaucucuucagacuauuccauaaguucauaaucuaaguuggggcuugcuauacaacuagccagaagacagcccucccaaauuuccacaaucucucaaaaguauuuaauaaaugcacacuuuaagauggagguuuaauuugcaaacagcuagaauucacccccauaaauucucacaaucccuuaaaacuauccaaaaaguauacaacccaagaugaaggcuugcugugcaaagcuagaagacacuccccucaaaccuuuaaagucuucuguugaugauuucuguuaacauaauaaauauccaauccagugacuugcuaugcaaauagcuagaugauaggccuaccaguucccacaucuaucaaaauuauccaauaaauacauaaucuaagaugcaaacagcuaggagacacacccacaacaucccacaauuccucacacugucugcuaagcacacacuacaagaugauggcuugcuaaggaaauagccagaucagucuacaaauuucuguaauccccccaaacuagacaauaaauacauaaucuaagauggaggcuuucuauacaaauacccagaagacccuuaaaucccauagucuuacaaagaccuccauuaauuagcacaguaaacauccaaccuaaugauuuacuaugcagauugccaaauaugcccauaaaauuuaugauccuccacugacaugcccuauuaacauaauauucaauccaaugacuugccauacaaauaaaugagacaggcccacaaauucccacaaucacuaaaaacuauccaauaaauauacaaucuaagauggagauuugcuaugcaaauaauugccagccccaaauuccugaaauucuccaaagacucccaauuaacauuauaaacauugagcacaaggcuuagaugcaaauagccagagcagcccacacauagcacaauaccucacagacccccaaauaaauucagaaacaaaacucauucucuugcauucaccugaaaauauaaaacuauauaaacagcuaccaggaaagcuaagguugaccccucagauucugucccaagguggcuuccgguaguccucuccuuccuagaaauucuagagccuccccuggacaauacgcauaggauggcuuugcaugcaccaaauaggcuucaguguggaaacacacuuucccaugccacagggcaguuaugucaagugaaugucaauaccgaucaguaggugauuguuugccuacagcugccauuuuauccaagaguaaugaaggcuuagagaaacccuagugaagacagguuucuaccgauggguuaaaauucugcugcuugaccacugcccuacccuguugccuaugaagaugcuggaagacaggaaaucaucuccuaguguucugccacaaugccaguagucaggaguccagaacaugugacuccaaggggaaauccuguagggugccaugggauuccacgaucuggugggagguuggaugcucuucgcucagagacuggccuugcaaaugcucuuuccucucucuacgggccccuggguuugucuccgggacccuaccgccuacucgguuguauucaagccuuuucccccaacuguaggauucugcuuaaaacauuuuaaauuccauuucucuuuuguccugguacuagauuuacuaauuuucauuuugucacucuaauggaaaauugauagucauuuuccuaauguacauugacuaccucauacauguauuuuuauguacgucauguagcuguuuaaaauucuagaauuuuaagaauucaaaaaggguucagggagucauuaaguugccaccgggguuuuuuuugcuuguuugcuuuguuuuguuuuguuaaaaauaaauauucaggcucaauuuuaagucuucauuugaauguaaaacaacguauuuucuaaagguaacgacuugugccacacuguacucaggggucacgaauuuuacacgaugguucaaagaccuuuuggagaccaaaauguaaaaguagauggagagaggccucugugacggaggggcuagaacccagugagcucucuguccuacuccugugucggccaccuuuaucugaaaaggaaggauggcacccacagagccuguuuagcaucaggcucccucagaaggcugucagaauggcuuugaccauuuuacucccguuauggcgcaucaucuaugccagcaagcuaguuugcuuuuaugggguuucuguccuagcaggggagagagacagucucuuauuugccaaauaaacaaucaaaacauuuacaacuucaggcagagccucugagggguuaagcaauggagauaaugaaaaaugaggagagaaacuggggggauugucucuguuagacaggagagcagaaggaggccuuuggauggagggggcaauuuaaaaaaauauguauuuguuuuauuuuacuuguaggaguguuuggcuacacauaugcaugugcacuggguccuuuagaacuggaguuauagacaguuaugugggugcugggaacugaugguggguugugcauuaaaaugcaagagcagccagugucuuaaaccucugagcaucuugcuggcccacaggugacgguuuuaaagacaggagugugaaggacgggaaagagcuagccacuaggauaugaaagugccagcccuggcaccuagaucaccauuaauaauaaguauuguuguuauuaauuacuagugcauucaauagauauucuucaaguacuugaucuuugccauggaccaggacugcccaaggucuugaaagagcaucucauuuucuuuuaaacucuugggagagugucaauuguggcucugauggcaggccaaaucuuaucauauaagcaugagcuuaaaacucaaaacacauacauuauaucugcuaugaguaauuauauauauauauauaugaacugugcuuuuauuauaaagaguccuugcaagauggacuguugugaaguaagucgcuguuaccccauuucugcuuuagagcagacccucugugucuccagauaauuuuccuccauugaaauguccagauucugugagcagcuagaauuuccugggccuggcuauggccuuuauugauuaggaaaguuuucaacuguaaacaagagaacacugccucagagggacauagacaacuggucuuugucuugcugagcaugaauuccaagggcagggggcucccgaaguuucucagcagcccaccagagcagggcccaggccuccacaucugauaggcucucauggcugagagcagacggacguggaagugaauagacaggccaguuaaaggucuuuucugucuuucuuagaugccauuccguucgucccuucucuguggaacauauagauggaggugguugaagagccagcuggcuggacaccaugaucauauguuugucaugcucagcuguguguaccuuaauuugaauucuaguagugucugcaggugagcacggaacccaccacuuuucagucuacagaggcuaauuugcauaauucaguacacauaauuuagaugcuaagaagaaauaauuguucaggaaaaaaaaaguaccuaauaaaauugaccuccacagacacaaaaaucuaagaagaacaguucccacgugggacaaagcccugauuagagcaugcuaugacggacaggcuccuggcuagugugaggagugcuccgaguacaucuagcuucugcuuauuccuacaaaugugaauagugaagauauucugcuaagaaagcuuacugagcucuguguauuguaugcuauguguauuauauuucaaaguuuuuauuuaagcagggauaugguaccacacuuguaaucccagcacuuaggaaacugagacaggaggauuuugaauuccagguuacccugggcuaucagaauauauagagguuccagaucaggccaugagauuugguuuaaaacaaaaagaaaaagaaaaacaaaaagaaaaaagaaacguuaucugguuuuauuuugguuuuuaaaggcaucuggcccuuacaguuuuacaggagaauugugcuaaaccuaaaaaaaaaaauuauaugaucugaauuauucuuaaauuauaccaaagucugguaagaggaaaaugucaaguuuagcuuuuuguaguaaauauaaccuugucucugaagcaugcuauccccuuucucaauuaugaguaucaauguaaauauauaaaagcauuagcaaacagagucaaaaaugguauuaaagaauaaaacacauuguauccaaguauuauaggaauucaaguuuggcucaguauuguuaaaugcagcaauaguugccaaauuuuaacgcuaguuuauacuuuauaaauaaaauaaaauuaauauuuuaauuauauaugauugccauauacaacacauguaaaaucccuaaauacaauauacguauacauaaguaaaugcaauauccugaagucagcauauuaguuaauguagaaucucaaaagguguuuccacuagugucaggaacagggaauaaggaagauuugccucaugcuccaggcuauuaauauuauuauagagagaauaugauuaauauugggcagauaaaacaaagcaaggaaaagcuugagaacccaaaagaaauauuuuagccuuuuuuuugcagauuauuuaauuaaauuauaacuucucuuucccaaguacucccuagagaauagcuguuaaaauaagagggucagagcuggagagauggcucagugguuacaagcacugcugcuuuuggaccagaguucaguucccaacacacacauucagcagcucaccacugccuguaaccccagccccgggagaacugaggccuucuuccugccuccucaggcacugcacucauguuugcacacacucacacucacauaacuagaaauuaauaaagaaagacccagacugggcuaugagagacucccaagacucaaugggugugaccuuagcugaaauguccaacagugggaagaagaaacuugaagagaccgucuccaguagauagacagagccccaaguagagggacggguuuaccaacccacugucaaaauuucugacccagaauuguuccugucuaaaagaacugaaaggacaaaaauggagaagagacugaaggaaaggcuguucacugacccacccaacuuaagaucuaucccauggggguugggcaccaaggcuugacacuauuacugaugcuauaauaugcuuagagacaggagccuagcauggcuguccucugagagacccuaccagcagcugacugagauggauguagauacacccaaucauuggacugaagucagggacccauauggaggaauuaggggaaggaucgaaggagcugaaggggagggugaccccauaggaagaccagcagucucaacaaaccaggacccuggaugcucucagagacugagccaccaaccaaagagaguacacagggugguccaaggcccagguacuucuguagcagaggauugccuugucuggucucggugggaaaggauaugcccaauccuguagagacuugaggccccagggaaggaggauuuggguggggagagaaagggagcacccuucagaggcaaaggggagggugacugggaugaggcacugugguggggagggacugggagggagcaaugucuggaauguaaauaaauaaaaguaauuaaaaauaaauguaaguauuaacaugcuauaaaauuuaauaaagggucuagaggaagauggcucagacacuuagagucuuuccucuauugcagaggaccagaguucaguucccaggaucaguaucagucagcauacgaucuuuaauucuagcuccaaagaaucugaugcccuuuucuggcuuccucgggcacuacauugcugugugcauacaugcaugugcacguguacacacacacacacacacacacacacacacacacaaauuaauaaaagggcuggaaaggugacucaguggcuaagagcacuuacuuuccuugcagaggacuugaauucagcuccuaacauccacagcauguggcucacaaccucauaacuacaguucuagaggaacuaguguccucuggcuuucaugaacaccuggguguaugaagugccuaugaaaacucucucugucucugucugucucugucucugucucucucucucucucucucacucucucacacacacacacagagcaaaagaggcagacagagagauagacagagagacaguauauacgcacacagugggaguaguguuguggaaugaacaccuggauuaugcaguuucuaugaacacagagagagagagagagagagagagagagagagagagagaaagacagacagagagacacacacagagaaagagacacacacaguggggguaguguugugcaaugaguugaggcccccaggaaacagaagggcugcugaucucuuuuucuugacacugauguuaacucauuucauucccguggcucuugcagacagacuuccuuggccaucuucuuuuuuuuaaaauauuuuuuauuacauauuuuccacaauuauauuuccaaugcuaucccaaaagucccccauac

SEQ ID NO: 4 - RNA, 82424 nt, Mus musculus
guaugggggacuuuugggauagcauuggaaauauaauuguggaaaauauguaauaaaaaauauuuuaaaaaaaagaagauggccaaggaagucugucugcaagagccacgggaaugaaaugaguuaacaucagugucaagaaaaagagaucagcagcccuucuguuuccugggggccucaacucauugcacaacacuacccccacugugugugucucuuucucugugugugucucucugucugucuuucucucucucucucucucucucucucucucucucucucuguguucauagaaacugcauaauccagguguucauuccacaacacuacucccacugugugcguauauacugucucucugucuaucucucugucugccucuuuugcucugugugugugugugagagagugagagagagagagagagagacagagacagagacagacagagacagagagaguuuucauaggcacuucauacacccagguguucaugaaagccagaggacacuaguuccucuagaacuguaguuaugagguugugagccacaugcuguggauguuaggagcugaauucaaguccucugcaaggaaaguaagugcucuuagccacugagucaccuuuccagcccuuuuauuaauuuguguguguguguguguguguguguguguguguguacacgugcacaugcauguaugcacacagcaauguagugcccgaggaagccagaaaagggcaucagauucuuuggagcuagaauuaaagaucguaugcugacugauacugauccugggaacugaacucugguccucugcaauagaggaaagacucuaagugucugagccaucuuccucuagacccuuuauuaaauuuuauagcauguuaauacuuacauuuauuuuuaauuacuuuuauuuauuuacauuccagacauugcucccucccagucccuccccaccacagugccucaucccagucacccuccccuuugccucugaagggugcucccuuucucuccccacccaaauccuccuucccuggggccucaagucucuacaggauugggcauauccuuucccaccgagaccagacaaggcaauccucugcuacagaaguaccugggccuuggaccacccuguguacucucuuugguugguggcucagucucugagagcauccaggguccugguuuguugagacugcuggucuuccuauggggucacccuccccuucagcuccuucgauccuuccccuaauuccuccauaugggucccugacuucaguccaaugauuggguguaucuacauccaucucagucagcugcugguagggucucucagaggacagccaugcuaggcuccugucucuaagcauauuauagcaucaguaauagugucaagccuuggugcccaacccccaugggauagaucuuaaguugggugggucagugaacagccuuuccuucagucucuucuccauuuuuguccuuucaguucuuuuagacaggaacaauucugggucagaaauuuugacaguggguugguaaacccgucccucuacuuggggcucugucuaucuacuggagacggucucuucaaguuucuucuucccacuguuggacauuucagcuaaggucacacccauugagucuugggagucucucauagcccagucugggucuuucuuuauuaauuucuaguuaugugagugugagugugugcaaacaugagugcagugccugaggaggcaggaagaaggccucaguucucccggggcugggguuacaggcaguggugagcugcugaauguguguguugggaacugaacucugguccaaaagcagcagugcuuguaaccacugagccaucucuccagcucugacccucuuauuuuaacagcuauucucuagggaguacuugggaaagagaaguuauaauuuaauuaaauaaucugcaaaaaaaaggcuaaaauauuucuuuuggguucucaagcuuuuccuugcuuuguuuuaucugcccaauauuaaucauauucucucuauaauaauauuaauagccuggagcaugaggcaaaucuuccuuauucccuguuccugacacuaguggaaacaccuuuugagauucuacauuaacuaauaugcugacuucaggauauugcauuuacuuauguauacguauauuguauuuagggauuuuacauguguuguauauggcaaucauauauaauuaaaauauuaauuuuauuuuauuuauaaaguauaaacuagcguuaaaauuuggcaacuauugcugcauuuaacaauacugagccaaacuugaauuccuauaauacuuggauacaauguguuuuauucuuuaauaccauuuuugacucuguuugcuaaugcuuuuauauauuuacauugauacucauaauugagaaaggggauagcaugcuucagagacaagguuauauuuacuacaaaaagcuaaacuugacauuuuccucuuaccagacuuugguauaauuuaagaauaauucagaucauauaauuuuuuuuuuuagguuuagcacaauucuccuguaaaacuguaagggccagaugccuuuaaaaaccaaaauaaaaccagauaacguuucuuuuuucuuuuuguuuuucuuuuucuuuuuguuuuaaaccaaaucucauggccugaucuggaaccucuauauauucugauagcccaggguaaccuggaauucaaaauccuccugucucaguuuccuaagugcugggauuacaagugugguaccauaucccugcuuaaauaaaaacuuugaaauauaauacacauagcauacaauacacagagcucaguaagcuuucuuagcagaauaucuucacuauucacauuuguaggaauaagcagaagcuagauguacucggagcacuccucacacuagccaggagccuguccgucauagcaugcucuaaucagggcuuugucccacgugggaacuguucuucuuagauuuuugugucuguggaggucaauuuuauuagguacuuuuuuuuuccugaacaauuauuucuucuuagcaucuaaauuauguguacugaauuaugcaaauuagccucuguagacugaaaagugguggguuccgugcucaccugcagacacuacuagaauucaaauuaagguacacacagcugagcaugacaaacauaugaucaugguguccagccagcuggcucuucaaccaccuccaucuauauguuccacagagaagggacgaacggaauggcaucuaagaaagacagaaaagaccuuuaacuggccugucuauucacuuccacguccgucugcucucagccaugagagccuaucagauguggaggccugggcccugcucuggugggcugcugagaaacuucgggagcccccugcccuuggaauucaugcucagcaagacaaagaccaguugucuaugucccucugaggcaguguucucuuguuuacaguugaaaacuuuccuaaucaauaaaggccauagccaggcccaggaaauucuagcugcucacagaaucuggacauuucaauggaggaaaauuaucuggagacacagagggucugcucuaaagcagaaaugggguaacagcgacuuacuucacaacaguccaucuugcaaggacucuuuauaauaaaagcacaguucauauauauauauauauaauuacucauagcagauauaauguauguguuuugaguuuuaagcucaugcuuauaugauaagauuuggccugccaucagagccacaauugacacucucccaagaguuuaaaagaaaaugagaugcucuuucaagaccuugggcaguccugguccauggcaaagaucaaguacuugaagaauaucuauugaaugcacuaguaauuaauaacaacaauacuuauuauuaauggugaucuaggugccagggcuggcacuuucauauccuaguggcuagcucuuucccguccuucacacuccugucuuuaaaaccgucaccugugggccagcaagaugcucagagguuuaagacacuggcugcucuugcauuuuaaugcacaacccaccaucaguucccagcacccacauaacugucuauaacuccaguucuaaaggacccagugcacaugcauauguguagccaaacacuccuacaaguaaaauaaaacaaauacauauuuuuuuaaauugcccccuccauccaaaggccuccuucugcucuccugucuaacagagacaauccccccaguuucucuccucauuuuucauuaucuccauugcuuaaccccucagaggcucugccugaaguuguaaauguuuugauuguuuauuuggcaaauaagagacugucucucuccccugcuaggacagaaaccccauaaaagcaaacuagcuugcuggcauagaugaugcgccauaacgggaguaaaauggucaaagccauucugacagccuucugagggagccugaugcuaaacaggcucugugggugccauccuuccuuuucagauaaagguggccgacacaggaguaggacagagagcucacuggguucuagccccuccgucacagaggccucucuccaucuacuuuuacauuuuggucuccaaaaggucuuugaaccaucguguaaaauucgugaccccugaguacaguguggcacaagucguuaccuuuagaaaauacguuguuuuacauucaaaugaagacuuaaaauugagccugaauauuuauuuuuaacaaaacaaaacaaagcaaacaagcaaaaaaaaccccgguggcaacuuaaugacucccugaacccuuuuugaauucuuaaaauucuagaauuuuaaacagcuacaugacguacauaaaaauacauguaugagguagucaauguacauuaggaaaaugacuaucaauuuuccauuagagugacaaaaugaaaauuaguaaaucuaguaccaggacaaaagagaaauggaauuuaaaauguuuuaagcagaauccuacaguugggggaaaaggcuugaauacaaccgaguaggcgguagggucccggagacaaacccaggggcccguagagagaggaaagagcauuugcaaggccagucucugagcgaagagcauccaaccucccaccagaucguggaaucccauggcacccuacaggauuuccccuuggagucacauguucuggacuccugacuacuggcauuguggcagaacacuaggagaugauuuccugucuuccagcaucuucauaggcaacaggguagggcaguggucaagcagcagaauuuuaacccaucgguagaaaccugucuucacuaggguuucucuaagccuucauuacucuuggauaaaauggcagcuguaggcaaacaaucaccuacugaucgguauugacauucacuugacauaacugcccuguggcaugggaaaguguguuuccacacugaagccuauuuggugcaugcaaagccauccuaugcguauuguccaggggaggcucuagaauuucuaggaaggagaggacuaccggaagccaccuugggacagaaucugaggggucaaccuuagcuuuccugguagcuguuuauauaguuuuauauuuucaggugaaugcaagagaaugaguuuuguuucugaauuuauuugggggucugugagguauugugcuaugugugggcugcucuggcuauuugcaucuaagccuugugcucaauguuuauaauguuaauugggagucuuuggagaauuucaggaauuuggggcuggcaauuauuugcauagcaaaucuccaucuuagauuguauauuuauuggauaguuuuuagugauugugggaauuugugggccugucucauuuauuuguauggcaagucauuggauugaauauuauguuaauagggcaugucaguggaggaucauaaauuuuaugggcauauuuggcaaucugcauaguaaaucauuagguuggauguuuacugugcuaauuaauggaggucuuuguaagacuaugggauuuaagggucuucuggguauuuguauagaaagccuccaucuuagauuauguauuuauugucuaguuuggggggauuacagaaauuuguagacugaucuggcuauuuccuuagcaagccaucaucuuguagugugugcuuagcagacagugugaggaauugugggauguugugggugugucuccuagcuguuugcaucuuagauuauguauuuauuggauaauuuugauagaugugggaacugguaggccuaucaucuagcuauuugcauagcaagucacuggauuggauauuuauuauguuaacagaaaucaucaacagaagacuuuaaagguuugaggggagugucuucuagcuuugcacagcaagccuucaucuuggguuguauacuuuuuggauaguuuuaagggauugugagaauuuaugggggugaauucuagcuguuugcaaauuaaaccuccaucuuaaagugugcauuuauuaaauacuuuugagagauuguggaaauuugggagggcugucuucuggcuaguuguauagcaagccccaacuuagauuaugaacuuauggaauagucugaagagauuaugggaaauuguagguguguccucuaucuauuugcaugccagcccuccaucauggguugcauguuuauuggaaagcuuugagggauuaugggaauuuuugggugugccuucuaguuauuugcauauuaagucucuaucuuagauugugcauuuauuugcuaguuuugaggaaucaugagaauuuguggaccugucuuuuggcuacuugcauaaccagccccaucuuuauuucuauuguauguuuauuugggggggggagcaaaagaaggauuaugggaauuuauuaagugucuucuugauaguuguauaaaagcugccaucuugaauugugcauuuuauuggauagguuugaaacacugugggaauuugugggcaugucuucugccuaugugcauaucaaggcuccaucuuggaauauauguuuauauuugagggauugugggaauuuugaguucugucuuuuuggcuauguggauagcaugucaccggacuguuuauuauguuuauuagggaucuuuagacgaguaugggaacuugaagaggucuugcuauuugcauauugagccuccauccuagauuguguuuauggauaguuuggagggauugugggaguuugucuguugcucugacgugugcauaacaggcccuuggaaugaauguuuauuuugauuacuagagggguuggaaaauuauaggaauucuggagugucuucuauuugcccagcaaaccuccaucuuggaauauacauuuacuggaugcuuuugagggauuaugggaauuugugggcuugacuggauacuugcgaagcaagccuccaccuuuacuugaauuauuuagagagaguucuggguuuauuuugcaccaaaaucugcauauuuuaauuacuagguugagguagugugaucuagcuuugggaagacauagagagagauacagugaaugguaagaacuccuuuuguggcccuucguggcaaccauaucugagauaaacuauaaaauuuaaucuaccuggguuuaauuaauuuggauaauagaauaguuggcauacuuuguggucuugguuacagaauuaacuugacuaaugucuccuuugguccauuucagagacaugguauguuaaugcugggcucaacucugggcucuucccuguaugauaagcacaaacuugggguaugagacugaaggguaaagaugaggcagguccaagucauaauccaguuaggcuuuucucugggcuucccuauuguuccccuucucacacccaauaauauguugggcccccaugugucccaucucauacccaaucauauguugggccuccucauaggucccgcuucucacacccaaucauauguugggccccaugugucccaucucauacccaaucauauguugggccuccccauaugucccccuucucaugcccaaucauauguugggcccccaugugucccaucucauacccaaucauauguugggccccaugugucccaucucauacccaaucauauguugggccuccccauaugucccccuucucaugcccaaucauauauuggguccccaugugucccaucucauauccaaucauauguugggccccaugugucccaucucauacccaaucauauguugggccuccccauaugucccccuucucacacccaaucauauguuggguccccaugugucccaucuauacccaaucauauguugggccuccccauaugucccguuucucacacccaaucauauauuggguccccaugugucccaucucauacccaaucauauguugggccuccccauaugucccguuucucacacccaaucauauguugggccccaugugucccaucucauacccaaucauauguugggccuccccauaugucccccuucucauacccaaucauauguugggcccccaugugucccaucucauacccaaucauauguggggcccccaucugucccccuucucacacccaaucauauguugggccugcccaugugugccccaucucaugcacaaucauguguugggccuuuccacaugugccccaucucacaugcaaucauauguugggcccccaugggucccccaucucacacccaaucauauguugggcccccaugugucccaucucauacccaaucauauguugggccuccccauaugucccccuucucauacccaaucauauguugggcccccaugugucccaucucauacccaaucauauguugggccuccccauaugucccccuucucacacccaaucauauguuggguccccaugugucccaucuauacccaaucauauguugggccuccccauaugucccguuucucauacccaaucauauguugggccccaugugucccaucucauacccaaucauauguugggccuccccauaugucccccuucucacacccaaucauauguugggccccaugugucccaucucauacccaaucauauguugggccuccccauaugucccccuucucacacccaaucauauguugggcccccauuugugccccaucucauacccaaucauauucggggcccccaucugucccccuucucacacccaaucauauguuuggccuccccauauguccccauucucacacccaaucauauguugggccugcccaugugugccccaucucaugcacaaucauauguugggccuuuccacaugugccccaucucacaugcaaucauauguugggcccccaugugucccaucucauacccaaucauauguugggccuccccauaugucccccuucucacacccaaucauauguugggcccccaucuuaugcccaaucauauguugggccuccccacaugugccccaucucaugcccaaucauauguuggucccccaugugucccccuucucaugcccaagcauauguugggcccccaugcguaugcccccaucuuaugcccaaucauguguuaggccuccccacaugugccccaucacaugcccaaucauaugcccaaaacucuuaacuuaaaugugcuuaauuaauuuucacuaauucaucuuggagugggaaugcuuucaaauguuucccaaauaacucccaucucccccacccaucacauccccagccuucucuguaggcugcuugccucauucggggaaguaauuggucaaagggcagcuagcaacugccugggggcaggauaauggguggaagcuuugaugcgccaaaaacuagguucccccagucuauagugccaacuccucagcccacuuuuagcccugggaccuguucuccaccucccagugggugccgagaccaaucccacccauggacccugggacccacuugccgcaaaucaaagagcaacaccguauuuugcucauuuuuaauuuuuauugauuuuuuaaugcugcacaacacaauauuuauuucauuuugaauuucauuuauuucuuuauuucuguugcugcuuuuauuuuauuuacugaaagugagagggaacuuuuguggccuuuuuuuucuuuuucuucuguaggccgccuuaagcuuacuaaauuuggaacaucuaagcaagcugaagggaagagggguuuuucagaaucacugggggaaaaaggaaagguugcgguguugaucaugcccuauggugggugaccaacugcuuguacaauuacguuucacucuuaauuaauugugcuuaaggcugaauuaaauuuggguguucccuucuuagagcagcucguauuggcggagaugcaugcgcuggaugaugucacggcagucguugaagacacggcggauguucucaguguccacggcgcagguaaagugaggguagcaguaguggcgcccaucuccacuagcagugcugauucucuguaggcagagagaggggcucggucaagcaacccucuccaggagccccucaccccaccaccagaggaccagccaucaacucauaguacaauacaauggaaggccuggaccgcucagucuccaaauccagcacugacuggagaauacucgugaggaggaguaagggacuacaaguccuacucaccagaaacucaucccgaaugaaguacuuggcccgggucacgcguggguccucucccggcucgggagucgcuacaaaaaaaaaaauuauuaauuaugcuaauuagcuuagaagaccuagucugacaccauuguagcucaucacccccaaacucuugaucucugccuaugaaaaugagggaaauaaaugucccuggcuuccccauagugggaggggcuagggacucucagccacaccuugugcccaagaaccaccugacuaaaccagcgccaugaccguaccauccucaggagugguguagcgagcgaacucuggaaaguaguccucaaucuucgauuugccagcgaggacuuucucagcaagcaggucuugcuuguugaggaagagaaucacagagauggugcgcagccaucugaggagagaggggccaggugagagcuggggccagagcaagcugcagaccuacagguugagccaagucagggagaccccacgcaccuguuguuccagaugcucuugaagagguucagagccuccugcaggcgguuagucugguuguccucccgaaugaccauguuguagcugcugcuggccaccacgaagaugauggcagucacaucauugaagcacuggauccacuugcggcgcucaucgcgcuggccgcccacaucgaacaugcuggaaccggaaaauacuggguuacccugggcccaccacucuccaggccagauaguuggggcgggacaacgauucacuuacuggaaguugacuuuguccaccuggaacuuggucucaaagauuccagaggucaggacacggcagcgaagcagguccuagaacaaagaggggggucaguaggucucacccuaauugcccggagaagaaccagcaacguggaaccccaggcuugaggacagaggcgcacgcguaccuggucacuuggcacguagucggccugcuugaucacaucaaucuuguccaggaagcuugaaagaaaaggagacacgguggucagugugugccaaguguguaccccguaaggcaagugguggugggauccgcccuugcuuuugacauguaagagaaguuuaaaacuucaucccuuuccuaaagcaauguacaagugcggguuuaagggugcacaggucucuguccaggacaaagcagagccagcccucucccugucugcuuuggaagacucucauucauuauugagaacugagccaagacaagcugugggcacaaaggggcuguucuugcauucaccacuuugaacaggaagcaaagacgaaguucccuuccuaucuacugggucugugaaacagaaaaaguuugagauagcaaacuuuuaguuuaaaaaaaacaaaaacaaaacaaaacaagaagaaagaaaaguugcucgacuauaaacacaggaaaauuaacuuuugccuuuugcaggacugagauaauguaauaugaaaaaguaauauuaauacuaguuuggaggauuugggggccaagggccagagggcugggaacucuuuuaaaguagaccaaccagaaaggagcauagucuauuuaaagaaagccccugaguuuuuuuguuuuguguuuuuuuuuuuuuuucuccuuccccuuccuuuuuaccaguuccgaguuagucuggcuuagaggauacacuaacuggcccaaucaaucuuacauuacagcacaggcccacaaauagcuccccagccacccuggccuccagcauguugccauggcaacagaaccacaauucuauaaauagauccuuagcaccaaaucuugugagaagacaucuggaguggggccagccaaacugcagcucaacaaacacaaaccuggcaguuuaagaaccaaccagguccaggcccagugccuccagcaaaaaggcaguuagacaaaugagcgggccacugugcacucaggcuggggagaggccucuuacacaacuugaaaguuguuuucuuuuucuugaaguuggugccacgugguacaguguucaggaguagauugcacugcuuucaacaacaagacauccuuaaaguggugugauccccaaagaaccuggcuaaaucacuguuaaucaguuaggaaacugaccccagcaauucccuaccggguagcugagccuccucaucuuguaucuguacuuaacuccugaauuggauccaaaauacaaaucacaaacaauuccaggaucuccauuuguuuucuguuucuauaauuagugcuuccagcuuuuaguacaaacuuuugagaaaaaucaggaacuuugcuggaggaggugugggggcuggggccuguggggcugcuuuucaguuccuugaaagaauauauaacuguguguauuaagucaugacaugcuauauauguagcaacaaguccccaugggagagugagccuaggaaagggucacugucccccucccaucaugaagcugaagugccuuauaagguacugaacaauaaaaagucuguguauuuuauaugaggaggccaguauguguuugcuacacugugugcgccccuaaaugcuuagaguucauauccgugaguuauaccacuuuauuacaaguaaguauuuugccuugcucuagcagguauuaauuguuuauguaaaacaguaucaguggucuauaaagugcaauuaaaagcuuuauaaaacaaaugaaccagacuggaacucucugacuacugguggguuuguagcuuccuggcuucugagcuucuguuuugccauggggggacagcuacuuacuacugggcacagucaaucagcugguacucauuggagcgcucguagcaggcacgcacucccucauccucccacagagccuuggcaugcucauagaauuccugaaagagaacccaggaaaaacguuggcugacagacugagcucaaaccaaucagggaccccaccccuggaauucuaaggccaucgcucgcuaugugaguccaagugugagcccccggguuaaccagcgcuuggaaagagccugcaguucuguuaaacucccagaaaucuauauaaugaauuagcaugcuuucaucucuggggagugcucacagucuuggguggcugcuucuguuagucuugugaggggugggagcaaaccaaaugaguaaacucccccuagaauuauguguacaggagggauauguacuacccugugggagggacaugggccaagguuagaauauuguccagauaucagaguagcagaugucaaugacaucagaugcauuguggguaggcugccauuuugucucugugaaucaugggaaucagaugacuauagaauccaugcuguguuucccuguugggaggguugguuuuuguuguugcuguugcuguuguucuuauuguuuuaaucaacagcuauuuuuuuuuuaauguaccugccuguacuaauuuuucucacaaguuuguagccaaaacccaucuaaaaaacacaaaccccacaaaagcuuaagaagaggcagcaaugacuucuuaacuuuagacaagucucuucuuuuggcuuuaaaaaucuuugcuccccccacgaaggguuaaaguguacauaugcuugacgcagggcaguucuacccucucuaaaaaaagcuuuuagaaagccaagagacccuugucaagagggucaggcucccggcaaagggcugaugagaacaauuuuuuucuuauaauguuccauuuuguaauuuauguuuagaucugaacauuggaaggugcauauuuguacuaggcuggauuaacuggacaauuaggacuugugugccauguguaacaaacaugugguuuugucuguccucauguguaugaggggaauaauugagcuugccuuagcucaggaccucuccuccauaaaaaaaaacucacuaucugauaaauggaggacuagguugaggucuagaaaaggugauggaacuuuguucauccauuuuggacaaagcccuaaucaugucuuuaucauccuuuagucuuaggcauaugccuggaguuaacuuaugcauucacacggcagguaugugucuggucacucuggccugaugcaagucuggcccucguguucccacugggacuaaggugagaggggcagaggaaaccaggguuaggguggagcuuacaggugggaagucaaaguucggcacguucaucacgcucagaauguaguccacucugaacugguucucaggguuggccagcuccacagggggcaccagguugcucauggcggccacaauggucugaaaacaguuuagcaaauuggucaggcguggggguggggggggcagcaccguggggcgaggggcuugcuaaaagauaagagcaaggagcuagacacauacuucaauggccuccuucagguuguuuuugauguccugcacuuuaguggccuucucacuacagugggauugaaaggaaaaaaaaaagaaaaucauauugcauccugcccaccaggguguuaucgucauugagacacgucaacuaaaaagcauaguauucuguuuuccaaggaauugugggcuagaucuauagauugaaggcauccaaauaaaaauaaaucauaauuucccaaucauguccugaggacaggccugauaaggcuggguuagagacauggcaucgagaucuugauuaacuggaccagaaauugcaccuggucuacuguccauuccaaccacacccugcugcuuccugcguggcucuugauuagcacagggaggguuguauggagguaggguuaguacaugcugaacuugggauucaguaguuugugagacccagaggugacaaguguuuauuauugauauuaggguuuuccauuuccauauuuguagaucuaauuauuuaaguaucuaugcaucugucaccagggagggaagauguuguuugggguucuguggcucacagcacuuuugaacaggcccccaguuguggcuaggaguccuggguccccacauuguuggugggcauuggguucauggauacuggaggaggaguuggcuagauguuugcuuauuuaaaccagccucugggauaacuucuguggccuuucugggaugauuuguaugcagucagagucagcgaucccacaggucacaggucacaucuucugguuuuggggguggauggugucccccccagaaggaaugcuaauuuauggagguuacagugguucaaaaugcugugucuuuuaggagacagccuauaugccaggcacagccauagagaaucucgagcuuguacuuaggggagcagcaaagccccacuucccugcuuggagcagacuccauuuugucugagccuaaucuucugcauggccaaugggggauuagaagaccagcaugcacugcacccucagggugaggccugguagcacagaacagggcauuggagaggaacagacccuuucugauaaggaaacugagguagaggacuagguggcagugacagagguagggcagaggugcuuuuacugacauuaaauugaagucacaagauagcgaaaguuaaaucacgcccccuccccauggaacaggguagaaaauuaauuaguaaaguugcaagauggggaccagaggcuacuauagccaggagggguggcaggcaggccucagguggagaucuggggggccaugugccugacagagguguagagaucuuggggcauguggauaccugccaauagggugggguucuggggggucauguggauaucugccaauggagugggggucauguggauacccaccaauggggugggggucuggaggaucauguggauaucugccaauggagugggggucugggggucauguggauacccaccaauggggugggggucuggaggaucauguggauaucugccaaugggguggaggucugggaggcauguggauaucugccaauggggugggguucugggagucauguggauacccaccaacggggugagggccugggggucauguggauaucugccaauggggugggggucugagggaucauguggauaucugccaaugggguggggucugggaggcauguagauaucugcuaaugggguggggucugggaggcauguagaucuccuaauaggguaggggucugggaggcaugugcauuccugccaauggggugggggucugggggucauauguauacccaccaauggggugggaguccgugaggccaugugcauacccaccaauaggguggagacuugggggacauggggauaccugccaauagaguaggggucuggcaucauguggauacccaccaaagggaugggaaucuggaggugcccaccaauaguggugaucuggggguuucugggguacccaccaagagugggggucugggggucaugugcaugccuguaaguugggugggguucuggggucaugugcaugccugcaaauugguugggggucugaggccaugugagugccugccaauagagugggaauaugggggucauguucaugcccaccaauaggaccacacccaaagaacccauucuuucaacaaagacuuaucauagcugauauuuggggcuuucuuuccaugcaggcuuguguauuuugggaggggcccuguguucugaaugaucucacuauauauuuuuuauugguguccaucucuuaggugagggccugcaagguuuagagguuggggguguucucaacaggagggagggggcgagagcucggcuaccaggauuuugacauggccaugacagugggaaaaucagagcccaaccccugcaagcugccucuagcuccacacuguaauuagagcaagcccaccacucagaacaggaaaagaaggcaagaggaaacccugaguccccauggccacugcaggcaggaggggcuauccuggggcuggggcaagcacucaggaugugggaucuguacacacccaaaagcugcuuggggcccacagacucuuaaagcuccagguaccacccaguguuuuagagacacggcgugcccacccucagaggggcugauucuguuacggugugagaggggcggcgcacguugaagcucagcucugaaguuaugcauuucugaguugguuuuagacucugggacuagcuauagaugucggagucuagaagcauguguuugaugcccccaguacucuaauggagaguucagaggagccuccccuauccugccuuggggcuaaucuacucuguuuuuaaaaaauggcuuccugccauugguacugagccccagaugccugguuuuaaggccccauaacaaaaagaaaugaggcuagcuggguauuaacuacccccgucgacauacagguagaaggaagcauuuccccagggaagagucuccauucagcuugauauuucguucuaaguaguaguaugauaauuggaaagcuuccagucuuaaaauacagauauucugagaacguguucagcauucaucuacguaugugaauaggugugggaguguauccaguauaaaacagcuaaaauagaaaaucuaaaaucuaauucgggcguguaguacuaaaacaaaccucuucauugaagagauuacuauguagaugaagccaucuugcuggggccagcagguuuauccucauuuguaauacugcuuaaugaauuuaacguugauugugaaauucagagaaaauuccuuagaugucucuaaacuacuuaacagaggcaagaugugugcccgguuucgggauucuaacugacuggaaaguuggagugggcgguaucuauaggaugaugcuccccuccccgcuccccccccccaaaguguaaggcagauuagugggguuagcauuuuguuuaguagguccugccccucuccuguuaagugguaagggaaggcuaugugauacccauccuccuccucucuacccuaucuuugugcuuguggggaaaagacagacaaaagagcagacagaagacagacgcaagauacagggauugcugaaacaugcagagaguuuuauuuaucaggagcguuaauaguuauuuuuacuuguagagucauaggaagaaagacgugcagguauuaguaagguugaagggguuagcacagcacacaauauauaggaggcucucucaguaggggcuugccacacuucucggaugccaacuuuugguacaguagauuaucaauauaucgaugccuuuucugauugcuguucuacuaugcuguugccaauuaaagacuucaucccaucuuucuguuuuuaacuuacgccuaaagguuagguuagggaccccuccccccucccccacccccccccauccccaggaaaacagaauaguauucuuauuaguaguuuccuaagaccgggcaauuccagcaugcaaauugggauaacugggguaggacauagcgaagauggaggacuguagccaucaucuaguggggguaauagacucuaaaagaaacagaugaacaaacaugugucagucacuuuguccccgacccccagauccuuugacccgcccgugcccggucucagaagucauuccucguccauguucuaggcuggaagcugcucuauggauugacaugagaaacagccccugcauccugcaugcuagugagcgcgaauggagcugcauggaugucuggcaugcgugugcguaugugugugggcaugagaugguuguggggaugagaaagcaaaauaauaaacaaugauaaugaguggggugccgucacaaaugcucuuguucgcuggguaacguaaagugccuugcauuaacaguuaaauuuuuuuuuaaauaauuucuaaggccagagguugucaacggccugcugccuaagggcugcagcauuaggcauauuuuuuuuuaauugaggaaauaaguuaagauuauuuuuuuccaaauaggucugaaaacuuaaagucagacugaccauugugugggcagaauuuagcaguuuugaaaggcaagucuguugguuuaaauggagaacugggggaaauaaagaccauaugggaaacaucgacucaaaaucuuaaguucucaucggaagccgaaauggcuaaccuucccccggcuguaucuaguuauucuuaaaaccuucucuguuuugcacuuuacuuguugacacgucauuugcaaaugcacaccaagauggcugauggcccugggaugaucucugcuuuguuccccagucuguguccucaguuucccccgcuauggucuucauguuuguuuuguuuguuagaagaguuuucuguuuuugaaugugccuacccaucgcuguugcuccuugcagccugcggguccucuucgccgccccuuuuaaagagagauugaaagcucaccuaucugcaaggcacugcaauuucauacaaaacccacacagucucugcaucuuuaaacagucagguaagaaaaccugacaguccugcguaccauccucccgguuaauccuuaggucgcuuuucuggcuaaauggggaugucuaccgagacuccacaccuuccuuccugcauuagcagggcccucaggagacucaggcuggagacaggagggacggguaauuguuuuccucugcuuucgcuaaaugcacaugcaccagggaacagagacacagaccuaacucuugagaauagggcuccucagaaucuucuccguguccaauccaaagcacaagugggacauuccuauuccugacuuuuuucuaugguggggggagcuauggacagggcauugacacucagccuugagaucgauuagcucaaccaauauucauuuuuuucuucuggcauuaaacuucagaaaguuagcucuguguuaggaaaaucuacuuugcccucuguauuucugaaggucaaauaaauauuauguucuacucucgaaaaauguagugguaggcaggccauggacaguuaggacacauuuaauagcucuguccaagaacugagagcgggacugaggugagggucagacggagccgcuuuuacugcuauaccacagugagagaaccaucguucgacugggucaaaauaaggaauccagccccccauggaggccugaauaucacuuucucaggcuaaauuuaacaucuuggagacccacaaggaaggcaaacugcgaaggcuucuuccucuuuucagagagaaaauagaaaugagaaguccugguuuagaauccuccaccacauuaacacucagggaaaacuaauauuaaaaaguaagauuuuagggaaauuugugaagcaauuaagccucagggaugacacggcucucaucagguuagacaauggcuaccgcauuuuaaaagcugcuuagcagccuccuccagcuuucaccacgaauauuuuugaagaaauauuugcuuaaccagccucauauugaagagucccucacaccuggggcaggguguuaucuggguucuuuuuuguugacugacaggugccaaucuccuuguauagacuucuugagagaggcauaucaggaaucaauaguuccagaauuugugucugauaggcaacaaugaauuauuuaauagauuauagguacaaaguaguaauugagucaauccuaaagccagugagcuagccccccucccuucugcauauuaacuaacuaugaauuuuggggcuguaacuuaaggagcacacacggacccaaagcuuucauguggcugaugucaucuuguuuuuuaaaccggauuaguuaaacuaacaaauucuagaaguuuccaugaacauucgcuugugguacccugaaaggugcugcucaauuuugucuccccagcacucggugcaugguaggggacagaagcuggucccccucgcuagggucagcuaagucccugacccuugcuguuucuuaucagcacugagaacaacgggggccaaggggaaaggccaauuccuuacugauuggcugucuccucggucugcauucuucauggaaggcaggaccccuugcuugccauguaucugucucuuuuuaagaaaaaucgucacucucacugugguauugccucgccauauugucuuaagccaggaaggucauuucaaaggcaaaacagcuccuggauugggcagaaguagcuaacucccugucucugcgccauuuucauaccuccuuuucaguuguucagguagaaguauugauuuuuuuuuuuaauuagagaaauaagucucugccuaucccaccaauucugaagcagggagggacucggaagcuuagagccugucggcaaggguuguggauuccaauuuuuaagugaagauguaacugaaaagauguuuuccugagaguacaaaacccuacaccaguugacuccagugaaaccugcaggguggugggugggaaccuccugugcuggccagcucuggcuggccaagggguggccaaggcccgucggccauguuggagcugcacugcagcaggcgaggcugcggccgcagaggaccuggccucagagacgcugucacccggccaagugcuguucacuguccucugcaaccaggcaccauguuccagcgcgaggggcugcuuuggguggacaccggugcuucuacucuuauuccuauuuguugccccaaagguugagaagggugugggggugcacccaucagcucuuucuugggcugucuaauaugcaaauuagaaaaaaaugauuaguggcaauuagcagcugugcuuucuagagguuaguauacacuccuucaaacguccugucuccugcaggccagguccauaccaccuguccugcucagugcccugcucagauuugacacuuacucuccguuaaacccauuaacaugcaggauccucaucugcuucacaauggugcuuuugccagacucuccagcaccugagaaaggaaagugagggcguggguuaagaaacaggcuugucacacuucaccuggaugauggccuuggaaagcagcagaagcagcacacaacagacacacaaugacacaacugcaaaccuccuucacaugacgacgcagugaaaaacaacagacacauccaacauagcaucuaccugaaguaucucaccauagaguaacaagcaagaauuaagggcucugcuguuuuuaaauagcuuuuuuuuucccuuuugaguuuuguuguuguuguuuuguuuucucuuuggguuuuuuaaacucaugaggcgaugaaggaaugacguaauugucacuggaagggugaaaauuuuaagucaaaacugugaauuuaguauugaaauguggucaaagguacucuaugcagcagccaccuaauuuccuguuuguuagucauuuuaugguuaaaauacuuaggaauggcagacaaugccuagacacugcagucucccacuaucacgccccgcugcagcaccucccucccaacgccacaaugcagcugcucucaagcaugcuucagguccacccuaaaaccacagggcuacacuguauccacuguauccacucccuuccccugcaaaaggaaucuuucuaaagauacauuuuucucuggauacaaccaccauguugcagagggaaaugguagaccaucaauuaucugucagcagcagaggggcgggagcggggggcgggggagcaaaaaaaaaaaaagcaaaaaacaaaaaauaaacacauuucguuaucaaacauggcacuugagaccucaugagcaucaggcaacaugcaacuucaacaguaccaagaguuuaaaaaaaaaaaaggauaagacuuuaauuauaugcacaaauauuccuggaagguccugaauaagaagauucuaggcuuuccccaacuaaggaaguaaauaggaacacaggccuccauuuuaaaucaccuuucuuucuuucuuucuuucuuucuuucuuucuuucuuucuuucuuucauagguaguauuuggaggacccuccagccccaccccauuuccaccaaguuucugcaaauguacucuucagcccguauucccugugggaaugguuuuuccccuccucccacaacaaucuaauuuuuaaaaaaaucuuguucuuuuucuccauauuguuucuguuuuggugcccagauagaaaggcauucacucccccacccuauucaguucaacacucccccuccccgaaauucuccaccccuccauuucuucaccccuccucuuuuccaccccuccacaaguccauaagcaagauuuguaaaaguuaaaauugguuuccacagcagcauugauuucaaagcaaacaccauccuaaugagcaaaauucucauaaauuaaauauaaaaggcaauauugggaggcuuccaugaaggaaacagaggacucaucaggucccucagcacuccacccucagaaaugggaacauuugugacaccagguuuuuuucagagacagaacuagauccgugccucaguuuccacuuuuguaagaauagaaaacugggcugaaaaauaacugccaggcuuuuguuuguuuugugguucugcaaauuuacuuaauuuaccugauagaaguuaaaauggguuaaagaaaaggaaguuggggguauuaaguuuccuuuguggguaauuauuucauuuuuaagaaauguaaaaugucgccaauagccagggcaacagauuucugugccaaaggucaucaauuaauuguggcacaaugcagccauguagaccagagacuugaaaggaggcaaggugggcucagaacugcagucucaaauaaguggggacauuugaaaucacuguaaacacacacaaaaaaagauguuaggaauuugauguaucauuaacaucauagugaacuuaaauaagcacucauaugagcaagaaugaaccauacagaagauucuagauguuuccagguguguacuuugaaaucagacuguauacauauucacauuuacagcagaauuacgcuuuuagaaguuucccauauaucaucuaaucacugaaauugcaaacgcaccaacaccaacaggauuauuuucacuuauuaacaauuuucugcuuuacucaauguggcccagggagaacaaagacuugaccccauccaaaaagaucaaaccaaacgccaccgcgaauuaacacagccuucuacauuuuauuuuugauaaucgaacuauuuuguugaaaagugacccuguucccagugaauucacaaauuuauucagauagccaaaauacugagacguggaaaguuuccauucuaauuaguguugugugauguuucuguggucauuucaacaauuuucgugugugucugugugcuuuugcugcccccaccccaguacuuuaaaaaaaguaaggagagacauccuuuuagcuugggauuccccccuccuuuuuaucuuucuuuuuucuuuucuuucuuucuuuuauuuuuuuuuuugccaaggaggaaaagccgcagugaaaaaaaagagaagaaaaaccaaacaagcaaaugucacuugccaaacaacuaauuacugucuuuucaucagcugccaccccagagucuucucagagcgcugaguccccccucccaccuugaaaaggacaaaaauuuuaaaaacgccauuucgaaacuaagaagccauuuacagacaaaugucauuuuccaguuuuaucuuauuuaugagucuguuuaaaacaggauuuuauuuuuuacuugugucuccacucccaaagaggccgaguaacaggaaaaccuguguguuaauuguuggcugcacgggagggggcacaguuggggggucagcugcuaccauuuaaugcuccucuuugcuuuucaaaaaagccuguaagucuagaaggggggggggggaaggucacauuguaaaaugacgugucauuuggcuucacugggcacuuugcguacuuuuuuuuuaauuuuaauuuuaauuuuuugaucuuauucgauuugauucuucuucucuuccuuccacggccuggccuagcucaggacacgucugcuccgcgcacagucagucgguccugcccgaaucgccccgagucgcgcccagaguccgccacgcucccuccucccuggccccccccacuucggcgccacgacuugcccgcgcccccuccccccucugcaccaccuuuaccgccccguccuuuccgaggggcugaugucacccgcccccccaccccggcggcuacuucccucgccagagucucccggccgagguccccgaguccccccuaguggccuuggccucucuuugggcccccucccaacaaaucgcacaccccagugaggcgggucccccucccugggcccgccggcccguuuccugucccuagcccuacucugucgcaguccgaggggcccugugagccuccccucccccucccgacacgcacccuggccccuggcacuaaguaggccucgcgaggacgcgaagccagggacgggggggaguguggccaacugaggggacgagaccgaacgagggggucccacgcccaauuugcagcccccgcccggccgaauuccgccccgggguccccuugacggccucgcccccugcacgcgcgcggcccagcgggccggagggccugggagcgagcgcuagagcgccggggaggggggcgggcucggcgcgcgcggccuugcgggucgccccgcggcacucccgggccgggcccgcucccccccgggccgcccuuacccagcagcagcaggcggugcguggcccgguagaccugcuuguccuucugcagcugcuucucgaucuuuuuguuggccucgcgcugcgccuucuccucguugcgcugguccucggucuuacuguugccgaggcagcccauggcggcggcggggcgcggccgggcugcggggcggcggggacggggcgggcggccucgggcgggccgggaaagcggggaacgcggggaggguggcggcucggacuaaggcaagcgcgcggcucuccgccccucgcuccggggccgaggcggagcagagcaggagccgcgggagcugcugccgccgccgccgccgccgccgcucuuauugccucggcccgggcccgccgccccgacccaaaagcgccgcggcgggcgggggagcggggggaggcggaggcgacggcggcgaggggggugggaagaagaggaggaggaggagggccgcggcugggagggcgggcgcgggcgccgggaggcggugcccagaggccgggcaggggucccagcacccacguccggcucgggccggcuccacggaggggucgcccccucgccccacccgcaguucggggccggggccuggccgugcggcggggggaaaagggggcggccccgcgguggugacgaccccucacacgaugccagcgcuccacccccgggccgggcggcccccgaucccccuccuccugcagcagcagggcgggcaggcgccgccaaggggccggggugggcggaaagggagggagugcgggcccggacuuaggaaaauuucgaaaaggagagagagagagagagagggagacacugagagagccagaaagcagggagcuuggagaaaagcuaggagagcacuaagcauaggacagagcaaccaaaaaggaaaauguguccacacacaagcacuaauaaagauccacacuacacagcaauggugguggaaggugguggugguggauguguuggugguguugguggugguggucgauggcgauguagaugaugaugguggaggggugggggggaggcugacuagaugagccgcucgucgcgcccccggcgcccggugccccuggcccgggaucgcccacggccucugcgcuuggcgcgaccacucaggaaggagaagaaggcgcagcccaggaacacucugaagcagcaggucgccccgaacacgaagccgcagccgcggcccugcucugugcgccucuguagcaggaaguuaagcacccaugaggggcugcgaaccgagaacaccaggaacaccacgaggggcaugugcgcgcugagugcgccugccuuggcaggcccaggccgccacacgacgccccccacgcggggaggcgcguaguaggcaucaucuucuucaucagugucacugucccauucggcccaggcccuacucgcgcccccgguggcggcgcccucuccgaacccggcggcgcccugcgcggcgcccucgucuucgccugcggcgguggcggcggcgcccucggggccucgggccucuggcggagcuucuggcacauucuucuucuucuucuucuucaacaucuucuccaacuucuuccucucuuucucucucuucuucuccuccuuucuccucugcuccagcagcuucuucuccaucuucuugcgcucuuugucggucagcaacuuugcgggcggcacaucgcgcccggcguucacgaggacccugacggacuucgggggcuucgcggggaucccguucuucugcgaagcgaacgguucugccagcaccgcagccgccacggcagcuucggcagccacuucggcggcagccgcggcugucuuccucucgcucucggccgcucgggcuuugagcuucauggccaucuucagcauggugccccggccaccucggggugcuugguucgcgccuggcucgggcggucugcuugcccccggccucgggcuucccggcuccugugcgccccgugucggggggcucagcugcagucuccgcugugcugucuuggggucaccgagugcggcuucccgggcuucguagggggcugauggacuggcugccuaagaguuagcgucaaauaggaugagcaaacaaaaaaagcgagaacaaacaaacaaacaaacaaacaaaaaaaacacccaacaacagcaagaaaccgaaaagcaagcaagaaauaagaacugcccaacaacucaaaaaggggggaagagagucuagaaaagacaaaaaaaauaaaaaaaauaacacaagagaaaggaaagugcaaaggugcagaugacaagaguuugcuauuacccuuaggugcuccuuggguuagcucuuggggaugccaauggagaagagaaaagagaaaagagagaaaauuggagggugccugaaaggcgcgaggcagggcagcggcgccaggcgccucugcccuaucccggcucuugccugcucgggcaccucgcacuugggcgggaagaccccacgcucccggacuuacaugugagugagacgcacucacacgcaaagcagcgccugccugcccgucugccugccgccgccaagcgcugggacaaggguucgcuccagccggugcugcagccccgagcccagagagccgggagcuagcgagcgccgcugguaccagccaccugaagcaacccgcuccgcggugccgacgcgacugaguguccccgccgcggagcggguuuuucuaaccagccugaugacgccccaaccucuucagaggaccgacccauaggcaauggccccuauaaagcgaaggggacgcgcaaaaaaucggcccacugaggacgugcucaaaugggcugcuccgcaggcggggggugagguccaaugcgcgggcaccucuaguguggguagggggcgcggagaacaaucuauugagggguacgggcacgcccaagacggugggcacccgaccccgccuccuagaccugccucccaauuuuccguguagugguguagcccugggcagcguggaaacuaugcgacgaugacaacgacgcuuacccaugugcgccuucuuaccucagcuucccagauagcgcacgcggggacggcggcacaccccucccacccugcggcgcgugcucguggauguggguggcggcgagcuaauuaaucgcaaugccccauauggggguucggaucuccucacaaguaguauuauguauacccgacuaccacggauagaagaagcaggcagcauuaugcaggcgaggcaacagccgagaagaagagccauggcgguggugcacacggaguccuucuaggugggagaggugguagccuggcucgggcgccacacggggcucuagaauaaaaggggaaaaguacuuuaccgaacaugaacuuuuuggagaauuguuucaaaacucaagagugucccgccccacuccuuggccacgcuaggacaugguagagagcaccgggcuaagucaaagauuuugaaccaccuuccucggguggacuugagggucugccaccggggucuauuuggaaacaauucauuccuucauucauucaauaaucggcccacaaguaccuugugcccagguggaccgagccaagggucagacuaagacauggcaccuucccugaaugggacaaagcaggcgccaguaaccccagaucugcuaaguaaccauaaacucucuucuaacguagucuuccuuucauuuucgaacacaguucgcaaaacuugggaugcuggggagaaggaaauagaaauguagacucugaauacaaacacacccaggggccugaaggggagagggagaagggcuucgaauaaguuauuguggacagcucuaucuuugaaacuaggaggacaccuuuugaucacucgcucagcaguuuuaggguacucuuucucucaaguuuaccaccucaaaagucagaaaggcugcaccauauaaaacuccugcgcacuguuuuucuuggucuuugcuacuacagcucuaccuccagucuacuuuaaaaacaaaacaaaaacgguuucgaaagaacaacagaaagcgauugaaaguaaccaaggacgccuuggaauuaagagcaggaagcugagccuaucaaaugggccuuugcugauuuuaacucagucucugacuuucucuguguccucaaaauuuacuucuuauccacggcugauuauggcuucucuucauuacaacacacacuuuaaaaaguccaaaaaccucaaagcaacuacugccccagguugauacucuuuuuuuuuuuuuuuuuuuuuuuuuuuuaaccuaaccagaguggaugggaagacuccagcugugcuugcguuccuaauucucggcaagggauagccugaagacagggacuaccuuuuacuuuuucacacagucaacaaaaacuucuugauugaauuugauucaucugucauuugugaaauuaaagacuuagaagagagaggaccuggccaaaaauuucgguuccgcuccaguuguucaaaagccucuuccuuccggcuuccagugugcugaggcacagauacauuguauuuaaaagguaaggaguuaacaacagccaacacagccuccaugccucuacacuaacaacauaaucauacgcugaguguaaugaagaggcugugggucuucuccuauuagauaaauaucacacccaaucuuuaaaaagagugaagugucugauggaauacagugacacauguaggcaaggcacaauugggaccauuguccuggaaauguguaacacaaagucaggguucucuccauucaacuccuaacuuaaacauucgggggagggcuuuuuuuuuuuuuuaauuuuaacuguuaaguuuuaccuguauuuuauuaugacuaaccagggauccauaaagaaaggauuuacuuuguaaauaaacggcagcagguggaaucgaggguuuauagguaagcaaaggacaccaagagccugaaacacaagcugcuuuguggucuguucgguuuucuguuuucacuugacacaaagugaaagaagagauuuuauuuaauugguaugguuagcugacaccaucuacgguuucggccuagcauugaccugcccaaagcccugaaagcuacauauauguuuugcuuuucaaaagucuuccagaguuagaacucacaguguagaacuugugaguuaccaauugauuuuaguagauugcccugcagcuuuagacacuuacauuauuguuuugaaaguaaagcaaaugaauuaccauaauuccuggaacacugcacuagaaaguguucucaucagagucagggacacguggacauuacagaaaccuuaacgcuccaagugagaccauaaaauauauuggcagagaggaugcaggcuccucccugacucaugcuaaagccaaaaaguugaaauaacacauuccuaaccugaaauacugggucaccuaauauacagcuugauggcacacuucaagcuugcgguuugaacucugccggcuuguaauuuuuuuuccucagcccuucuguaucuuucuuucugagugugaauguuucaucugcuuucagaagcaacaacauugcuauagguuagaaucuucgaaauuguauuacuacuuaaugaugucgcugaguuuuaagacaagaauguuuucuugagccuuucauuaguuggggucauuguaagcuacuuuccaagagccuagagaaaacacaauuaugauauuauuuuaauagcccaggaaacaauaacuaggcuuccacugaaacagaacccuuagcuguaaggcuuuaauaauaguacuuagugaugcauucuaucuucaaagcacauuccgcacuuuaauuagcuagaugacuggaacuguggcugcagauaaauguuacuugcaacuuuggccauauugaaggugaaagcagguacuguguggagcuccucuaggccuggcuaaucuccauaagaaggcuuuaauacucagaacuagaaaauuuuaaauuuuaaaacauccaaugucaugaccauucaugacauuuuuuuuucaugucauauccacugguuaguauuucaacuacaaaguaacuccaaacaugcauucuacauuagauauuuaaaugucauuucacaaguucuaagucaacuacugaagaaugaacuaagcacgugaaauuucccaguugaauaauauccaucagcuaauccucaaauaauauaucuuuaacuuagaauagaaucucagucuaguucaauccaacuggccaaggugauuggacccauuuuuuucagugugugcauuuugguuugguuugguuuuuuuuguagccuucauugacuaucugugacccagauaggcaagugccaccuguacgagaaacaagccuaauuccccucccuauaacguauaaaauaggggacuggaaggagauuauaggagcucucuucccuuugaaauuuaacucuaaacgguguuugauucuccuggcuaaccacucuagacagcaagagauaaagaagagaaagauccacuaggaagaugugagcagcauaaucaugaaccacaggccucaugagcaacgugcagaaggaagagagggcagcuccauuuacccagggcacaccagcuucaacgggauaccagccuagcagagaguacuacugggugaaaggcuaucaaagaguucucccaacuaacagcuacuuucccuaaaguaaaaguuggugcaacuggugaugugauccgacaugaagaagaguagguauugaaacccuccgcuaaaauacaaugucuucaacuaagguaaguuuguuacauuggguauggcaguucaugacuauaaucucagaacucgugaacuuaaggcaagaggaguuguuugaguuugaggcuagccugggcuauagaguaauaccauaucucaauaaaacacacaaaaaauagccucugccaaauguuuauauuuuaauuaucuucagauucugaacaaucuccccacuccccaaccccuugcauucaguuuuucaaaauuaguucuauuguaagagcuaggcuagcuaaaaacacaagcuggcagcaaauauuuuguagcagaauguaacuuugugaguauacauuuauaucuuugguuuucacugaccaaaaagcauuuucaaauagugaaugauuugauaaguccuacuuugggacaacugagauucugaugggagccagggguccuucaguuccacagcgcucucuuugucugcuguuaggaaaccccaaauuaaguuaucaaugugacauaccuaaucacauguuuaauucaucuagagguguagguaccuuuucaucuuuuuguguuugcucacacacguuuaaauuggaaaaauguaaaauuauuauuuaacuccaccuguuucccccagggcauagaauguacagccccuccagugaggaaggcucuuuggaagggagaugugaagaagucccugucugaccuuguguggacucaugcucagugcuagcugggaagccagugguagugcccucaacaccagccaggcccagauggcacuguggccuucugaggucucugccucgcucuugaaguguccaacuagagaaaauucuguagccccaaaguaccagacauguguaagaagccuggagauuggauaaauggacaugucuuaugagcuacaggccuuagcuguaccuacagccacaucccagggccucugcaugccacucauuacugggcaaguggccucucucccuuucuugaacauuccugucugucccuuauauuagucucuacuauauucucagauuacaauuccuuuugugcuaacuacacccccaaauuaaaagaaugucacugacuucacaaagaauacaaagcagacugguuuuauauaucuggggguggguauuaaaaauguguguugccuuuagaggacauuuacauaaaacgauaaaguaauuuaaaauugggugaggauaacagauugguuuuaaauaucgccccuauuagccaaacaaauaaaggaccccaagaaauucccuaaggguuaauaagcaaaacacuaaccacauguaauaguuucuuuuuccuaaggaacaguacgauaccagcuaaugcugaaagcacgcuacagcugugacuuguagcuuggacacuagcuugagugacagguguaccaucacuugcacagaccagcugaaauuacaaggucuaacucagauuuuccccacaauuaacugaugccaacauuacauccauccaggaaagagccuccagcuacaggcacagcagagcauguguucucagucuucaacauuuuaacaacagcaucagccuugggccagaagggaacugcagcucccuaaucacagaaccagaaagccgggaugacucuuccugagggaaggcagaagaaagcagcuagcuucucuaaugcucaucugacggaguuucugugacuggagcaagcucaggguucgaggaagcuugucaccaaaauuggugucauuaaagaagguggcaugucuaagagcaugcccggccccuagcuagagcuuuuaauccaagcaccucggaagcuucuggaguacagccauuuaaagugacuugucacaccgaaaggacggcuuucuuaaauaaucucuauaguuuaauuucugucaaugaaguagguuagagauaacaaaaauguagauagaaagaugaucccugagcaaucuuaauacuauaauuuacaacuaugccuuacaguuucaucugcuuccauuguucuuacuccccuaacuuuguaaaacuuucaugcccucgggggcuggugagauggcucagcgguuaagagcacugacugcucuuccaaaggucccgaguucgaaucccagcaaccacaugguggcucacaaccauccauaaugagaucugacgcccucuucuagugugucugaagacaacuacaguguacuuacauauaauaaauaaaucuuuaaaaaaaaaaaaaacuuucaugcccucuagauugauugguacagauggcaaagagaaagugaagcuuugggggguggguguggggaggacuuuuaacaaauauuucauuuuuaaaguggauacagaagaggcuaugacaagaaaacacagaggcucgauucuucaaaaaugagaaaaaugaaaauguauaccuggguggaggguagagagaaaaggagggaggaagggaagggaaaagagagaaggaaagaaagccagcuagcuacaagcagccuagaagcccuggagagaaacaaaaucaccacaaaaacaauuuaucucaguggagccuugcuugucccuugucccaccaccugccuguuuugugacagccucagcaccaauugcuccauuucaguaacaagacuuugauuucagagacucauuagaauccugagucccugcuuaacaggacaacugaaaaaucuacguuuuuaacucuuaaccuuuucguuuuucuauucaaaacuugguaaacugcuaaacuuacauguucagggggcugugaguguuaaauaaaauauucaagucacaccuggguucugccuggccuguaccccagaggaaaaaaugaggaaggugaagcaggaugcugucugcauuuccccuuugccugagguguuuauaaacagagcuagacuaaaccacaaagagacugaccugccaucuucucuuccaccugccuagcuuucuacugcauugauaagacagaagugggggggagguagaauccgagagagacuagcuaaauuaucuaugcagaugagagaaaagagggaauugauuagcuuggcucaguuuuggagacugugaaauaaaaaauggagggggggggugucaauuuguccccaaacuaaaauuauagacauuugucuuuugugauuaaaaacacuucucauugccuuuuuuucccccaugaacuggaucaaacugguguuaccuaagacaaagcaagggugaacagauuuugcuuccucugaaucaaagauggcugcaggcacuagacagacccugccucucaggcugcugcugcugcugggauccuaacgguuuccucucccugcccaccugccuguagggaccaaccugcuuccucauccccagcuucuuucuucagcuacccagagaaggcaagagacuccugcaucuuguccacaucuuguucauguguaagcucucuuccucagcugccuuuguaguuagaucuguuuccuaaaaauuaagcuuccuuacggcaugcaggcugugugugggugcaauuagggcaggugguagcugaugggcgaaaauauucaggcagacugauugcuucuggacaagacauccagaugaguuuuuacaauugaacuuucuagcagcuugauaggauguauuagugucaaagaagacaaaaacucaagucagaaaggucaccacagggguggaccauggaaggcuauagggauggcagagagggcuacauauuucaaccaaggaaaaccuagguuuuuaaggugugccaaacggcucaaaauucaccagagcaaagcuacccagaugaaaaggaggcuuucaggcuguacugugcacagcgguuuggugaugcuacagcuaaaguacagccuuccuuuauucuaccacccuauaaaauguaaaugaacaaccauccaaucucuaccaacaugaagucugacaugaggacccagucguucagacaucauuaggaucccauggucucaguguuuauacaaaaucucucuguuuucuuuuuccagagugccugcuuauuguuaaaaagggaugaaacucucuaacucuuuucuuauucugacacugagaaugcugacucucuaacacaggcuuuuucugaccccuaagccccauauugaagguaucuggaauauuuuuuuucuccuucaaauaacaaccauuuuaaaaugaaaccuauaagcagguagggcaauaaauuggggugcugcccuuguuaucuuucccccagcucccccagcauugcuuuguaaauaaaaaugggaaaacaaaacaaacuagggccuaucuauuauauuuucaaguguuuuccuaacauggauccacuaacaucugagagauggccauucauuccuucccacaucucuguggcaggcagagccacccugcauaguguuuaggauaaauucccugcuuggaccuggcuuagcugggaggagagcagacccugcaguacccuugaccaccugagauucccuccuccuagaagauaccauagauguggcauucuguuuguuaauccugcguguagaaaacaaagugguuugauuugugauugcaguaauucaccuaccacaaagcccuaaguccuuacuggcuuauugucagcugcugguuaauaaucaucaaaaucgcccguguaugggacagugugucaacugagugaggggaguaaggggagagggcaggaaaaagaaaaccacacauugucucggaagaggugacuguguaguguguacccuggagucaguaggagauaaacauaacccugagagcuacauuuaaggcuggggucccucucaaaagcgacaugacuucuagcagacauucuacguguaaugguuacacaaaggcugcagagaugaguggcuuacaccgugugugugugugugugugugugugugugugugugugugugugugugcgugcacaccugcuguucucauccccagagaucucacagcuaaccuugggcaugcucaguuuacucucuucucucuuaccuucccauuuccagaaaccaaggcucuuucuaucucuaagaaagcauuuagaauucacuuuuauuucuuuucuagacaugccagagugcuuuugggagcuuugagcaggccaagcaacugcuugagaucagaggauuagagauaaguccagaggugggaagaaauauaaggaccuuccugaguuuugcuugacaugaauauauagacucaacacuuaggucucugacuccuccccagcacuauaacauagccucugccugaagcgacuccugucucugggccuguucaguucuaaggcauguacaugggaauggcauaucugaccuagccacugaccuuaaagaaagcacaauuuucaacaggggguauguggcagaccacuugaaaagucuuccagccaccggagaaaggccccagccagaaagacuggcccgaggacuaaaaucucaccuugcccuacagaaggaagggagaagccuuucuggcucuuuuuucaguguccuccugguagaauaaagcaaaaugguguagacuugggcaugggugcacagucugcagggaggggcugagauucucuuaucaagggcaucugucauucagaggugacaguugucugcucccugcaccccagcaaccccugucccuuucaggucuuucccuuuucccuacuauaagacuucucuauaaaagccgaaaacaucuuguucuuucaccauaauuaaggagcugucagggaaauggcauggcugauuucuuugcugcugccggagugaaccugcucgccacucuuuccuuuucucucauuugcugaagugguccuuucucugccugaaaucagccccuuugcugauggagaucuuagcuggaagcagagaauucuaagcaaaauccuaaccuugggagggugaggagaaaaaaaaaguccaugcuuugagcuggccugugucugcagcaaggugccugccugcacagccauuuuucaugguggggaaugguagccucaccaugucuggcuuugcagaccagucauugucaggauccacaauuuagcaaaacccagaggccguucucccugcuggcuuagcuaaggggcaagaggaagcuauuuagaaggaaguggagaaguuugaucaggaaagauaaaauccaaaugccuuuaaugcuugaagggaaagcgugugugugcgugcgugugugugugugugugugugugugugugugcgugcgugugugucuguguaugugcguguauauguguguguguauacuauuguugccagccuuccugcugcaagcuugcaauaaagcuguaacuuacacgcauaauuaaucaccuuguuccuagcugagugucacccaagcugcagggaaggucauuucuaugcgguguggacacugaguuacugaagggucuaucugcaauaaugucucaucuugugacaagguuacccucuuccuauuaaccaucacagagcuucaugcaagccaccuugaagguagguaacauucaaaacccaaaagcugaaaaccaacaacaacgaacaccaaaaggaccuuaucccuaagggguguggagcucucucugcugccggaaugugacauauauuuaaacacauguuauggaugcgauucguaacauucauccuugucuucaacuacuuacacuuuaaggaaacucacaugucaggagcuuucgaaauuagcuuaauuuccucucccuaaauaucauacaccucggaaaggcccccuuuaaguuacacuagggagcguaccuggcaggcuuccggguuucuagaggguauguuaguauguggcaugucagaauaggcauccaggccucuucagcugagucacugcuggcuaaugccccucucagugacgccagguuaaggugugcaaucaaccugugccacuaagcaccagguuuuccucugccugugaccacacagccagggggccguucgugcuaacaacgaggcuauuuuguggcuuguuuacuagcucuucuuagucuuuucuccaugccuggacuuuccauuucuuguuuaaaagaaucaaagugaccauacuaccaacacagcauguugcccuggagguaugggggcugaggggauguggugggugggggguucuacauccggggaacacagaagaggaaaaccauucugcuguacuggagguugcuaggcaguccugagcaggggaaaauggggugagaaaaacagguaaugagggcccagcugccccucuccuauuucuggggacuucauuauuaaaaaugugacuuuuccucauuuuggccucacagaacuguuuauuaagaguaaccuuauaagccuuuggcagcugaugggauuaacugaacugaacacagccaccugcagcccuggaaagaggccugggccaaauccccaccucucaaauucacugugaacucauccccaaacauccggaaggagcaaggcacauggcccuguucuaguucucuuugaaagguagagacuguaaaggagaaguuuaggauccuauaaauuugguuuauuauagaauacugacuuaggaguucuuuugguucagucaucugccaaaacaaacaaacaaacaaaaacaaaaaacaaaaacaaaaccuaacuguaugcaaacauacacauuuuaaagauacauauaaguguauauggaaccuacccaggcuaaacauuagaaaggaauagauuaagauauugaauuccaagaagaauauauagguaaccuacaaauauuugugaaagaaaaccuggaagcaaauucuagauaauuuucauucuauagaauuaauggcagcauuugaaugcagacuuucuguuuuagggaacagaaaaaaagaguccuaaaggucaggaucuaagaugguggaucacagcuaagauggagggcaggccaggaucuaagaugguggaucacagcuaagauggagggcaggccaggaucuaagaugguggaucacagcuaagauggagggcaggccaggaucuaagaugguggaucacagcuaagauggagggcaggcuaggaucuaagaugguggaucacagcuaagauggagggcaggccaggaucuaagaugguggaucacagcuaagauggagggcaggccaggaucuaagaugguggaucagagcuaagauggagggcaggccaggaucuaagaugguggaucagagcuaagaaggagggcagaaggcuguggcaguaugaaaguacucuggcugccaaccauagcuacuuuccucagccucaggcugacacgaagaugugaagaguugguuguccuagaggcagaugucuguuuauucugacccucagagauaaguucuccuggguuuccugcagcuuacuuauuagaacagcaucaugucauuucaguucugauuuaguuugcugacuuggguuagaacgcucuugaagggccacugaaaccaucuuugcaugcguucuguagcuacucucacagaaugccuuccuagaaauuacccaccauugucuacuuccugugucugauuuuuaaccacaggaccauaaggggagaaccaugucuuagaccuuuggcuuccacucagggaagggcacauuuccguguuuauguacugaauggacugacugacugaaugaaugaaugaauaaaaaugcccaaauccaggcagacucaccgaccugagcaggacucauccucuugagaggugugguagacacgugggcagcuacugcaugcguaguaaggcuacuaggcaagcagacaagaaacaagaacauuuaacauacauguugauuggaaauuugggggcaacuuaucagggagggaaaaugggcucauauguauaggagacuaguuucccaugcucuuugccaagguuaacaaaaccuacagaggaguaaacccgaggucugccaauggucaaaacuguggaaacguuaacuggugacaacuguuuucauuuggaaccauguuagagagugaaucucugccuaaagcuggcacaucgauuuuaugcuaaauucccauuuaaucucccccuuuucuuucucagaaccacugugaugcccccauuccaaagauuccaaagugucacagaagguucccuguaugaguggggcgguggggcgguggggcggugggggcgguggggagguguccaucucucggcuuaugagaacagcaacccugugcuccccucaaccucaggccgcuuuugcuaagucucaaagcaauacaaauucagcucaaaucaauuagcaacacauuucuaacucuuggcgcuugucagggagggucaacaacuuuuccuggugggggaaucucaaucaugagaaggagccaaaucuaaagaccaaauguggaagaauaggguccuagcauaaccaacugggcugggguuugaguuguuuuguuuuguuaaacuugacagaauauuuuccugacuacagccaggaagccgaggcugcacucuuuugacuauugucugguuauggugucuuccagccugugcccugaccccagugcugagccaucaauccuguccccuuguccucuggcuuaacguacccccuucuuuucccccuuacucuuccuuacuggagagaauuaucuccucccaacugaagguacccaggagacagaccuucaaaaguuguuuuucaaagcgagguggugggguggaaaaaaggaaggaagggaggaaggaaggggaaaaaaugacagaaaacaguguccauauggaaccuggcuggugccaaauucuuggggccaucaaccuacaaaauucucaggauuuccuuaaucucugaaaugcauguucaguggacaaagugcucacguccacccauaggacugcccuggcuuuguucuggauaauuauugaaacaaaggacucacaaagauagaguggguuguuuuuuuguuuuguuuuguuuuucuguuucugacaaaaaagguccauggugugccagauugcuuaaaacaaaauagaacaaaaccacucagugggcgaagcauguggaaacacucagaaaaucagguuguggcagaagggguguguguguaggggggggggggggagagccuaacgugacaauuaaacaaaaucauuuggauucagguaagaaacucugaagaaagcaaauggggccuguugggacagagaagccaguggccagaccccacagggccauggugacauccuggauccaccaccagccuccugguugcugcuuucccaagugggucuugaaaucuagucacccucugagccuucucuuuucuuccuccuuguuuaauuaagcccagccaagccucgaugugcucaauuccuguucacugauagccguccaucucugcuugggcagcgaucacuacucgaaacccugauguucuccaagacuugaaguuucccuagggcagggacuucaucuggacuagagcacugacauggcaaagucuuuacuucugcucucucuccucucccuuggcuugacucuucuucucauacaucauucuggggcuucuuuuucucaugcccuuuguaccccucucuccccuuucccucccaccacccaacaauaaagaacuagcuaagggaagugaucuuacugacaaguaguucuuaaggccccauagacuucaaaagcucagaaaaaaaggaagcaagggggggagaggaauccagacuccuuuccccuguuuccuaccagagugagaagguuaaacuaagucaaggaucugugaagagauggcagaaggagggaacuggccucuguacauacgccuggggugggggaagccaaauaaagaacccugggacccaugguuaauaaauacuucuuagcuacacaucugggugaggagccagagauaaggacacucacaacagggcaggggcuggagugagguuuggggcugggggucagggcuaggggcgggguuauaaucuuaugacuucauuuuaacaauaacauuacuccuaaaagaaaaagggccaggccaacucugaggcaugggaaaguuuucaguccugugggaagugaaagugggcauuguguccccagacgggauuaggggcucuaggagggugagguaccuguuaaggcaaggauuugugugcuuggaguuggucugagaaagaacgccaucaaaucacagcagaucaaaacuucauccccuccaguguguucaaacuaagugcccagggacccaagacaggaugaucccuccuccccacccacccccaccuuugaaauauggggcgguuuucuguuuagguugucuacauuugaucuagagaauucuaccaguucccacauuugcaagcagacccagcuauucugagcucuuugcugaccucugguggguaggcccaucgguacuagaacaggcugcuuaccuauacccauaucacuaacaccuggggacagccuugaaguucacauaucagaagcccugaaaguggggguaaagaaucaaaaaagaaagaaagaaaaagaaaaagaaaagaaagaaggaaagaaagaaaagaaauggaaaaaaacacccuuuuaaaccuucaggaaaagaaaacaaaagauaaacaaaagcgggcaagagagaaggaaaguuguaacaaaguuugaaaagaauugacuagcagaguacagaaauguuagccugaacuaauauuuuguaucuuauuucucugauuguuacauuuuagaagagaaauagaagaagcuauggagaaugaaguacuaaggcuggccuuaguggccgaggguaaguucccagcagagucugcagccccuucuaggaaggcccauguaccuuccucaguagcuguggaggaggcagggcagugggaucagggcaaguacaaagcacugucuuugggaccuaguccuuauguaugcauuucuuuuccagcccuuggcugggugaaaagggaugaacuuugugaccucugcugcuacacaagauagcuccaggcaggggacccagaaauagucauuuguuaaaggacaaaagauggccuaagauguuuuuccuacaccaccugccauuuugguaaggacaaaggugugugugugugugugugugagagagagagagagagagagagagagagagagagaguguguguguguguguguguguuauaccuggggggagcagagaugcuaaccaacaccuucuauuuaaaaguucuccuaacagaauuaaaagauucuaaacugggaaagaaccccacccccaaccuuuuccccaaaagacagaaggauguuuagggucucagaacuguuccuggcagaaggagagcuuagcacuguuacacagaaagccaaagcgggggggagagaaggggcuuccagguuugcaccccacuguauuuuaucuuucugaccuccuaaggucuacaaaguggggauacuugucaccagauaucaauugcuguccugaaaccuuaaacaaaaagcaacaacaacaacaaaaaaaacccaaaacaacacauucuuaggccuggggcggagcuacgucccugggaaggaagauaaagggagggggcugccugaagcaggcgcaggcuugaauuuucuaacaccaggcucucaauuguaaacucggagcgccaucugccagccaguucugaacagcccuccuuuguuucgauuuuccuacuucccagcccuaaacagugggcucccuucuuuccuuuaaaguauauauguauuuuauaaauucuggcucagaaagguucucccuagaaaaagauccuacuuuaaaagaaaaaaaucugaaaaugaaaagaaaaauaaaacaagaagagagagagaacaggaaaagaacaaacagguaaaaugccccaggaccuuuuguuuccucccuccugcugugaacuuggggugcaaaugagaugggcucccuuuucuacuuaaggcaaucaggcucuuccuuccuuccucccgcugggagcuaccucaaggacucccccgggugaaaguguuuuacuucugggcaccuugagucugggggugagcuuucgcuacauugguuuuagauuugucugccaaauaaauugaguuucuacucugugccccacuuucuccagauguuccuggccuaaaaccccuugugaguacuucauacacauagaccugggagacaugggaaguuucuggcuuccucuuaaaggaacucaugaaauuugguaccucuuuggccauggcagaaccucagguaagcuugaauacuucaagauguaucaucagucuuuccuggacaucacuuggcaagcaagcacauggaacucuaaacucaaguguuagaaucaaccaaggucccagcaaaaccccugagcuuaaaccagugcucucuccaucauccuaggacccucugcaaacacuggagauucucuguacaccacucccccaacuauuggacuuucuuccccauugagacaacauaggaaagugauaacauggaacauuuccaaauacucccacuagaaagugggauucccuccuaaguguacaucuuaaauccucacuugcauaucugcuuggcaaaacaaaaugaccuucugugcucuccuccuaagagcaaaaaugaaagaaacugaagucacaugaaugcugaaguauaaauagcccagaguuuuuuggcuacccaacuuaaaaaaaaaaaaaaaaacuuucccccuaacaucuggcauuggauucugaguucugccuugagucuucuaagcauuuccuuggaaagauguuguacuuggucccaggcaaaaucucaaaaucaacauucugagguuuuaauuucuaggauugugcauugaggcagugaggagguuuuuggggcacuuugcuuagcagaaccugaaauucucuaagcgaaucugcaagaaguuuggaugucaaaugcugguuccccaucugacauggccggcaucuaacugcucagacccaaucuguuuugacugauucacccuaaucuuuacccugauagcucacuuuaagauaugaaaaucuuaaguucuugaagacgaggaaaauacuggaaaaugccuuugcuuuuaagaaguuagaagcugggaguacagucccaaucagcauggcauaaagccuugcauucagccccaggaacuaaagaacugagacagauaaggugcugguuggugacuugggcccacuaaagugacaacuaagccuugaccugaaggguagacauggggauagaugcugaugcuacuuuuagguggggacauagcaaccauuuuaucaaagcccuaaaugcaauccuuuugaccagaaaaugucuuuggucaggaacuucuucuggaaccacuguuuccuuucugacaaucuccuccuucuucuuccuccucuucccccuccucacugugguggucaccucacuuucauuaccacacacaaagguggcaggucaccuuuccguggguggauggcugucuuuggcauguaccucauuaaggcuggugugcacagguuaagugaagguacuuuuaguaucugugaguacacgggagguacaggucccucccuuguugucuggauauucauaucccuucuacaguaacagaauuuaccagugcacaccaggcagagggaacaggcuagcacgaugcuaauuauuacaacuuaaagagcccuauguacaacuauaaaguuaaaaaaaaucaauguaugccccugauacuggcuacccacugacuaguuagguauuaaccuaucagaguccuagaccaauacauuguuuauuugccugaaauaauuucuucuucucuccuauuuagggucaucugggggucacucucagacauguguggaaauugcuucuauucaagaauguaguguccaagauuagugugcacauugcugauugguuaguaaaagggacaacuuuccuucagauggcuuaucaguagaugaacaagcuauaccaugugcgaugucuagcuuccucaggacaagggauagaggggaacucucaaccaugugugacauuuaguggacacuagaaagauuugggcuaucauacuuaauugugggaaggugguggugguggugguguguguguguguguguaugugugugugugugugugugugugugugugucugugugugggugugugauguguguagugguggcuguuguuaauauguuguuaguaguaguauguauguguaaaauguguguagugguagcuuuuggugaucaugguggugguuuguauguucauguacauauguguguauauguguacaugugugugugcuuguguguguguaugugugugcacguuuaugugugucugauauuagauaucuacagugcacagaacaggucccagcccccgugacaaaaugucaauggaguugcuuagaagaucccuuuguuaaauagauacccuuuaaauguuccuauagucucagugcauagcuaaaaagaauaagucauagcucaaaauauacaaaauguggaggugcgggcaaagaaugaaaguaaaguagaguccuucccaccuugcuggccuucccuguccucucucuccugccuuauacccucucaccaucuaguggccaccugaaauaucaacccuuaguuacugacucuagacuuuucuaaagcccaccaccaaaaaaaugauuacccaggagacagcaggcaggaggcuccugggugacucaugauuuuauugauaagcuaucuaagcauacacuaggcccaacagagccauucgaugcaaaugcaaggaauuaagacguacacuuuccagacaugcuaaaaauaguaacaccaacauacaacaacuuaagagacaaauuacaaauaaacucugccuuucccaagaagugaccuuuugggcuuugguccuggcccuuggacacuuaaggaugaccacguguaauaaaagguugaagagagugcuguucugaaaggacauguuugaauccacuaugcaacuauacaccugugcacuuccccaggaaugccaccugcucuugacacuguauccuuuggggaaugaagggaucagugagaccgguaaucuacuuuuacugccuuaaaaucugggguucaggcccaggaugggucucagaagccccaggggacucaauauaucuaggauaccugcucucacuuccuuuacagcucugggguccuagacucaucugugccuagcuuuggguuuugugugucaucaugaccauucauguugacauuuguugugggaaaaaaaaugcaguuuuggacuuaccugggugcagguuaccuguaggaaugucuucggaguuguuuacacguuaacaaccaguuuggugagggacaaacugguuauguaggaggagagagguauucagaaccuuugacagaaggacaggcaagagccagcaagucagaagagaggcuccagcuggccauucugaagucuucauaagaggucacucuccguuagcgguggcagugagcaugcucgaccgugacacuccugagaaggcaggcacauaagcguuuucccccuucccauuaucaaagaauaaggagacaaaguuuaagugcuugcacugucccccacacaaaaugugugugacugucagaaacaccaacugauucacaucaaauuuuaaaucggguaccaauuguaacuuuuauaccucucuccucaccccuaacuaaaucauucaaauuuagcaagauccauuauuuggguuuagugggaaggacucuuaacgcaaaauauuccugaauucuccugagccuucauaacucacucuguagggcaguuugggguuuuaccucaggaccccggaagcacacuucuuuaguauuucugguccucucauagaucacuugccugaugcuccuugguuaccgcuuccaguguggcacaugcaaaauacuuccaauaauucuaacuucaaaggucuugugucagagaccagagcauuccgcguccccucaagucuguggugguuggcaaucauugaaaaguuaacauuuugggggcuggggggaggggaauagguccuuaccucucucuuggggucuuguccucuuccacgcucccaucagcugcucugccucugcggugaucugguuaugggaagggaaacuagagacaacuuuuuuuguaaaacaaccacauugaccccugagcuaucuaacaauccugaacuaguauauacauagguagcuaaucccaggggagguagaggaggaacaagcaggaauggcagaugguacuuguucaggaggggggaaaaugacccucuuaggguuuucucuuucuucugccacauuaucguaucauccuaaauuuggcaagaugucauuugucuauuguuugaguuaacuugugguuacaaacccuguaacaaggagugaacuauaaaauguagaagccggaaguguggagugccuaggcucaaguuaacggucucucagggaaaauauacaaaaauaaaauaaagccucacuugaaauagagaaggggaaaaaaagaaguuguaaacuuaacauuugggggagcucacaugugaaacacucuagcucuuacacgauaaaaagcuucacccaggaucuggcucucccuuuaaagaaagaagaaggaggaggaggagaagaagaagaagaagaaauccuucucucagagucuucuggaaacuaagcccccucuggcagcuugcaucugaaacugcccacuaaguauucuuaagcugcauaaaggccucaaagauuuuucaucugaaacuccaaaggaaaggccggacccauuuucuuucuagucucucugaagagcuugacccuaggucagggguccauaggucagccuaggaaugugauguaacaacgggcacuccauccagcggacuaaagaccuuaauaggugggcgucagacagagacuuggugucugcugaccauaggcccauggacaccgaauuccaguguccacaguucuuggccucugcucacuguggcccuguuguuucugcuuggaaaaguucuccucuuucugugaaguuuuaguuuaaaagaggcaaaaagcauacuaauuuuaaguucaugaaaacugugggaagaggaaggugcauuuaaccugugucauaggcuaaaaaaaaauccagaaacuaauuuucauuugcuguuucugugccuccuagaagacacagcaacauuugaaaagcugcauagucuugcuaagaagugaguggacacaucuuauuuggaggggaaacugauugaaaaaaaaaaaaagggggaaugugccuagaguugaggguuucaauuuuaaucaacuaugcuauccucucuuuuaaaaaauuuuaaauguccugcaucaaaauaaaucaacaaagcaaaugcuuuucaaaaucaugcauggauucuugauaaauaaaaaaaugggacuuaguuguaaacuaaaaauaaggaagagaaaagcuauuggagauccuguuuguguacuguggcacugcgcauccagggaugugcauacaaaaacaacugcacuguaguaucauuauuguuauuuacuauaauuguauaauuaauaauaauaauaguuguuguuguuguuacugauguugauguuguuauaagcuugagcucugcuaaagaaaacuauucggggauuuuuuuuucucggaaaagaugucaaagaaaagcuacauuauauacaaaaacaagaacaaaaggaaaaaaaaagcuuguguguguguuuguguguggggugaagcaaauguguugugugcauaugugugugugguguguuauguguauauguguguguuuguguguuguguuauauguguauguguguguuguaugugugguaugugugugacuguuuguguguggugugguauguguguugcauauguguguguuguauguucuguguguguguguucucuguacauauguuauguguguauuaugucuguuuuauguguguauuuguguguguuuguuuauguuauauuguguguguuuuguguguguuaugugguuauauguauguguuguauguguacauguguguauguguguguuguguguauauguguguuguguguguuguguaguuauauguauguguuguauguguacauguguguauguguguguuguguugugugugguauauauguguaugcauuguguguguuguguguguggguauaugcauguguuguguguguaugugugugugcuguguguauauguauguguguuguauaugugcuguauguaugugaauauguggguguguauguauauguguguguuauguugggaagcagugaagcaaacaugaguacuaagccuccacaaaauggcuucccccaaaugggcagcuuacauuucauguucacucaauagacauuuacagucaguggucugucagggucuggcuagaauucagaaagcaacagacuguuagacaccugucauuuaacaagggauuuuaagaucacagagaacacuccaacugucaugcucucaucuuugagaaagccauauagaauuuuucaaaugggcucggugagcguuagcaccucagaguuagaggccuggguccuucacauacuuaccuugcuaccuuugggaggaaaaaacaaaagaggcccuggccuuuaaucugugugaguggaguggaugugcucaugaaaugggguacugaagugcucaugaaaugggguacugaagugcucuuacugcccagaacucuuucaaagggcugaugugacuaaacagaagacuuuaaaaaaugcaaaaugcaauuaaaacaugucaucauuaucauugauggccacuaacaauguuaaaagcaugagccaccccccuuuccaauacugggggugacccccuucccuaugguucauaccaucuccucaggguagaucauaugaguuagauaaaaauaaaauuaccuauuuagaaaaaaauguuuuugagaggaguugaaauuuuuuuaaaggaucucuguaaaacauguuauucuugcagauguuauugggaaauaagaugcaaauuuuccuuaacuucuaaauuugggggucagggacacuaugggcuucccacugcaccaaacaauucaguggaggccuucugaauuuagaaaaagaaaauggcugcauuaaaaaaaaauacagggggaaaaaaaaaacaaucugcacggugaauugcagugcaguaccguaccacuuggcagccaaauaaauuauuauauaauuaauuaugauuugcuauaaaaaugaggcauuacuauaguggucauauuauucagagugcuuuaccugcuuguaauaaaggcaagagauacuaaaauagacugaucuaguagccccuugcaauucuaaaccaagaaauaauaucuaagugaaguuuugaaaagaaaggaaaaaaaaauccacagauuuuaaacuaacagaaacaugaaaacaggccuugauuacauuauguuaaaaagccucagcucucuagacauuauagaauuuuuauugaauuauuaucuuucuauuuuucuaucuaucaucuaucuuuaaaaauaauucuagcacuaugauguuugggcaauaaaaacagaguaugcacacagaaaaauguuuuuuuuuuaaagcaacagaugacuguggaugugauacgugaagagcuucaggauggucauuugaucuacguuuucagggggcagaaggcauagauaccucguuuaacguaaugaagcuagacaguuagugaaaaagucucauaacugugaguaaauccucuccuucugcuucgacccuccccaaucaauaacagggacccagauacaaucccucucuuguuacuucagcgaaaugaaagcagccuagugggaaacugcagccugcuuugacagacagcgcuacugcagucacaggcagcagggagcaguggccaucuuagaggcucaggcgaggccuaggccaaggcugagcagccugcuuucuggaugacgcugcauagaaaggucagaguggcugagauccacaaagggcagacaggccagugccaugguaccccccccccuccccaaaaugugcuucuguuuggguuuaauaauccccuccaggaaaaaaaaaucuaagggauauaagggggaaacguuugcuauucugaaagaagcuggccucagaucugauguuuggugcagagagcugcauuagcagagaguauaaacuuccaagcuccuucuuccuauauugggggugggggcuaagacagaagacccaaguccuguuacugcaggacacuugaaugaaaauuuccugggagagcuuugcuucucaaacgaggcgacuaaggccucagaguauaagggaccaaccgggauucagaugugcagagucacuuaggucaucuaccugcagacaucugucccccccacccacccccaacucacaggucagcuucucagaguauggaaauggaccugcagugaaguccaagccuugucauguaggggacuaugcuuuucacguaacaggggcauuugaaauuuauagcaacuuccccuuuccguguguuugauucaaugauaccaauacuucccccagguaggcauaaauaaaaugaccaucccgucuaagauaaugauuuguggcacaucacagcaacacagucacaccaucaaugucuuuaauaaauaccaucacagauuaucgaauaucucacaggcaaauggagcacagccuuagacacuguaauccugagauucccuugacagguuugagaaaauaaauaaauuaauuguggagauucacucaugaagauuuuauuuaagcuauagauacagaccauuguuaauugcuguuuugauuaaucuggcaagaagaaugaacgacucagguuggaaaugagaagucuguggugggaggggcucugacugcaggaugaggggagggguuucugcgaggggaggggacaugaagagcuggggacauggagagcuggggagugggcgguggaagaugagggccucaaaagguaccuaucuggcuggcauaacauuucuuuaaucgucauccuaaaaaaaaaaaucuuuauuuuuuuucauccucaacugaugcauagaauuucuuaccuucaguccucagcuaaagcugcuugaaaaaaagaucgacaugcaaacauauacacaguucacaaggcuauccccagcuucccaugcaguguucacacauuuaguauuuauuuauuuuuauuuuuaauugcaauuaaaauacaaaggcaagauuguacucccaacauacaacucccaaccuucuuaaacuaggcccuuccugccacgaauuguaaaaauauaagugauugccuuaccucgggcucuucgcuaaggagaaaauuauuuuauauauauagauauauauuuaaauccagccacgcccacucccuugaaacuaacccuguguguuuugaauguggccuugccagcagggcuaagguaccccccccaaaccuuccuccugcucuacucccccccccccacagguggauccaguaugugugugcaugugcacagaauacaaaauacacauguuuugaacaaccccaaagcccugagugucugguuuuucaaccguuaaggcgggaggguuugacauacguauugagaagugaggauaugcuuagcgcaaaggggaaaagagagagagagacauaccgggaaaagguuauggaggcccgcggcggcaggccccacuccccccagucaucggcccagcagauuacccaggaugccacgccaccguugccugcgcguuuucccucugcucgcugcagagagucugcacacagguuauuacagaguguaccagcacggaaaguuuuggccgcgccauggcgcaaaucacaagguaaccuauuuuagaguacaaauauaaaaucggcggguacguugaaagugccugggauggauacugggacacacugagcaugucaugcacaggcgaacacagaaaauggacaccaacacacaccaacaacaagcugucugagucgaagcagccgugccaggcgaggcgggggcgcgcacccggauggcccuagcccaccgcggucacgaacaaucgagccgggggagccccgaagggcccaccccagcaguucugggcucaccucacgcccccgccuguccagccuacgaucgcuggcgcuggcgcuggccuccggccgguaacgacccucagugucgcucggcaccacuuuucucccuggagggcauauaguucggccacccgaacucuccaaaaggccccucucccaccccagggcagaguugggggucccucccuggaacuucuaacaggguuuccggacccccuccucccgcgggcaaggcccaagccccaccggaaggcccugccacccccuccccgggcggcccgggcggcccuacugcccaggggcagaagcugccgcauuaccuagaagcagcaggcgguguguacacauguaguccaucuucuccuccuccaguugcuugucgaugagcuugcugcguuucuuaucugcgcgcuucugcucucgcaucucaauggcuucuuugcgcaucuguuugcgccucuccuccauaggauccuuggccuucccggggcugagggaucgugaucggguacacucggauagaccgaagcagcuuccgaaggcucgggugaagaaguugcggacuggguugcucccgaccguguggcuccggggcaggccagggcggcgguuucgccgcagaagccacuggaagcagccgguggccccuucuuccgacucaucacuggaggacucgaucucgcagaugccagacgaugccucguaccugcagcagcuucggccccgcucguacuugucaggccaggcagucggccgcggaggaggccgcggaguaggcgggucagcaaccuggaucucggggcuggggggucuaagaugggcccugcugggggcggcagaggcugaccggccagcagcgacugcgcgggcagcagaggcugcccgggcggcagcugcugcgcgggcaggaagggaugcccgagcggcgggaguagcugagagugaccuggcuccccagaccaguggaccugcauaggcugcccuagcggcagcugcccuagcagaggcugacauugcuggggcgccagggacugcuccagcggccggaugggcucuagcagaggggacugcccggguagugggcuccuugggggugauaggggcugcccgggcggcaggcuccgccaggguggcagagacugccgcggcugcgggcuccaccugggugacaggggcugccccggaggcagacucggccgugguggcagggacugccucggaggcuggcucggcggcuggaucucugcugccuucagacucggacucggcaggaguggcuggggcgacuggggcugccccuccgucaggaucggcgcggacagcuggggcuucuucgaguucuucaggauccgacuggagaucugaaggcguuccuggggcugucccgucuucuccggcaucgcucuggcuaucugugagcaucgcggaauccguaggagcuccagcaucagauccgguagagacggcuugggcagcaggggcuggcuuggcauccauugcuucaggcuggguggaagauccguccccucucuccggagaggggacuuuuccuuccaccgcaguggcggugguagggcuuccuuccaucucggcugcuucucgcucaacugggggucucucugcgcacucgcucuuaucuggggcucccgagacuucgaugggcgggccaucacuugcgauuggggggcuguccauauugacagcggugucgucgucgaccccaauggaggcucugccaaucucaagcaggggucuggugaucuccaucggggggcugucgcaugcgaaguuaggaggagaucugacagccucgcggaauggucugucaauggcgccucggacccagaggggaggcgcguucucggcgggagcgaggcagagcgcacucgggaccgcgacugucgggaacucgccgccaaugccgauuugugggaugacucgcgggaguccugggggugggcuaucgcccccgaauucuucuccaccgaccugaaauggcacagauucuucagggggagggcuguagucuucucggaagccagcguuuucaaaucugauguucccgggcuccgcgggaagagcucuggggaccaaugcuuccggaccuccuggcgcaaggucugggacuugcaagggaggcuggcuauggucucccugggcaggcucguugaacucaaauggcauagcuucuucugguggggggguauaggcucccaggccugggcucgcgccagugggggucccgggcuccaaaaucgcuggguugaaggcuuggaggccugauggggucccagaugguccuggcugcuccagggugggccagaaaucucccaggcugggcuguugugucucgaauggcauggcuuccuccggaggugggcuguagucuccacccacucggacuuccucgaaggccuggcaggggcuuuggaugucagauuuggagucuucuggggguccacugaucucacugccagucucgucggggacgggcucauuguuagacgguucggaguccgguucggucgccauuucuucggcugggccagccccagcaccgggggcagcugccccuggggcuuccaaagguucuugcucgggcugcuccccgacuucaggggggauaucguguuguccugacauauuauugccguggaggcaguugaacaugcccauaacacgguggcgacuuuucaaaauaaauuuggggccccguaagacggagcacccagccaaacuagggugaaaaaaaauuuuuuuuuaaaaaauucaaauuuuuguuggaaaguucuccagccucaguuuccaaacuuuguaaggauagauaaucaggggcuagaacccaggaccauggcugaagugagucaucucuugcuggugaagucugucaccuuccuaguuacacuuaccccuucgggcuguggucggccaacaacuuuaggaacuuuucuguucucucuucguacuuugcuguacuuuagcuccgccuucuuggcauuuaagagcgugccgauucgucucgaaaaucguaaauagaacucuuucucugccgccagaggacgcaggucucagugcugagccggcuccgggagcuggcucccggugccggcugcucccgacuuuggguaagggggcugaugagcggaggccuuguagggacguucggcuccguccucuccucucccggacugauuccgagucucucuagcucgcuuuuucccuggccagagagcgagcgagcucucuugcguugcugggacacgugacgcaagacgugggcauuggucuguuagaguacagacgcugaaagccucccuccccaucugauucuucucgaggggaggagggacugcaggagggcuuuaucaccccagauuaccccaguaugcgguaaauuccuuaucuaaggaccccacacucaggcaauuacccauacucaucuccaagucaggaaauggaggcuuuaggauacaaggaaagggguagaggcacacacacacacaaaugcgacagguggucgugagcccaccggaaggguagagacagggugaggaagugccgaauguaaacacgcaauuuguuucguaaaugcucuaggguacuuuucuuuauuucuuuuuuuuccuuuuuuuuucuuuuuuuaauguuuauguuugcuguuuguuggggauggcuccagcaaaucccuucaaugucccccauccccauuacaccucggagcucucaacagugguauaguguguuguagucagggcuugcucuguuuauauggacggugaugcaguagaaauaaaggucucagcagugcacugcagaaaaucaagcaaagcccccuuaggaguuauucauguuugccgcuuucgugcaaauaggggagggggcuuaaggcuuaccggaagaccccccaccuagcucaggucuuguacuucugucuucuggguaaaggcaaaaggagauuugggguguaguugauggcccauuuaggguggucucgcagacuagaaaaccugaaaugcacuuaacccaccgaccaaccgugccaugguggcaacagcugccgagacucgcaucuuccagccaccagcgccagcugcggauuccguguucauuuccucucucaagcccuucuccagcccccuuuuauccccuccuccuucuguugugagcaccauagagcauuugcuauacguugaacugcaacaguccacccaggcgaaauuaagcgcggucacaaagccugcggcugcgcgccccuugcggugccggggugggcucagagcugcaggaguuuauacagucacauugcccggugggcucagcgaauaaucauaaaaugcuuuaggucugggaucugcagauuauuccugggcaggguuuuuuuguuaauuguuugccuuugggguucuguuuuuuuuuguuuugccgcgcgcccgcggcacgcgcacaccgcggacauuuugccaguagguaauggcgauggcgcgaggcauugucuuuuguugcaauacagcuaggcagugggcaggucuggccugcaggacccugagaaaagagaguaugaagugguacauaaagcaggcugcggcaauuaugcaccaugcagauggguauauugcaagaugcaugcugugugccgcggcagauuuaauucucugaagucuaacaugucccucuucucacuacaggcucggcacacuacagccccuugccuacagcguccacguggucacccugaguagaagaaagcagacaaagugaacccccagagaaugccugcgaccugccgaaggcgugucaccucaacucuacggcugaacacacugcaugccggacacuuugaacuuugguccaaaguuuggccaacuacccucccccacauauacacacacacacacucaaaauggcgaaacgguuugaacauacaccgaauaggccaacugggucucaaccacuagcccacuccccuccgaccccagcgacaggucagcuauugggcuggggucacgccaaucaaggaugccuggcgaaugagcagggggcuucggaccggaaaccggauaugggugggagguccaauagggggcgccgcguuggaacgcccaaagagguugugcuugcuggguugguuggaagcgguuggcgggcgggcguauggcggccaggccuagaaggccacggucgccgugagugccuugggggccaagcuuuuugaugcccuaaaucgccaaggcaaggugggaaggucagggacccccauggaccaucccuugggcucaugauggcgguaggcuaacucacuacacagagagggcuaucgccgaggcaccgcggagagaggcuuuuccagggccuggagguggugggccaggccuauggagaaagagagcuuacugcuccgaugcagacgagcaguacaagauggacagauuucauuucccagagaugcugaacccugcacaaggugaaaggucaguagacgcugagguuggcgacccaaggagaccgccacgcgggucuugugggcucuccaggccucucacacccaucccuaaagcaccauucauccaaaaggaaaaaaaaaugguuucagguucucuuuguucagacauucuuaugaucugugagaauccuuuguuccacauucuuucuuauaucgugcuucucugacagggagaaaccuccagagcaugccagucuccuugugaaagagcagaacggcaugaaaauggaaagagaaggccuccaauaggagggguugcaaagaccagauggagaaaauggcgccuggaaugggucuccauagcaagaugucuugacugaauagaaggggcggggcagagcgggcacaccuucaccuaucuggaacaaaggguccaauguaaggaaguguggggucugguuacauaaaugaucggacggacaccuuugcuccuguaggagcagugggaaagaagggagaaaauggaugugcuuucugaggcguccaugcagcauccgggcucuuugggcaggaaguggagaggaggaaaugggguagauggugaaagguguguguuucucccuccuucucagaucaggauuugaaucaagcuuuuagaaaggacagaaccaacauggagggugguuccgauaaagggaacaaaggaagggcugugcacaaagaagcugcagccgcggaagcccugagagaagagagacccagacacaguggauaaaagagacuuaaggguuccagaggcuuccuggaagcacucguauuagacaagucacaaaagacggaggaaucaaagacuaccaccuggguuuuggacacugggaauuacauagagucggggaggggcuggugcugagguagaggcuuuuuuuuuuuuuuuuuuaauuuuagacauggcagaauugaaaggaagauggacgauuugauauacauauauguauauauauacauauauauauauacacacacacaauauacaauauauauuuacuauauauauauauguauguguauauguauauauauguguguguguguauauauauauauacauauauauauauacauauauauauauauauauauauauauacacacacacacacauauacacauacacuuacaauaaauuccugggaaggaaaggucugaaguuuaggagaaggguacaaggcaaaaauucaaauuguccaucagccuuacuaagguuugagauaaaugaaccagauaaaauuucuccaguggagggauacagccaaggagaggccagaaggagagagagagagcagggcaggcuccagaggcugaagugggagcagcccuugugugugcaucauggcuucuuagccucgcacuggggacuuggggcagguaauagguaauguuuuguuauggugacuguccugugugaggcaggauauuauauggcuucucuagucuaaaccuaccaggugccaaugacauccccuuaguaugaauaauaucaauguccucagaguuuguacagauggccucugauacagaguugccccuggcuggaaaagcugagaaagucuuuacauugacuuuaaaaauaaaaaauaauuuuuuuuuaaaaaggcacuuuaauuuaaagguaaauucauacugggaaaaacagagcucgggauuuaauccugauuaugcccugcccugugcucucaauuuccuaugguggcauagaccuaaguacaaaggcucugcuguacacaagcagcaaguucaagagggccuguagcagaagguaacuguauggccuggccaaaggacuuggggaguccagaaugguuaagagauggaggugaugaguggacaaguuggcuuggagucaccuuacuggguuucacugucuggugccuguugauguuggugaucuggcugccucgauacaugucugacacaauuggugagugccuggccuggggccuuacccuacuaggagugagguuucuaauggucccacauuacaacucuacacuaggaaaggaucuuuucccuccccucuuaguugugugugugugugcucgggugaguguaugcgcgcacgcgugcauucacgcguaggucagaagacaacuuguuggggcuaauucuggugucguguagguuccaugaaucaggcgccuuuguuugcccaucuccucagcucccuggcaaaagauaugucaucccuaguccagcugacucuguaaugguugugauggggggagguaaaugcugagagaugugaguaaaacaaagccaccggcgagucacaaaagcugugggugggaaaggagugggugcagaggaaggcuuacuaggugggaaaggcagaagcuaagccugggggccucgaccauccacacaguguaugcuagagugacaggcuaugagagagauggugugucagguggagaggaggcucuuuccguauuagaaaggacugguaaggagugccccuguuuccauugggcucugcuucucugaggaaaggcagcuugcucagugcaguuggcccagacgcucaagucagaaauaaucaggugaccuuuugaaagucacaccaaccauaaagaagcugacucucccucggcuucagcuuccuuaccuaaaaaggcguggucccacuuuucuguggugcccugggcugggugcuuguuuacaacaacaguuguauuuauauuuacauuuuagggcuuuauguguauauauaauauuucccccuuugggguuuuuguuuucugcuaaaagcccaaggcccauccagauaccccaaguaacugcuucuuaacgucuuugauuuaucccuguggccgcaaaagagaaagccaaguaggaaaggucccuuggguagaagggaggguggagugagcaagaugguggggggggggggaugcagaagccaggaauagcaagaccauuggcaguaagguuucuuuugguuuauggcuuuggggaaggggcagccuuauaaggagccuucucugccuauaguacauaugugucccauuaauuuucaggcaaaggaaccagaugcagaaaaagagaagauagaaaaagaauucaggcaaacacuaagucgcucagccucccaaugacaaagguuuucugaguguuucccugaguagcaauaagacuuugaagcuguucaauuaauuacuguucaauuaagacugcugcagcccuccccccaccucccugccaucaucucugcaagccuuggccgguggaggcagcagcucugcagaaggggcuguguggcuggccuguuugagacaaaugcuaauuaaagggaagaugucucuagcagauagggcaagauacuggacuagggacugauguggggcucauguuagggggaugaaaugauauuuaugaauacagcuggucaacucuggaugaaaagccacgauaaagggcaggccccucccucaggcuuauuagcaguggcuugauaucaauggcuuucuuuguggaagagccaccaaauugugccuuagcuugccaugcuccugccaccugugccugcacaagguguccacaugaacagcugagaaugcagcugaauccacgagggagaagugccuguugcagaugagagaaacaaucaggggaggugucugccggaggggcgggcugggguggaaggagugggggcugggaucccagaaggcgguuagauuuaauagaaaggcuauguaagauuucuguaacucauggugggaauuguaggcacccaggggcuucggggccugaauauuauuugaauuugaggggauuguguuguucaccuuuucaggcaaccucaaucauccaaagcaaauuuuccuaaugaagucuaauugaaacagacacauaagccaggagaaucagccggguauugccugcgggagggagaagccuguggacucuaggcccacauuccugcauuccugugccauaggaaugggagccucagaggcuggucuucuugagucaaaacccaaugcuuuaaaaaccauuaaguaagguuaguagcucuuaagucuuuuugguuaaugaauuugagguauccuuaugagaacuccauucuguagagcugaaguugaaauuccccagcuaggucuauaagacugggauggugaccucaagggugacugaucugaaauucuccucuaguguccaucuuuggcuauuaaaaauacucuuccucacccugaggugucgaugcuccuuguugcaccuggucccauccucccucuucagccugccauaguugguguguccucaaugguuugauucccuaucucuucaaagugcuuuugugcacccaugaaauguguuggcugugugcuccuucccgggccuccauagcauguucuuuuacucccuggguccccacaacccuuuuugcuccccucaccuuggggcagccacauccccuugcuaguguguaacauguuuacccuaaaauaggcucauaggaaaaaacauaggaaugugcacauuugagcuccccuggggccucccgccucuguggcugagcacuaucaauaagugauguugcucugcacugcagacaccugcacucaggggauccaagucacuaggcuaugucuguccucugguccucaccaugccagcuguucugcuucauggcugggcuggggcucccuaucuaggagacuuggagaaaacaaacacuaguaaaauuagaccaaauuuuuaaaugccccaaagggguuaaaacaugaaauaaauaaauggucaauaaaaagucaauuugcagagccgauuauugggagaaguguuugcuuuguuugccucagcaguggagccaaauuuggcuguguguuugugucugggggugagugugugguguaugucugcugugcauaugaguguggguguguaugaguguggugugcuugcuugugugugucugguguguguguguguguauguauguauacauacauaugggggagugaguguggguguguuuguguguguaugaguauggugugcuugugugaguggcuguguuuauguguaugaguggguacauuuguauaugagugucugguguguguauaauugugggugugcuuguguguaugaguguguguguaugaguaugucuggugugcuugugagugugugugguguaugacugugauguuuguguguguguguguguggaugagugugugcuugugugugagcaugagugucugucguguguuuguggaugaguaggugcaugugucggguauguguguggaugagugugugcuugugugugagcaugagugucugucguguuuguggaugaguaggugcaugugucggguauguguguggaugagugugguguuugugcaugugagagguaucugggguaugaguauugagugucugguguguuuguaugaguacgugcauguguuugauacgugugugcauguuuguggugugugugagagugagcuuagcuauuaccaggccuugcagcauauaaaaagaugugaguacuaaaacuggagacaggaaccacuggcuggauauggcuggaaaaaaagccccugggagggaaugauaauggacaggaggugaaacacuuccccguuuaucccaacuaucuagagccucuaagccauuacuuaaccuguacugucagcuugcugucucccauauuucguagcuagcaucccuaaugggcuuguaccaacuggguucuggaagguucauucuagacacuaaccacagggggagaauucgggaacagcacaacauagcauugauaggugcucuuaggagugcucgcucacacuccccaaccccgcccccaggacuggacgcagugagucuugacaacacaaacacacuucuucacaguuagugcuuuuuauuuagucaaacauuugagauuugggaacgucgcuggagcuagaggugcggcucugcccuucugacaccagagagagaacgauuuuguucugcuagcacacuuuaagaagaaacugaggcagaggggugugagggaagaccggaggcagucagcaaggugggaaagaggcacccugggcucacccaguaucuuaugccuuuugucucagucugcugguuucucauucugucuggguuugggaguuagguuaauuaguggccaaaccccacaacaggacauuccuucccucauguggagcacgggaucaaagguauggccugaguuucucaucuuguuacuaagugggacuucagaggaagcaguauuugagcuaacaaggugacaucacuggucucuggcccugaacaauugauuaucaugacuugcuuuuguugcuuuugugaugggcugcuguccugcuugcccccacaccguugucucugcucaguuuccucauccucuuuucuuuugacaugacaaaaggagaaauuaaguaaauccauuaaaaaaaaaaaacuuuauucuuaccaguucugauguuucaaguuucucguuaaggggacacagcugcuaaaauguaggcuaaagagucaaagguuguaagcaaucccagaggauaaaaggcuucaggcacauaaaaaagcaaacaaaaaaacacacuuacaaaucaauccuagaguuuacaccucccaucucauucuccaauucucacaaauaaaauuaaaaguuuuacugauaaacuaaacaguacuuacaucuggcauuugccaccacacgguauuugaacauugccacauaauuuuaaaaaagaaaaucacuuaaaagacacucaauaaucgcacccuuccaccacagaaggaaguuuucccauuaagcaaacgauuaaugcagcuaaagauccaaaagcucuuggaaggcaguuuaacuagcuuugucaccgacccccacuugucccacgugcaucucccucagccagucuaccuacggagggaaagggcuugccaguccauucaaaugcuaaccccgcuuuaacagggugagacaaagggcuaguuagggauguuugaggaccugcuagaaaagcccuggaaaaguaaaauccugagccuagugagcgaaugaacuauuucacagaaaauggccuugggauggguguuuuaucaaaaccucuugugugggugguggggcucucccaaggguggugugcuccuauauagcccgccgagguuuuuuuaccuggagucaggauggcgcuagggagggggaggugcugagagggaggggaggguugugcgggccgguagcaggcuggacuaaagcgucugcugugacucagguagacagugcaagguuacuaauagaaagcaaaaugcgcguuccuguuugaauaccccggguaugagccucucuuacacugcucacuugggcuucuuuuguagcuauuguuguguuguuuuuaaauuugguuuguuggcggggggagaggguguuuguuuuuguuuuuucccggaaacgggguuucucugugcaguccuggcaguucgggaacuugcucuguagagcaggcuggccuagaacucacagagauccaccugccuccccauccccacccgacccccgcugagauuagagguuugcaccaccuugccaggcucuaggcuucuauaagaacagcgugagguggugguuauagaaacuggagacacuuuuaaauuuuuauuuaucccagcaacaaggcagcauccuaauuuuuagcuaaugaaaaaaaaaucuaacugcugaaaaaaaagugcggcuucuccaccuguuaacuagaaaccuguugcuugguaaacucaggcuacauuacaagacauaaagguaccuaacgucaagaaaacgucacgucaucuuuuucguugccgagcauuuuaacuuaggaaaaauaaugucucacuuaggcaauuucacgcuuucaacccaaaagcccccgccuccuuuccgcaagcuaccggcucauucucuacccacugcuaacaaacugcuuccugcuguugaccaaagucgcaauuagccgcagugcgcacagcccacccucacuuaaauucugggggcugcgacgccaucccaggaaagaggguagguccuggaaggagacuacguaauguguuccuucuagcaccauucuccucuuaggagcucaggagcccagccggcuuugauuucaagcuuugaaacugcguuucuuaaccagauuucccaaaucaucccaucaaaauaucucaagccgccgcaagaccagccgcgcacacuuaaaaaaaaaaaaaaaguuucuaaaugggugagauacaguaggugcguuuuacuuaagaucagccuuuccgcccaaggcuggaggggaaagcauucuaaggugcguuacgugcuuggugcuggggcagaucaccggugggugaucuccccucccccacagguuacagguuccaaaaacagccccacccgagcugaagauggccaaaauggcuguagcgcauccucccugccaccucucaguccaaagcgcaggauccgacaucuucccagcuuaggaagugccacgaucuuuggguacaccuuugaaggugucagagugauagccacgaccuccguacucagccugugccuugacccgcuuuaccuuuccucccaagaccacuucuuauugcucucauuccuucucuccugccucuauggccuaggcgcacagucccggaccucuccggacaagucggaucugccuaaccagcugcgcgauaccccgaugugauccuagcugucugccaacccagguagcccagaagggcacccguaaagaacccuauaccaccacugaguguccuccaagcacuauccacuaucaagaaacuccuuucugcgcgggaagguuggcuuuaggacgcacgggagaggugcgcgcgccccuuuucacgaucucaggccuccucgaaccuccagaggugagcgguauuaaccaagacuacuugcacggcguggggggaggcacuggcuccagggucccgcggccccaaauuggccaugccgguacccgauuuccaggcuccgcgccggcugaaugccacgugcgauuuaggcuccagaguugucacccaaucccaaacgcaguuacuuucugcgcauugcaauacuguagcuauggcgcagcagucucagaucgccaaaguuggugcgugcaccuccauaucgagcccagugggcucuaccuaaagccaacuccguugcugaagacuaacuucuguaggaggggagagaacauagaaaacaagugacuuaccuuugccguuuauguauguaacuccaaaccuggggcgcgcugggaauucaguguggcacaccgaauucaauguugcgcaccggguaucagcucggggaccucagguugucuccagcgaggcgccagaaaugccucaccguccaacaaaccuuuggccucccaagcgccccugggugcccuggagagacuugaagagcccucucuccuuuuccggggugcauuucgggcugauuaaugggcaccgcucccuucccaccuugccucccaucugucucuuuccucccacccuacugucucagggaccccaguuuggucagggcaacuaaccuuuauccaugaaaacaaggagaaucuggacggagucacccauuagugacgccggauggggaugggccccuuucugggaggggacuccggggacuggucgcgacggcgggcuggccuccuggucuugcagcggcggggcugccuguuuuccuccuugcgcuccucuggcuccuccucggggucccgaggauccugaucuaagggcccucgcuggggcuccucccccucgcuugcgcucucaggcuccugaguggugggcugcgcacgucucggggaggcgucggcgcucugcaacuucagagcgugcagacgcugagugagugacugguugaagguggcaccccgggggccgcgcucguccucuggcucggucucuggcucgguuucuggcucggucucuggcucggucucgauuucggucucggauucgauaucggacucaggcucggucucagaaucggucucggucucguagucguccugaucguacucuaggcacucggggcgggccagcucaggcucaaccuccucgugcucgugaucagacucagauucagaggacucagggaguaccugugcggcagcugcagcggcagcggagcgguggugggcguuaaggaagcuccggcgcugggcagcacgcugcugggcgcgggcguuggaagaggcuagggcgcggaggagagcaauggagcaggagagccagaggagagcgguggcagcccggcggccuaugggcgggcacaggucguuguaauuauggcgagcucggcgccacugcugagcccgggaccugcgauccauucucuuaggugcucaccgagaagccgacucacccucuggcucugcagagaguggccccacugcgcaaggacuguuggggccgaaaaggauuaaccuuaugaggagagaagcuggggucugaagaccccaaucucgccucggggcaaaaagaagggauguaccuaccuucaaaccacugcgaacuuucuaaagcuccgcgccucagcuuguggcuguaaguaaaagaaagggauggguaaagaagagagaaggagucuccucgaggcuccucucgcuaagucucagacucugaagucuaagacuccgagaggugccuccacugauccucucgucugggagaggauagaggagacugaggagagauggggcaauggggcccuauaaaguugcgcggacuucugccgggcaugugcaguagggagguguuugggggcgggagugccuccccgcgagcugugcguuggcgcauagcucauggcgcagacccuagugggccggcagguggcaggcgggaaccuuguuugaguagauuuggccaaagcaugggggguggggggcuggauaucgaggucuagcgagcgaagggaguaagauagcuacagguuagcggauuuuagaagccaaguauagauucccacgggggguuguccccacuccucaacuuuuucuccaugagcauagccaccaaacaauugaaaaccagaacgcaaaauuguaaauauucaggggaaugaggauccguacgugaaugaguguuaaugaccgaagagcgugaaugcuugaggaucagagccucaaguaaacacuaaccuuaucaaaggugguuacuuuugucagggcuguuaaaguaacuguaauuaauuagagcagccuccaagaagguaugaaccccacuggcaaacaaccccgccccccgcggcuguagauguaggaauuugcaagccgacagucagcucauggugaacacuguuccacugaggugugcuggaagaccauaggaagcugagagugaguauccacgagaaugcccuucaacugcugcucuccguguggguuuuuaggguagucuuugagccacggacucaugcauuucagcugaggguucaaccaacacacuugaguucccggcacucgcggagcucuguucuaggugcugaagauagcgaggaacaggagcaggucuuggauuagagaaaggggucuugagggguuaauauaucuuaaccagagcaucagcucauucuuccagcaucauuacuucaucuagcucacgcuacaugagaaaaacagguacgucagcaagagcaucauggcuagggggcggccagagaccacuggauccugcuguuggacucggaagaacaagguaaaacgaccugcuuguuccagagcgcgcuuggaagagccgauggacucagguagguccaggaggggauggagcccugugggaaguggguguggggcucguuuaucuugccuuuugccuuguuaaauauagaguaccuuaaaaaaaaaaaagcauaacacuagcagaguuguguuauagggaugcaugaagucuuggcaggguguuuuaguuguuggguuuuugguuuugagguuuuuuugauuuguuuuuuacauggaacacaugucacacggugggcuguuugguuuuuuguuuuucccuugaguccaugugaagagucacaagagguacugcugccucuccaagcugcucccccaggguuccuuccuggagguggaauugugaguuaugucuugaagcaggugcugguccuaggucacuuacuuacccucacacacuugcaccucagagucaggcucccagaugcagugucacagacuuagguccuaggugcccugcaugguuggagauuauagaaucucucugucuugacuguuggugcugcaucuuguggucuaggaguucauguacagccuuaaaugcuggugagauagagugggguuggaucagcagaucucaugaacaaauguguggcuguaaucuagauguucugcugacucuuagugcauugcugugacucuugagccccuguuugggguugagaucucagauccuuaucucugccuuuccacccugaugaauggggguaucugagggguccgaccgcuuccauacacuuaaccuuauuuuuuuuuuuuuucaguuaaaacaguucugccaacaucauauggagcacaaagacauuggucuagccaauuuuagggcacacagagagaggaaaacaggacugugggugcugguaaaugcccguuugauggaaacugaugccagcugucagcagugagguggaugaugguuuuuagugugugugggaaagugccucauuuuucaggggaaagcuuuaugcccgugauagagauggcagcccacauccuaugcacuaguacagaaacaccaggacugcccacauuauuaaaaacuaugcauuacauaauacauaucuuggaccaggguucugcauuagcacugcucuuucuugcaagaugcguuugaaucagcuauggacaguuaacaaagcauacgcuuccgagccccggucaucuguacaguuacaaauucauuucagcacgugcucagcacggacuccaggaggagcagggcugcaccaaaagacagcuccaucuugcacuuagugccgagguugagcaaauggaucugcacagaaaaugcucuuuaaaaugcauuaugugcaggacuuuaaaaagugcuugcugcagagugaauuucaaaaggggccaaguaggugaugaacgaccucaguuguuaccagcugggguacaagggguucucuguguuugcagguaaauaaaguguggucauauauuaccuuuagacuuucaggaaggaggcuucuagaccaguugggcaggaaggcaguuuccaguugcuuacaguaucauauagaaggguucuuauuuggauguauugggaagaagauucuuuugagcuuagaggacuguccuguggaaauggcuucacuaguuauuugacauagcuccagggggcaaaaugagggccuagaugggugcuguguacagguaggcuucagcccaaggaggaauauucuagcaaguaggacucugaaggagaauggacucggcgucggcaggagcuaugcuaagucaaaggacagaugacuacauguuagauagagguuuccauggagcuugugaaacugcuagagcuaagacaagguuugaccacggcccucuguaguugcucccccagggcuguaggagagggcuugggguggggguggggguuucaagccucccacucugccucaguuucguucucacuccuggagccaaggugucagucagggccaucuauucauuacauuggccucugggccuccccuccuggagcugucuuggaaauuacaaaauaaaauuggcuauuuaguggucaugaauugagucacuuuuaugaccuagcgcuguuccuagcauuguggagagauggaagucaaugaggaugagcagcagcugcuggccagcgacguggaccaugugagaccacagguaaaguucuuccaguucgucuguuuggcuuuuauuuuucaaacugagaggauugccccuauucuaccuguuugaugugcagagcaacauacugggaaccagugugucacaugagucugggggcuugcaggcuaucgucacagagcuacagguaccagaccuacaauagaggcugggcucugcucugccuggccagcaggcacaagcacucucgaacguggcuuuuagacagucacuggaggggaacaugguuuuuggaaauggagagcuuucuaaacuuuccuuuggagagaaaugaauugagggacuuugaaguauuccccaccucucccuguggcagucagccagaaaugcucaaccaacugagaauuuggcaugggccccuucccuccugugccgcaaguugacgaggcagcauggggacauguggucugucucuccaggugcugcuuugcuguacucagaccacacugaucuuaguugacuaacuguuagaaaugaugaaaacuccaaacuccugauuuuguaauuuagggggaaaggccagcuaaagccaaaaagggggggggggguaucuauaggaugugucuggguucugcccugaccaucauuggguuuaucuguguuguuccugucaggaguaagauggggucagagcugaacccauagacccaccuuuccugcccuccacuguaugcagaucaacacagaaccaacagaaucugucugucccucucuguggagugaguaaugucuacacuugggagguccuucccucacagagcuugcugcacaggcccgcugaaaaguguguguguguccuuguuggguuuuguuuggcccuagagcuuggccuuucugggcucugaugauuguuuuguacuguagaggucagaaaugggcucugccugcuucccagccagacaccaguguguaagaugaguccaggugcuucugaucuuggauaucgucugccucagcuucuaccuagaauggcgucuuggggcagaaacacuguuggcuacucuggacuugcuacccaaaaggcauuacuccuagcuaggcuuuuguucaacuuuucugagcaacucacuccccccuccagccaccauggacagagagccuccuuugccugagguucugagucacccuucagaccugggggagggagccagggagugggcgagccucgagccagaggaaagaagcccuuaguggugucgugguucaggcucgggcucauagaauccuuucagcuugagcucuucaaacgaugauuagaccaauuuuacaugucuagucacugaggccgcaguagauugggacucuuucuauaugugcaaagugaaguggagaauugaggcaauuaucuucaggcaaaugagucuaggcucuguaaucagccuguccugauaacugggcaacaucggccucaugcacagagcuuugcuuugcuuugagguaaagaggauucugaggcauguguucguuucucacuuggcuuuguuuucaaaggcugucugcuggaccucccagcccagcccacccuaugcaggaguugggcugagccccaccccugugggcucagcucaggugugcauauggcugugugaucugucccaggcuccuuuaaccagccucugccaugcuguguuuaccuuucucuggacaccacccugagauccugagccaguuuacugacguacaguguuaggaugacaugauuccuaauggaacuuaugacgacuuugcaugguacacaaugaagcuuaugacuggagugucaucuuagguccagaaaugaaggcaacagucccaguccucccuguugugauuauuaaacccuucauuaauugugagcuuuuucucauacuggcaauggcuacccuccugacccauccaccaccugugagggaagaacccuugcaugguggagcaggaugaaaacguaaaguccuguagucucccguggcuuccuucucugggagccacagucgcaugggaaggcccugugguaguuugggugcccaccgaaaggugugacagagcaggcagaauaugugugggcacagcgucccucccucgcacaacagcacaauuagagaacacugugucuuaaucugcugccuuugacuguaagugcuuuaggaauggaggacuugaaauggacuugggaaagguaaauaggaaaggcugcuuucccuucagagucagaaaauagccaucuuguccccuugacauuuucugaugucucucuuaugaaaaagaaagcggggguaggaggagcaugaaucuugcgucuauccugggcuaaguggguuuugaaggagauuuuugucuccaaggguugacucauccuguggucugcacuuucuuacugugaucuugucuauucccggugaguuuguuagauuguacugucuucccggugugucccucaguugcuuuacagccuguccuucguuguuuuaagaccugcuggacagagccuguggcuuccuccugcacacugcguccucgcucucugagcuuuuugcccauuuauuuuucuauacaaauuuaaaaaccauuuuuaucaaguucuguaauggccuuggugguauuuugccuggaacugcauucagucaauaaauuaaaugaggaagcaccgugaucucgucugcauuuagucuuaagccugaagucuagucucuauguauucaagucuuucccacauuaagaguuuguauuuucuuuauacaauuugaauauaaaauguggcauuugaugcuugaagaaauggcacacauagguuucucaggcauuugauacuuguguugcuuugugaauggguauauuuuucauuggguuuuuaggcuguuuauaauguguuuaugggaugauauugguuuuuguacacuucccucauauucugcuacaucuagaauugucugguggaugaggcuuccaguagcuagcucuccagugcaugcucugcugacuccuggagggagugcggagugcucagcuccuccaccacugaaugcccagcacugcugguaggaagagagacacauagacagggcuuugaguuuucgugccaagacuaauuuagggagggacuaaccuuuacugaggcuaccuaagccucuuuccuaccuuuuagguuuuuauccuauuuuguuuucuagaaggacagaagaugauuauuagaaguuuuauaugguaaguuuuuagauauuuuaaauuaagugggaaauuuuguuuuuaaucaaacugaauucuacuacuccccaaauaauuuaaaagagagcugauauuaagacacaagacaagccuuaacaaauauaggaaaaugaaugaauuucuugugauagacaggugagugaggggcaaaagaggaaaucaagaaaccccaagaagcaaguggaaauaaauacaacaaacauagucacuggcucauaaugaagagguuuccagagcauuuauagaucugagugcuuccuuaaggaaaaggucggcaggcaucagacuaauucagucuccaggacccauguggucaaaagagcugacugaccuuccucaaguuguccuaugauuuccaucgguagguguguauguguguguacagacacacaaaauguuuuuuaaagccccacgaaauucugaacaaacagcucacugaagacgaacaguugaaccaagcugaguaaccugcagacaggugucucagggcagaagccaacaucgaggggaaaaaaaaaaaaacaaagaaucaauggaagaaagagcuggaucguugaaaagaugaguaagauuggcaggcuuuuaaccaaauuaacccaaagaugaguaagauuggcuuuuaaccaaacuaacccaaagaaaaggauaaagagcaggcuaguaauuagccaggaaggugacauuacaucuaauugugugcauccugugacagcagaagugacaaaggcggcaaacacauaauuccggaagcaaauagaguccacuaaacuaggaaauacaaagaaagugguuugaaauuuucuuuuugaauacaaaauuuugaauuuguauugcaugugacugaccaacgucaaacccagaugagguaaauaauuuaaacaaaucuauagcgaguggugauguuggugcgguaauaauaaucuccugacucagaaacaauuaggcuuagauagauucacugugcauaugaccagaccuaacacaagaaccaagcaccaggacuuaccgcauuccuccauggaacaggguaggcaggaacauuaccaagcucccuuuuaagaaaccaguauucuucacauaccaaguuggccacaggaacacacacaaauuauagaccaauuuuacacaggaauaaaaaugccuaacaaaauacucagaggggccagugggauggcuuaguggguaagccugcugccaagccugaagaccuagccacccacccauguauacuggaaggggagagcugaauccuacaacuuguucugugguccuuccuccaugagccauggcacaggcacaccccacauguaauacccaaguauacuuuuaaaacuuuaaaaccauauuuuaaaaaaaaagauaucacaauuucauagacuucacuucagggaaguagggguaauuaaagacaugcacagaguauuuuaagugugugacaucacagaaaugaacucccaaggccauuucauaaacucucaacaucccuuuguaauaaacuccuugaaccagccagaagcagcuguguguaguguaacaaaggccauagaugacagaucugcagccagcauucuacuacguggggacaaaucagaaccuccauuauggucuaggccaagagcaacgagagcagagaagcaagcacaagcauggcucauggagaggaggaaguggaagcauucuuagcagaugacaugguuccacacagaagaccuuagcccaggggaaacccugagaaccaacacugucagcacaggacaggacagucacaaaccugacacaucaugugcuccagcaacagacccaaggagaccagagaaauggucucuucgaguugcuuccaaaacaaaacaaaucagcccuugcaauaggcuuuuuuuuuuuuuuuuuuuagguaauuuuuguuuugcuuaacaccauagauuucuuuugaaauuuuaucaucauaaaaucucaggguaggaccucucagcucagugugcucuuggguagaguucagccuuugguaggccugagcgucuuuuacuguaaaauuguuuucaugucauucuucugguuuguucucauccagcagucgguugucaacuuguggauuguaugcgauccuguuagggucaaagggcccuuuuagggucacacaagaccaucggaaagaauguagauauuuacauuaugauucauaacagcagagugauaguuauaaaggagcaaugaaaauaauguuaugacuuggauaagcacagcaugaggaacuguguaaaaggguugcaaaguuaagguugagagcggcugcucuagucaguuggaugccaucuaguuaggcuucugcuuuuauucuucugaguuuuuucuaauuacuucacccuuaauuuaugacucacuguguuuucugaaauuacacaagagaggagcagucuuguuugacuugcuuuuuaaagagcuuuuucucuccagucacugcuuucugcguguuaggugguugguguuagcauugaugcugggaacgggggcgguaaugccuauaaagguguuaagcccauggccgagguggugggaagggaaggggacuuaaucaucuuggguagaaagagccccaacggucagacccagccaagcugcauugugucugugugaaauacaacucuaauuuccuuucaguggguuugcuuguuuuugagacaagauaggccauggaauagagagaacccagagugagguuggaugguggucgucuguuguagagccugccucccuacucuucuugucggggcaucaugcugcagaguggcuuaugcaugccaaggugcuacagagccuccaaaggagcagugguuuauuucuagggcacacagcacagggagcuaaccgauacuuggauauaccaggagaugccuuccugggaauguguccugugcacuugagcugaggcugaaggcugauccugugguggcaggggugguacaggcagucagcaggauugugggacagcgggaugagucugggaguguuguugagugguaggaagcccuuacccugggaccaggaggugccuaaucaaguuuguuucaaagcucuuaucugguaccagguuuaagagauaaaugggaaaaccagaguugguggugacuacagaaauauaugagaugggaggugguaagagagcuucagugacuaaugcagaagccagccacaaagcuugaggacaacaucccaacacccauguugggauggaucuguguauccuucauugagugagagaaauagggaacacagcugguugugugauagcacuccaaguucccacaugcugagcauccuucugcacuaaccugugggguucgaaguagucuugggccccacaggaaaaggcaucagaugcugcagaguuucagucuggcccuugauggagagaaguaggaaagccggugccaaggaacccaccuuugcgugcuccacauuacuucuggcuuguuggucuugcaaguucuagaacuagaagagaccagagagacccagccuuagccacccucaguuuacaaguaaggacacaggcugggagagggaagggagggagggucuu

SEQ ID NO: 5 - RNA, 71078 nt, Mus musculus
cugagucuaagaaacuaagagcuggagagguucaacucaauccaaaagaauaccaucccgggagacugugaugaagggaccuauugucucauccauccguauuagccugauugcucgcagcggcuuaacagggcaggugcccggggaaugguuguggagcaaguacuuagaucuuucuuauuuaugugauuuuguuuuuaaaucaagacaauccacacaccauuauagccauucuuuaaacguaacgucugaguggguuuuaaacucacaaggcugugcagaugucggcaccaccucacccuagaccuuuaccaacaacacccaccgagucacuuccguugaugacaaccacuaauuguuuauuaucgaucugucuguuccagauauuucauauaaauggagucuuuuguauccggcaucuuuucuuuagcauaaugacauauauaguauauaucucacauauauguauuauuauauauacacuuacuauauaauaucuauuauaauaucuaucaguauauggcuguuuauaagauugaguaauauucuauugcaucaaaaccaaaugaucugcaggcuaguuuuucaaauguccacgauuugccagguuucccaucauacacuuggcggagcugggaauguuccucaggggggucuagguuuuggggguuuguuuuuacuguagugucagaugcuuuuuacagaucuggcacccucggcuccccagguuuccaggcuuuagucagacugaaucggauccuugguguugugugauccggaguugcugcuggcaggacuccagggggcuuccuucccaccccacugcccccuuccaggguugcagagaggucugucuggcugucuggaacaauagaacaaagaggucucccugaacugcagaaaccuguuugacagagauugcugcagucaugaaucaagcugcugaaacuacuuccaccuccucccugugcaaacaccccugggcccuggagcccggccuuuucuccaaaucccaagccgaggcuugucccuggggaauggagcaauguugggagcagaggucaggaacauggucuuucagcggcaggggugccuucacacucagggcuccaacugaaaguugcuuugaugaaagucccuccccucgacuuuguggucaggcaacauuuaccugcugggcagcgcaguggugugcacacugggggcccccaggccaggccggguuguaguucuggagagugcauuccagcaaagaguuagucagauuccuuuccucuugcuaauaggucauccacaaccuuaugccuaaccagacugcacccuuucugaaagaggaaggugguaagucccggauagcagaugcuucuuagagagcuuccguguugaggagcugugaggagauggccauguuaauccugaggccacucugugauguguguguggcgauuguuauuauucuggugguggaugagaaaagcuagucuuaaagacuaacuaauugaaccacacugcccagcuucucuaagccaagguugacauuguaaccagcccuugugacauccauaugcaccaggaguagugacaaaggugguguugugaccaucacuaucacaacaauuaaacaaggcggagggaggaugccgaagcugagggagcacuggaauggacagugggcugucugacuuucuagccuacacccuuaaccacaaggcaggcagacuucugcaccucucagacaacaucugacagccaggugaucauucaaugugucucccuccucccaugcugcccuucucugccuucaacauuugaaccacagaugaugguucgguggugugcauaggcuuacaggguuaggggcacgguagaaaacugaguugauguuugcugagggcuccccuugggugugguccucucucugauaccacuucccaagcuugugugguguugcagcagggcugaggggaagaggcaagggcugguagaucagaagagcaagccgagagagugagacuggagcugagccacuuggcaguggagggucccaugccuggccagucauccuccucaggcccacugauguuccucgaugcggacugugacauuacagcacaacagcagcaccugucugaccagugaccuggcccccaagaauucuccuuacaguucugaccuuuccauccagaguucguguucucccuugacagaaucuuuucucugacaagaauccacuuccgcucucugggcccuguaggccucucuugcugugagguuucaucucugugccuuaaggcaggcuuggcugggaaggacaugagggcauucccaggccuucuagacuugcuggcuagcuguugcuccccacccgccucugcaugcaccuucucuuaggcugcuugugcucagagcagagcucugugacagguuugaaaaugaaagacucuuccuggcugcucccagaugcguuugcaucugcaucgggcugacaucuucuuuaugauaucugaugaaagguuugccacgcggcguuucuacaugagcgcgugcuggauggaaacccuccaagggcacugggaauauucacacuaacaagcuaggcacacgaggauggcugcugucugcaagcacagaacagauuuagcaacaggcccuggaaggaugcuucaagcccugcugcaccugagcuuuuccugcccugggauucuugcaaaaaaaaaaaaaaaaaaaaaacggacugaagaucgagugucuccaauaggagcacuaagugcuuccuggagcuuuauaaauuuaaauuugauauacuaaccucgcuauuugauuauugcuggguguugaaugguacuuacacaccuagcaaauaccaaccgugcagauccaggcaguuauucuguguuccuccauauacagaggagggagcaugcgcacgaugaagguauaaauaucagccccagcucucaucaacaggcagaggaagaacuggaacuccagcccagaaguccaucccucuauccccaugugccucuguauugugaaaaugguucauuugauuuuuuuuuccccacaccaauucugggauccaaaggugagaugcuggguaaggaguagcaggacuuuccugcuacagcacaucuucaaagccaccgcaucccacuguggcuuuuauucugaguggccacaucgcugcagcagacgcucuuugaaaugucgaguuccugaccuuguggcuuccucccacucccuaaagguccaaguguacagaacugcauacaaguaaagaccacuggggcuuuuggagagagagcuccaggguccucugcuucagucaccucugacucagccuggcucugggucuguagcacagagaaagucacacccaaggaaaagagcagauucuucaaggcauccuccaagcuggguaaaacuggccucuagccugccuagcugcccaccagccacauggacgacgauaggauuccacaguaggcgcgcagacagagacccuucaguucacggcugccuguaauguggagucaggaagggcauccuccaaucuguguggauugaacauaaguagcaacaaagaggagguugggaagaaggggcagaguggguagcauaauaggccuguuugcuccugggccauggcuuggucugagacacaaucaccucugcaaaagggcccuuucccuagauggccgugagugaccuagagcugguccccuagggcuuggugcaggcucauucccaccauccucugccagggaagcaggaaaggauaaugaccggguucucuucccacaaagaugcuauucccaggggccacuuguuugccgugggaaaccuggccagcgccucagcccuagguccugaacucacagaccuggugucuagggccugggagggaacugcaguucucacaggcuucuguauuuaggccaucuccaucucggagacuccagauuuccuuaaagcaucacugcauugagcaaucuccacccccacccucccacccccccaguaggacacagcucaggagccuguucagaaucagggcugggacuuugcucugauuucucugucagaagagcagaggcagcccucaauccgcucuaccccacccacaucccagcaucaaggccacacuggacaucuccucccucaccuagccugggccucccugagaacuaaguuucacagagggcuugggagucucagguacagaauggaggaaggaagcuggcagcaaugugguaggaaugcugaggcugagaccgagaccgcagagggaggacggguagcgaauggcugugggcauagcuugaagaccagaguuguucugcucuguugcuuacccaugaaugacagcagccagcccccuccuuccagcucucuggaaagugaaggcaguaaaaucuuccaugcacacaaaugcaaagaugaaacacaagcauccuacuccagaagagcucgguauaagaggggggccgaguggcauguggcuguccaucaaagaagguaguguagaaaaggagauuuugugcguauuaggauuaacagcucuggggucagacuuugagaggggaagagggaccuacucuuagaaauaagagggggagauuccagcaggggcuuuuuacaagcuuggagcucuuugucagcuuggggcuuuacugccaugaaguagcuauuacugggauaggcaagauggcucagugggcaaaggcacaugcuguuaaggcugaugacccaaguucaaacguugggacccauguuauggaagcagagaacagcagagaagagagacagcagguuagccucugguguccacacacacaaugacaagguagcauguguacaacccucucccucgugagccacagaaauguacaugcacagaagauagguaaguggauguaaaagcaaacuuuaagacaaguagcuauuauuauuacgaacccauuaauucacaaggaaaggugacaucuuagauauugccuuaagugacaaucuaagggauugggacugaggucacuuggucccaagagccauguggauaaguguggcacaaaagugaaugaaaaucccuagagcugcaggcaggugcauauagaguuucuuagccuuggcaucccaaggcuguccuuggaucuugauuuaguuucugugccguuccugucaacuguauucauuuuguucugggaauagauaguauuugaguuugccuugcucucccuagaacaugaaaaacauucuuuacacacaacacacacacacaccccuauauacaaucuuaaacauggaaauuaagccuuaugaauucuuuuguuuaacacagauuugaaugcacuguuuugcagaucccaaauuuugcuuccuuuugcuccgugucugaaccugcucuaggaugaaggcuggagccgcaguguacucuuguauguaauauuccuuuaaagaaaucucagcaucacaugagcugaacagaacaugggagugccauggugcgugcucagcuguaggccuggucacaggccgggccccucuguaaccguggcaugaggcaucucugcucucugcaguggacccagccucacacuaacucaagucuacuugaacaucaucuguguuguugaaccuugcugucuuugugacuuacgaaccuauccaggucccuuucacauuugcaucccaucuuccagggaacuggccaugucaccucaguuauugucccuuucuucuccgaggaguggagucacagcugcaggugucugggaggaaugccuucuucuggucuaugcaucugaaaccauaaauccacagaauacucuccauuaaguuccauauuacccccuccuuggacauuaccacaaggccagaagaggaguuacagcguaacucaaacagcagcaaggacaacugggguuggagaagggagucugggcuuuugcagucacaccugcaugcagccaauacagacuguuuuccccuucccccuccgcuuagcagcaagcaugugaauucuaaagcacagcucuauguuuguccagagggcgugacgugacucucaggccacaacucagcuagcacguaaccauuauuuagaacugaacuuaaaauuucuaucuugaacgaugcacuacugaaugguggaagcuggucugacaauugguccucuagccccaccagacaccuugguacccagauauggauggaugggaucuuugucaucugcacauacuggcaucuguugagaagucuguucggcuggcucugugguccuuguuccaagcaggucaccccagccuccuccucccaccugcaagacauugucauauuugccaccuugaucacaucucugcucauguuucuaagacacacuggcuguugguggcucaugcacaacuuucuugcaugaguaguaggggccuuugcuaagggcuuccuugauuuuuuuccauuuuccuuaauuuaauugcuuagcaaaguaugaguucucuucuggauccccugaacuuccagagauucuucauguagauauauaaauacaggacuuuguucuucacguguaggcaaacacauacacauauacacauacauauacaccuaaauaaacacacauacacacacacacacacacacacacacacacacauuuacugccagggaccuaccaggaucaaaccacuugucucugcucuguugggugugggggggggggacgggggguguucaggguuuauaguaucacuuacugaauguucuuucaaacauuuugcuuauggaaaaaaacuguaugcuguagggcuuaggcuccaaguguggaagacuugucucugcuuuuccuaugacucagcucuccucucuggggcagagagagcugcugacagagggcagggaaagcuguguguaccaaagcuugugcuggagcaaugggaagaaggaaggaugcugaccccauuugaagguguuggggacuccagguugcucuuagucuguagagcagauguuguaggaaauccaggaacggcacaggcuuggaaauacaggauuauuggggacaggcagacagcuuccacugcccugggacuggccaugaucaccaaagcuacucaguuuucaucuccuggugaacagaugaaggugacccuucguuuagaauggggccuuucccugugaccuuucagauuucuuuguucaaaguggccauuguuuucugugucgaagcuccuuugugucugcggcucuucaucugacucauuuuauagacucacucuguaauugaggguauguaccagauggccaagaaagccuguggaaaaaccgugcucucgagauccucaugaggagcagugugcaugcuggcugacucaacuuucuugaacccuauucagauggcuaugaguuccuagagauccugaaacagguugcccgggacaacacugacaauccugacuugagcaucuuguggauugacccagaugacuuuccacuggugaguggcccaggccaaccuccccccgucccccacccaucagggccuuuaccacccauauuuguguuuagcauaaaacauucaagcgugagggacaaacuaaaauaguugaauguguuugaagaagcccagaggcuaaugcguauggaguguguucauauacuuuuaauacagccuauagccucgugugguuaugguagugaccagacuaaccauuuuccuuacuucugggacaccaagaggugacuacucuuggagaggccaagccaggggggccagaaacauuccuucuuuaagcaauaauaugaccccuuugugucucuacccaccacucccugagauucuagaagcaaccuaaauuauuagggaauaauugcagaauuaagacccugaugaagcaaaggagaauccagucugaggacagaauccaugccuagcuuguuugucacagcuccuuagaaggcaggagaaauuugccaccauggugcuagccuguguugaugagcaauagcaagaaagcguuguuaauucuuaauuuuggacacaguacauggaauucacaccaugcauggacacagugaugauaguggaggaagccacauccucugcuauuguuccuuauuggccaaguuccuuauuggccaaguucaaugcggcaccaagagccaggauccccagcacugcaugacauagaaccugggucuuuucaaaugcuuugaagacuaacacauaggucuuagauuacaguuauuuguuuaacgauguccucauagcucauucccucaacagcccuaaaaccagguacuauuauaauucuuaucucacgaagaaagggcgauguuaaacugagcagauguuaaacccuacugugacucauagugaagucauagcuugcucuauugaguguuucugguaagguuaacuacuagugaugauacaaguuugguugcucucuggcugugagauacauaggucaugacuugugaaacugauuggacagcaagagcuggcaucgaauccuacacacauugagauugggugaaccaaaggcagagacuuccaugguaauugaagccaauggcauaauucugggucaacauaagaaagccauggccacagaagcauacaggauuaaucuguugauuuaaugcuggguauguucaguuucccuggacugcuucaucaugucaacuuuuaagugaucggccauucuuuugggcaguucuacaucgaccuugguucuugccaagcaaucuccagacaguucuaauuuccaaacccaccaacaucccagucuguucuaggccauguguuuaccagggagaccccugccccugaacaccucuauuuucuuagcuuuauggaccccuuuagcucaguuagccugccccagccagagauuuguccagauggagcccugcugggcugaagacauuugacucgugucugcaguuuaugccaaguuagagccuaucagaguucucccagccaucucauguggcugggaggcaccagauaagggcuuuuaagaauggaacauugaagcggagguggaaagaaauggcucuuucauuacacacauaauaucagugaacgagucaaauuugggaauagccaucuuugugauagucucccugagagcuguggaagcauuuauggucuacguugucacaguuaaugcuauaguaucuuuuacucaaugcuuuaaagagcucuaaugcuggaggcagccuucaauuuccuaaguguccacagcuguuuucaaaggcauuuaaccagucccuauccggcuacuauggaaggcuggcaggugggucuagccacagggagagcccuccacccacugucuaacuuggccuuuuuguugcugcagcuuguugcuuacugggagaagacuuucaagauugaccuguucaagccacagauugggguggugaauguaaccgaugugaguauucuuaccgagggcuggucagacacccuguuggcagcuaugcaagcccaagcacaaaaucacucaggagucuacaacagugaggaacccuugggucuuuuccaaacucuugcaguauggcccaagacugggcucuagccagucccaacccucucuaggaguacauuuccuugcuuauggagcuagcccaacccgacucauugacuuaggacuuuccgcccaagaacauucucuuguguccucuuccugaacuaaagaacaaggccuucuuacacaggcuacucaugcccagagcaaccauuaccuaagguggauaagagauugacacccagaaucccaugcuagcggccacccacccugcagucaggcgacacugauaacagaagagaaaccuccugacagaaguuugagcacugaugaacugagggugagaagggcuagugggaugaugugacagagugggaagaaauuuugacucaguccagacaucugauaugcaacaagacagaaguggggcagauucaaugagguuaacagugggaagaaggagcuauaaugagggcccaccucagcuaguacaggaauauucuuuugugaauagggccaauuagcaaugucuuuuugccccauagaaaguacccuagcagucuauacauuuccugacuuuugugaaccaguuugaaaucugaauguaaauuaauuacuuaauaauuaauucugugugugugcaugugugcacauauguauucucuuggguaguagaauacagauuucuuuuacuguuauugaaacagaauacugugcaagaccauuucugcaacuuggcauuugcauuugucuaucuguauguauuccugcuagguauuagagacuuggaggcccauucaacacagcuuggaaaaugcugcccugccucggccuccacccauuugcucaugggcucauucuguuccucauugcaggcugacaguaucuggauggagaucccagaugaugacgaccugcccacagcugaggagcuggaagacuggauugaagaugugcuuucuggaaagaucaacacugaagaugaugacaaugaagaugaagaugaugauggugaugacaacgaugacgaugaugaugacgacgaugauaaugauaauucugaugaggauaaugaagacagugaugaugacgaugaugacgaugaauagcuccagcccugggugauucugaugagugacauuacaaccaccauguaccauacagacagcccaagggggcagcaagcaguggugcccacaccuagucagcucuuuuccuuucuccagcaucuuuuucuagucuguucuuggcaggagugguacauuucagugaaugccuuuccaaacccagcaggcucacacugcagggacagaaggggagugauucccaugcugacuacuucuaaccauugaggaacaaucagcccuuguucuuugcuagacaaucaggggucauggaauucugggagucuggggacuguaucuccugacaccucuacucaaguuuacuuacugucuuugauccagauggugacagaacugacagcuugcuauuaguucacaagcagggaguggccuucuaaucagaguccaggaagggcacaugauuauccaaucucccgccaaacccagagcaucugugaacucagacccaagccuuuggaugucaauuagaaaugccuugaaaugugugggcauugccaucauuucuggaauauuaggaugaugagugggggucaucuagcucuaugaacaucccauuaauugccaagccucauauauucaccagugguaagagaggcugaaggauaaaaggcuuuucauuuuucugauggagaccguuuaggucucugaaugggucugcuggcugcccagagugagcugggaacugaaugcacccucucuguccccgcuagugagcugucccauucugaguuaaaaucgcuuuauccacuggucaauuaacucuccccauucaucagcacucccacaguugaccagggcagcgaccauuaagaguucacgaugcccugaggcaccaaggaaaaaaaaagaaaagaaaagaauccccaagugccuuuugaauugucugaaaguaacagugugcuugguaguguuaguugcuaaguguccuaacuuauuuuugaaaucuguuaacauggagaagacucugugugguguuguuuuugaaacuggggcaguccuuuuauggaauaguaauaaacuaauggacauuagacucauguuuugaaaagaucgaggcuaucuugaugauccuaccccggucuuuggggguuuguucaguuuugccuggcuggauccaguucuaccucucugcaccucuggcugcccuucuagguuuaguauuucacugugucucuccccacuauccaugucuccaggcaugagcauccacacccaucaaccacuacccgaguguuaacgaccuccacugugggucucuacccuucaucuuugaccuugguguuugauccacuuggauucaagcugcaaacuucaaauucaacacaacaaagccuuuauccauucuccuuccccucgacgcuuguccuuuccaugaagccccagccuggaugauugcuauuacugucuaugccauugucuaggugccuggaagugccuugcucacuucugcucccacggcacugggugcacacucguggucacagcacucaucauugaauugauaaaacucacugcauggccauccuuucacuaaauacaggcuuuaagggacaaggcguuuacuuaucuuuguauuccaagcacuucgcucaucacaaagcagagcuuaguuauugaaucaaucggugaacaacgggucagccaaagcagcugccauugccucgcugugcugggcaguggaguuuacagggcacauaaggugccucacgcuguguuagguaacaaaauaauugagagaaacaacugaaaagaggggauuuuacuucagcuuacaauaucauugguuuuagcuuaaggucugaugccuccacagccugcagcuggagcuauggcagaagggaaccaugggagcagcugcuggccucacugcagucaggaaucacagagaacaagggagggaucgggauuccaaacuaucccuuagugucccucccuccagugaccuacuuucuagucuccugagaguccacacaguugugaacucagaacaagccaagaugagguuagucacgucacgaucuggucaccucuaaagccccaccucuaaauauagcugcaucggggaucaaguuuucaauacauaauaagucuuggaagauacucacauucauaucacagcagaaugcuucagucuggguggguuauucaguaaaaaucugccuuucacaguuuagucuaaugccaaugugccaauuguguugguuccugcucagggcuuuuuugguggcuuuucauucuguuugcauauggcagacagacagacagacagauaacugauagagauagaugaugaugaagauagauauauaguaguaaauagguaauucucuucugaaaggaugccuguccugucaaauuaaagucuugcuacuaugacuucauuucacuguaauuaucaucugaaagggccuuguguucaaaugcaugauuuuggggaugcauaauucagucuauaaagcagggccucaauauaauuuucuccccucacaaaacuaagcaggcugugcuguguuccacccacccaagcccagccaaagcucaagcaaacucuuagggaagugauuguccuucgaggucucaaugccaaaacuuucaaguagccaaggaguugagggaugugguccauugcaaaaguggucuguuucucagcccaggaagaucugcuauucucagaggccuagaaauaugugugaagcugaaacuaugcucugauguuccugcauuaggaucucugggaguccaucugguucugccuggacggugcuguguagucaguacugagcccucuaagcugauauggguugagcacuuucuugcaugccuggaguacaaugcuaaaugccuuccauguuaucacagcuaauucuuacagcagauuagaagauucgucugguuacuguccuuaauaaagagaggcagagagagcucaagcaacuucucagcauuacacaaacacucugaagggucacagauaacccuucauuuuauacuuaaaaggauuugcauuaagaacccaaacacugcauucuuuuucccucagagcaugucugaggacagacucaagugaauuuccaauaacucuuuuuauugcuugaacccauuuaucuucccauucugaguucauaaucaacucaaacagaacuaaaagugugggcuaauuaaaaaacacaagaucugcuauccuguuaaaaagaggaguaagaucaugaauguuaucuagaaccaagcacccccuucaguguguguugaugaaacugcaucucagaacuugaaaagauccugccuuuucuagaagagagugugaccccucaggucuucuggacuucguguuugucacgcugugaggaaccaugacuguaccuugugcagaccacauauaaucucacuuucagugguacacauucuucacauacaggucugauagcaaccuuaggggaaagacuguuuuagucauuucuacucugcccaaauuugggugggcaagcaauaaaucuugugacaacuuuauaaacaugauacaacuugacccucauggcuauuaucccuauuaaaaauacacacacuccucaacccagugauuauuuaaagugaauauaaaccaacagcuuuugguagcaugguaucagcuguuuggauuagcuuaggauagcagacugcuacagaagccgaccaggaaaacuucucagcucacaaaggaugcuugucauguagggugaccuuuuuccucaagugagcaaaguccuccagaaacacagcccuccuuugugagggacugagcagcagcuagaaaggaguacagaagugucacaucacgagggaauggaaugaccacagccaccuagcagaccaaaauauuugcaagauggauuaagaggagucuuuggaaucagugugauauuuuaauaaucugaacccuuuaucgauaacugcaagucagagugauaacgcugggacugccaucagccuugacgcuccuccuauguaacaccguucgauuaguuuguagucagugcuuugaugcugaauguccuucuguucucauucauccacucgcccauuaaaacucacagccuuuuuaacagucuauagaccaauagaccccuaaacuuugucacacauagauuagggaaggcaagaacaagcagguuguaaauggagcagcugagcagagaagcaagagagaaaaaaaauguccgaagcacccagcuuuaguucugaaaaaggcaacuucauuauuuccugaaauauuauaaagacuuagaccacagaaacaccuguggacauugacccagaaagcagagccaaaagucaucucuaaguuuggaaacugagccuguguaacuagaggauggucccgugacacauuggcacuaauggugaguagccuccucucuccuacaacugagauccuaucugugccagcaggcccugccucuugcucugggauuucccuacugcuguccugaugucuucaccccacuuccuuaaugugacaguuuaccaucggagauucucaaaacuccuccacauucuacagcuacaaccccgggaaaagaccgaaagagaaaagggccuuuggcugccgucugcauguggcuuuaauuuuguuccagcagguuuugcuugugaacuuaugaacugugagcaucugggcugauggcccaaggaaacagcuuaucauuaaucuauacgaugaguaucuccgagucaauugcuuucucugaucccuguccaugaaacuggcaagaaugugugugcuaucaacauuccacgcaagggaaggggagcugaguacagaggcagaaagcagcaacauuucuucagcagcuaaucuagcucccucaucuaaaguaagucaauaauuuaaaaucaauuaucaagggaaaacgaauuaucaaacacagcugucugucuguauaucucacgccccuauccaauguauaccaggucuccugcuuuccacaucucaaauguuuuuuuuuuuuucuuuuucuuuuugguuguuguuuucucucuuuuuuuuuauuuacucacaagguuggcuuccucuccagguuugagaaccuaaggguuuuaucuuuugcugccuauucacuuagaauuucccucgccauaaaaugaucggcaaauguucguuuuccguaacucugaucacugccucucauugcccuccuccucuaucacacguccccugauugucacaggaacaugugagauugcugcaaaaucaaaucaagaucgaagauguucccugggaaguaaacagaccuuagagcuaagauacucacaucagucagagaaacgguauacaacgggaaccccaauuuccaagauuagagcauauucaauguguaaaugcucauuuggaaggaggggaggacacuaauggaggaccccaaagaaagccaaauaacguuggauacuagauacaguguguccaugacagacaccagcccucaccaacaucaugaucagaauccauuucauacagcaaaccuucgugacacaaagagacuuguguacauggcaaggagccauauaauucagucauuuauauguucaaaaauguccagugagagugcaacauauauucagacguggucauacgcacaugguaucugcugacuguaaguacaggcuaagccagaacugccucucuugguuauaaagcacggcacuaaaguauucaagaauaauauggucucuggcuaucuauuuuguauuguuggacucuaccagauaaggaucaaaguuggguucaaaauucagagauuaaaauccuugguaacaaaaaccuuucccuuaaagccuggcccagguaucucuggucugauccuuaucagaguucaauucauacccugggugggacagugccugccauggcugcauccuugcuggugucccacacucugugaacacuuaaaauuaacuuuaguuaagcaggucauacuuuugguguuccagaggaucugaaaaguuaaagcauggaguaaccuuuauaaaaauaagauauuauuaacauuacagguuuuuguggucccauuuuuaggcacagugaucauacuagaugacuauuccuucaugucuauaacggaggggcaacagcaccugaaggcaagggcuauaucucccuuccuggcuccuagcuaugccacaugcuuccacuacaguacuuauaauauagcgugaacugaacuugucacugugcaucaggugucucagcgccauaacuaauucucuaggcaagggucuguuguuugauguuuuuguaggcuggcaguuuggcaaggccuacaucagcaguucucaaccuuugggucauggccccuuuggggaaggguugaaugaucuuucucaggaaucuucuaagaccaucggaaaaaauacagaugucuacauuaugauucauagcagagcaaaauuguguuaugaaguagcaaccaaaauaaauguaugguugggaaucaccacaacauuagagacuguauuaaagggucacagccuuaggaagguugggaaccacuguucuacaugaaugaauucaccagggaacgcaccuggccaugucugaaggcucagagagacagaaagacaggcaaagccagacaauuugcaugcucaaaugcuuuuauccuaaugcuguuucacggucaaaagaaucagagacucaagauaaaagcucuggagguuguuacauuugucccugggaguuaauucaaaagugucuuuaucucgcugaaugaaucuuuggacuuuucugagaaagccaccuugccggcacugccucaggcuccaggaaucucucuauggggcuggaaaacuccguuccacucuaauccaccagugaagcacguuucauaggcaaagcaaguuagguagaaaugggacagauggagucaaggggcucuuguuccaucaggaguuucccacucucugucuacccucagaaucuuaauucccaaugcagggauaaugugagcacuauccugccaucucugucuauccuccccuccaacagcacaaccaaaguauaacuuacacacgguggggcagaggaaaaacaggucuucuuuucuuuccuuuugacccuuggauucuauuuuauguguacucugccugcaguccaaaggguagguauggggaaggggagagaagcugagaacagagucaaggagccagacaaaaggcuccagagccaccagcugcagccaaucgcauaucgcaccucagcugggccaccuuagcucucccacccacaaagccaacucaggccccugugcccaagggccaaguaagccucuuggccuggucagguccaacagagagaggcagcuggaccugaccaggcaaauggcugugguugcuggcagcucaguggcggcagcccaggccugccagguuaaggcuuuccugggaggagggucucuuggguuuuucucauuauauaucccaauaggucagccugguggugaggcuccccacaggaccaagcgguauaaacccaaagggaaagaaaugaccuuucucccaaggaauucucagacucagguucccacucacgguuggugucuccaggucccuccuccacacccagaaaugccaaaccacuuagaucacugcuggggagagugggcagaggggcgggguucugagcaccugcagagaucccuuuaaccaaccaggcaagucucuucuuucaacuuucuccuauuucaccugcaaaugaaaggaucccuaauuaagacaccgugggggaggggcaagcugugcugcacagugucugauguguaacagcuggagagugucagcacccuccccuccccuccccuccccucccuucccuucccuucccuucccuucccuuccccucccuaaauacaauguuuugucaaaauggggacuccauuaauuuucauuagaauaauuucacaaugaaauccaucacucuauauacuaacacaaaaaaguuaaucacaaaaugugguccccaauuggauuuuucuuuuuuuuuuuuuuuuuuuuugagcacccauucaauuaaacgugguuucaauggagucgaacuggugucugcucacgauucugugaguaccauucaagaacugcacuauggacauaaaaacaaggcguguuuuauuuauaauuggauaugauaagauuacauauuaguaaguucacaguagugauuuauuuguuuuucugauguaacaagauccauaaagagcaaacauuacccagaaauacguuaugcugcguucuaauuguagggucucugcugcagggcucucuucaaaugaucauacagacaucccugucaauuucagucacgaaucauugguuguuucuuuuaaguuacauuaaauagaugcacgggaggcucccuggggagugaaguuugaacaguaacaccccaccccaaguuugccugguuuuggucuuguuucuugcuguuuguaggucacagaggucccaaggcaagaaagaaagaaaugggcaugccugcaaggugacaacgggcucccacagacagcuccucauggagaagccaguauaaagaaugaaggagaggacaaugagccagcuuugaggaacggucgugaacagacucagccauacccacauguacaaacgagacacacaacgacuugucacuggccacguggauguuaugacugccagcgugcaaacauggcaacgcacacuccgagaaguucaggugggaacagguccucuucuucccugauuugcauccaccuguagggagucuugcacagcagggccaggguugaagagggcaaaccaaggucucugcuucguugguucacugggucaaugauuggcaguggugagaguggguagucaauuuccaugaguacaguguguugguaggaguucacagacagaacucugugcuggcuaguuuuaugucaaugugacacaaccuagagucagagaggaggagugccaacuaagaaaaugccuuaguaagauuggucuguggauaagccuguaaggcauuuucuuaauuaguaauccguggaggucccaccccacuguggaugggaccaucccugggcuugugguccuggaagcuauaaggaagcagacugagaaagcuuugagaagcaagccaguaagcagcacuccuccauguuccugccuccagcuccugccuccagguuccugcccuguuugaggucuugucuugacuuucuugaugaugaacuaugauguggaagcauaaaucaaaaaaacccucuccuccccaaguugcuuuggucacgguguuucaucguagcaguagugucucugacuggagcaagcuauugcauuuaauacaugcacuccagaagaugauguagaaauuagagcugcucaccaccaccucugacucaggagauggcaagaucgaguacccuagaccuuucuaaggcuuaucugcauggccagucuccccauucauuagaaagccccacacucuuaaucccagcacucgggaggcagaggcaggcggauuucugaguucgaggccagccuggucuacaaagugaguucaaggacagccagggcuauacagagaaacucugucuugaaaaaccaaaaaaaaagaaaagaaaagaaaagaaaagaaaagaaaagcccacacuaacagugaauugugauaaggcaaacauacccaggccacugacuucauacucugugcuauaaagaaucugucuucuuauauccagaugaugaugaugaugaagauuggaccugcaccaaggaccucaacaccccuaaacaacaggaagugguuuaagaauuccgauguccccuuucuucucucaccuucucucucuccuaccuagugucaggggauuggaagggauaagggaggugaaggguaguagggaaaacaacucaauaaaguacccaaaaguaaaaaaaaaaaaaaaaaagaaucugucuucuugcagaucucaaaagggaguuagaggaaagaagggagaugauaaauguuggguaagcauuuacuuuaugaacuuuagccaagacaguuuugaccccacggguuaccuaaggaugugugagccucauaaccuuaaaguccauuuuaauucccacuuccugagcauucaauuccaggacuauuaaagacugcuuuuucuuuuuuuuuuuuuuaagcacacaauucugaacaaaaguugucuuaucuaccuuuguagauaaugaaaaucacccgggaaagacggcaaucucagaccuacacucuucauugaguucuuccacaguuaauguuagaauuuuaauaacuuagguuagaaguuauaggggggggggaaucuauaaacguuuaagguaauggaauccuguguccucuaauaggaucauguauccuacuagccuuggggagcaauuuacauccuuuaaaaagaguaggcuaugaggguccaagaaaugaaauaaaacuuuauugucuucaguugugugaugcagcuuucugcaacuucacauuucuuuugcaaacucuccucuacaccguucgcuuccacgucaacucggccugguaaaacgcugggagcacaaagacuuuaaaggauccugcuugugauuuuggcuuuucuuucaggaaucgaugcaaacuuaagcauuuugaagaaaaaaaaaaucgauauucaauuuacaaccaaaacaauaauuucaggaagucugaaguucuaugcaaaggagauggagaggggccaggagggaaaauaaauuaauuccuuaauuuaaaccguucuuugcccuucugggaaugcacauaccaacacagggcuccaauuuaaccccuuuaagacccaugguuuaaccaggagcaggaagcauaguacuguaagauguuaccuuuaacgcugcaguacuuacauuuauggcacuuaacaacugaaugguguugguggcggagcagcucugcugugacauuacccuccacacacagcuggucucucacagacugcccaccccuuaccucguucuccuaaaauauuuccugaguaagacauccugaggaacuuccaguagaagggaccuaaagguuucaaaguaagaccaaagcaccugguuacacuauaugugugugugugugugugugugucacagguuucucuuccuucucuagcacaucuuucugagcaaaaguuauugaacaaaaaaauaacauuggcuuuucuaagcacagguguaucacaaauauuccaugccaauuuggauuuuuuuuuuuuuuuuaaugacagacaaaaucgcuugguucguggaaugcacagacagaaggguacacauauaugggcacggagaugauggcggccuucuccuuuccugaaaugagaucccugaaacugauaaaggaaagaguacuugguggagcauugcuucggauguaggcaagcagagacugggacagcccacuacaaggugucaggaaaugacuccuugggcacuccccugcacaggacucugccaggaagcagcuaugucuacaaaugggacaucaagggcauuguccucugaaaccagcuacaacaugcugacagaaggagccuucgggacugcacggcugacucaacucucccuuucccagcgacccuuuuccuugugauaaguugcacaguggugguggucacaaaccucagggaugggacagcaguaguugccaggguggugggcacuguuugguuucccguggcagggaagcuuggcacaugagcuuuguugaauacuugucucccugggaaauuagauggcuacauggggcaccugccaacugggagucacaguguuggucucuccugguuugugugaagcagggcugaggaggacuggguggaugggcuccugcugcagccuaagggaggugcugcggcugaauagauccccagagucauacccuacuucucgggagaaagacugggagaggcugugcaaagagcuguggguauacuuggaaagccaaaucccugacaucucuggaggaccaagcuagccuggccaggcugcccaccauguacagcugugguccagaugcuaaggagagugggcguuagagugaagcccagguaggcaaucccagggcuagggaagggccaacagaggagcagggccaaaaacagggcagguaggcucucucucaggggaaaauggaaagccaaucacuuaacagcugcaaaacggcagugcacauuuccuaucaguuucuuucucuucgcaauguaaggcaacaaaugauuaaaaacucaggcgguuggacauuuccuguacugcccaccacuccccagggugguguggugauguggauaacuacaugcacaaacacgcaaguggguguguaguguuuggcuuccugaagcagaauaaagugaggccccuaggaucuaugaggugguagaccagaaguccaggcgggugugguacugggccacaggcagggaccaguuguaaggcgaggcucccaaggacacacagcagcuacacuuugguuuacagcugucacagaaacuccagggaacagcuucuucagaagucccaucuauuaaagucagaugccaacagucacuuguuggggugggcaucuccugcuuccuuccaaauaaagugcagauggucgaaggauacuggucuauccucugccaguuugagucagcauugaagaauuuuaaaaaaucuuuauaaaagaacuuccuccuggacauauauauauauauauauuuauauauucuuuuguuuuucauaaagccacaaguauagaaauuuuagacugaugucucagacuguaagcgaagaacaaacuugugagauuuagggucuaugaacucuucugagaguacaaugaaugggauuuucuucacauugaccacgaggcugaaguccaagcauuuaaggacgaaaacaauuccaucccguaacccguuugucacagccuccucacuaauaagucuccacugugucgagagccaucgauccuugucauacugcaagguggggcccgcacugagguaucguucaaggaaagccugaaagccaaggaagaacauuggugaaguuacaaggguugcugugcguuauagcuaggcuccaucuuguuuucccuagaaaauguuacccaacuaccccauaccuuagacuagaguucagccucucaugcugaaggcccacgagacccucucuguagaaggaagacuccuugggcuucggaauuuucuuuuggcaauuuacaaucagagggugaguugagggaaguggauuggcuaccacuguugauguaacaugccaccugaagacacgggcaccucucccucccugcuaaagccaagaauccccgagggcaggcugagugccuggaacagagacguagucagugaauccugggcagacagacaaggacaaccgcacagacaaaacugcauggcucuaccaccugcugguugugugaccuugcucagucauuugcccgguucucucaaccucgcccacugagcugccaagaggugcacaaagcacucccaguaggcacacuguggguguugucugucaugcagaacugaugcauguguggcuagggcuccguauggccagacccacguccccucuccugagugcuugcuccagggacacgacaccaagcagacugaaguucucugauuccacuacaucuucaugugccaucccuccugcugagagcugucccagaaaucccuccuagaccuucacaucuuacacuaucccucagauggaucaacguguucuuuugccaaagcuccugaaaccccuggcgaugacgucaugccauaguucacuuccugaacucugcugacuugcugucuccuccccucgaggcuucaaacuuguagaagauaagaacuacgucaacccugucuuccacuuuuuaaaguaugacuuucuaaugugccuggcauggaauuaaauacauacaucaguuugguugggagaaagaaugaacugacaauauaaauugaaaaauacuggcauguagccaucugguccuaggccaaggugaggaccuuuuuggguuucaagcaauccucuuucauaacuccuccacucugccgggcagugcaagcagcuguagccauggugauaggcacacaagaaagcgcugcugugcuccagugaaaucggagucacagaaacagccaaccccuggcuuugaccagugaaacuuaauucaaaggugcaccaacagacaagugguuaggcaaaucuacauaucugguggaaucgggagcagcuauucacagugaaagcugcgugagucagaucugaguguauggaaugaaugauccaagaaaccuugagugaagaaagcaggcuuccaaaacgcaggcgugucuaguauuaaagcaucucugccuuaaaagcuagacucagacucagcuaagagaacacacgucagcccgaacuggaaggaguggggggugggggcagagugcgguuuuguugauaguguggggguucuaauuacuuuguguucucucugucucugucucucucucugaguuugugugugugcacgccuaugcaugccauggcaugugugugcuggaaaacaguuucccgagucaguucucuccuuccagcauguaguucuggggccugaacucaggcuuggcagcaagcaccuuuauccaaagagccgucucaccagcuccaguuucgguuuugguuuuguucuuguuugauugguuguuuuuuuguuuguuuuuguuuuguuucugagaaaguuucugauagguagcacaggcuggaccagaauucacuacauagcacaggguggucuugaauccauaagccuucugccuuggccucccaagcagugugauuacggugauaaucuaccacagcuggcugaaaacauaauuuucuacauuggacuuuucuuuuuuaaauaaaaauccaagaaagcauacauuuaaaaaaugaaacgggaauauaucagacaacuuuaagaaacccuggagauaggaaaccagcggucccuucuccuugacagaagcuauuccucugcacaaggggacaauaguuuucuauuugcaaccuguuguauguggacuuuuguaacaaaauauucaaguguucacccacauugcaacagaugauauaccacagcaugcuagacacucuugcuuuuguaaacgauuuccaguuugaaguuacacagaauaauauucugggggugggcaaccuaccuuuaauguagaguuguacauacagauacuaauugaaaagcugauucuaggaugccccuuauauacuauaaucugauguucaagucucucauauaaacgggcucaccguuugcauguacccugcaguuacccguguacuuuagaaugcuuaaucucuacauggcuugcagcaccuacuccacugugaugcuaaguagcugcuacacuguguuguuuaguggacagugacaggaacguguguacaugcucaggguggcagggaagcacgaacaugcacuuaguaugacaggagugcauguguaugcacucagugcagagauacauguuuccauccauggcuagccgacuccacagaugggucccgagcugacuacggacacagcugugcuggauauuuuccugggugggagacgacugaaucaaagaaaugaaaagccuuacaguuuaucauggcuauuucugcauggcuuucccaagcugguaguacuugugagaaguguaagaguaagauguccuuaugaugaaaggugauuggaugucacuugugcacgaaugccaaggucauccaugcuuccaugagacuuacaugcuuauagccucucuuaucaucaucccucacacaacaacucugucaggcagcuaucccugcuucauacgggaggaaucauuauagaaaaacuugugcacagcuacaaaccaacugaauggaugggcgagaauccgaacccaccaugauacccacugugcccacccuuucucuuuuugccccaguccucuauuuacacugcugaugacugcaacaucuaucccuuacaguguacuaaagccacgauccaaaaacaaagucuacaacauccaaaaugguggcaucguuucugccaaaaaucaacagcuguuuagucagacuuuuaucaaaugauagguaugacuuuaucacaugaauuaacaugagguaugaagaacauccucaauucacugguuaggaaacugaggcacaguaccagaagcuaauuguccaagguuguacagcaagacaguugguggagggcccagguuaaaaugggucaguuuagcauguacucagcauguacauacuuuccugucacacugaucauguacacaugcuucacugucacacugaguguguacauacacuuuccugucauacuaagcguguacacauuuuccugaccacccucaccacuacacuguacugguuccaggugggauuuuuuuccucuguuauagugcuacauccacuccaguaguaauaagcgacaggccccgaaaaccugggcacuguccugaggcgaaaaguucauggaaacguagucuccuggaaucguggcauccuguauauagaaugcuccaauguccuugcuuuaguugguaaacagauccgugugcuuuuaauauugcuuuauuacaagugcuccuaaggauugauacuuugacaaauagcuaaguuagauucuaggcaguccuugauccgacccugggcauggauagcuaagucacugcccuacacaggaauuuaccuuuaucuaggaagaaggaaguuugugaucuaaggaggaaccagaguagacacuuagaacuauagauagcugaguuacacccauacacaaguauuuacaauggccuagggggaagcuggacuauacaauagacuagaguaggaacuauggcaagggcacgaagcccuugacccuggcuucuaagauuaaguggaccuuagguggagcuguuuuugaucccaguuguuaacacugaguuuuaccccaguugguuccugucaguccuucuguguuugcauuccucuguuuuguguaagaauccaguaaccucuuuguaccuagccagugugucacccaacuucccuauuuucuucuguauaaaaaguuugaugcucgauuugacaaauuacauucagauucuacacaaucucaugugucgcuucuguuugucauucaccaacuccuuguccaccugcaaccagagacccguuccacgcagauaggagacccaaaaagggggauagucugcagcauuauagaaucuagaggccuucaaaacauguacuucaaaaaauaauuguuccgggcuagggagccggcucagggcuacagugcuugcuguacaaguguggggaucuauguucagauucuuaggacccccacguacagugcuggaaaggaagagagggaggauccuagggccucacuagccagccagucuagcagaaucacugaguucuauguucagugagagacccuguguuaaaaaaauaagaugaugggccagagagacggcucauuaguuaaagagccuuuauugcucuuccagaagacccaaguucaguuccuacuggccauauuaggagacuuacaaucacuuguaacucuaguuccaggagaaugucaucuucuagccuuugcaagggacauccaaacaugaaagaugcucacacagaaacacacaaguacauagauaucaaaaucaaaaguaagucuuaaauaacguggugagcaacaguggagacaugggaugucaugugaccggccaaacccagggacauuucugccccagccccgaccuagcagcgcaccuugggggucaugcuguuggugaugcagaaggccaggugcugcaggauacucuccaugcugugguagugcugcugccguguggugcgcagguacuucugcagugcccuggccauggaggggaagauggccugggcugccucucugggguccaucaccucuccgggagacuucugcugcuccucagccuggagacgcuggauauggaugaaggcuuccuccacagccacuaccagucuggaaggagauucgggacagucagcaaggcagcgcccacugcagggucuggggacagucccauaagaugcagagggccuuuauugacugaagcacccuggccuaccaccaacuuccccaaggcucugucauacuguaucccucuaggagauggaaagagccugggagaagagaagcaacagcagaaaugagaugggagugggugggugguaucgcugggccucccaguucugccaauaaugagcucagaaagcucacuuuaaccugugcuuugauuucuucaauaaaaggugucuccugagaagcucugcccgagccugacauauacagaagcagaugcuugcagccaagcauugaacugaugaucacaggguccccaauggaggaguuagagaaaggacugaaggaacugaagagguuugcaaccacauagcaagaacaauaauaucaaccagccagaucccccucccccuccagagcucccagggacuaaaccaccaaccaaggaguacacauggagggacccguggcuucagcuguguauguagcagaggauggccuuguuaugcaucaaugggaggagaggcccuugguccuaugaaagcucaaugccccaguguaaaggaaugcaagggcagggaggugggagugggugggugggugggggcacacccucauagaaguaggaggagggggaagggauagggggcuucugaguugggggaaucaggaaaggggauagcauuugaaauguaaauaaauaaaauauccaauuuuuuaaaaagcgaaauaaagacuucuguucacacuccaucgggaaagcgaaagcgagcgugcagacacagcugcuaaagagccagagcuuggguagcuuuaguuggcagagggcuugcccaguaccacagagaccugggacaaauccccagcaccucaugugguggcacacgcuccugauccagcacucagcagguggaggccacacgagaagccaagcugacaagauggcucagggcaaaggugcuugcagccaagccucacaacccgaauuugaccccccagaacucgugugagagaagacaaagaaccaauccccaaaagccaugcucuccauauauucacuguggcauauguacaggcacacauacauguacaugcacacauacauguacacacauguacacauguacauacacacacacacacacacauagauguuuaaaaagguuuuaaaaaagaaguucaauaucauccucagcuauacagagaguuuaaggccugguuaggcuacaaaaaaagaaagaaagaagagaaaagacaagaaaagagaagaaaaggaaagaaaaagaaaagaaaagcaagcaagcagagcuuuaguccccuuguuccacuuaccccuccccccagccccccagcaacucaggaaggggaagaaugaggugacaggcuuaagggaagccaccuuugucaccuuccauucacaugggaaauggugugggugggucuugcccccuccaagggcagccacagaugcccccuggaaaucugcucugaaugcagauucccaggcccaggcuuaggcccacagaccacgugguaagccuuguaagugggcccaggaccugugauggguguuuagagguaugucugguggugauuacacacaaagucugagaaacgugagaguaacguggucugaaaacagucauccagggcaugcguacaaacagaaaauuaauucuggaaguuaaaaaaaauuuuuuuuuuuaaguaagaauaaaauguucagcgggaggagggcccaggcgugcaagggucacagaccuugcucuccgcuucuucacccugcguucguguucggccucuucauaauacaacucguuguggcuggagucucugcgccgagcugcugcagcaaucauggcucgggacugaccaguggcguuauuacuaggcccuuugaugaaaggagaaagguagauagcuuuaacgguaaacgccaggaaaugggaccgagaagcagcaccagggucuguggucugcuaguuagcgcccacccacgccccuacggagcaccccuggcugggccugcgcaguacuccacgcucauggcagccaggagaucuaaccccagugugauggggaaauggaaaaagaacucugaaggggcugccaacugcucaccccugaaaacgccggccaagaacaacacccgccggagcgugccgaagaggucacuuaccaucugcuacacaaaguuucaguuuggccauaagggcagcugggacaucgcauacagcggacaaugagagagagugggcaggaugggagaacaaggacagacagagaaaagagaagucaagggacacugacagugaccacacacaggaacacaagcuaagccgagugcuaucucccccaacaccaaagcccagcaaccgcaauacgccccgccccaucugugaaucgaccuacaagucccguaucacccugagcaugacccaacuuagcuuaucacaaagacacagccaggaccuaaugcuuucuucugggugccuuagagaacuaaguuucccaaucaagggugaggcuuaccagucauaccccucacauagccaaauuuaaaaaaaaaaaaaauauuugaacacuaauaccaaaaacugauaccuauguaaaccagaugucuuacugacaacaugaaucucucugggagucugcaaagcucuugucuuagcccaggugcccagcaagacguaagagggaguccuguuucucacacuuaagcaucugacacccugaaugaaacuggccucugacuuggugagucugccuccagcuucugguugccauuccuggccaggacugagagacuagagaggagcucccagauagcugacucucuaggcugaauacguuucuaggccaggguggaguauucuaggccgaaagcccugagagcaucgcagucuuuugguaaacagcucagacuuugaaaaacauuccuuuccgaggacuuucaaucuaaaguguucccagcaggaggcaggaaacacagcuacaguuuccaauaccaaaaucuccaaguggaugaacuugauauauauauacacauauauagacuguaacugacauucccccggaaaaaaauguuugucuacauuuaaacuaaaaauauaaauuguucuaaagugagaaaagaccguaaggcaagcacagaauacaggguugaagcaaacguacuaugagguuuaagccacagagccaccuaacugugcgcccccccccccaaacgguuucaagcacauaccaucuacauuguagacuuucaggccagccaugugcuuggcugcucggaauuuggaugcuguuaggagguucggguuauagauggugaaguccuuguaguaauuuuccagaaccaccaaggcugcucgcuggaugcuguaaaaugagggcaaaaaugaaugcgggguuuucaccggaauucaguggggcugaaaugagaagucuuucugagucaggucaauuguaagucaagguagcccucccaggaaagucugcuggcuccuacacuccccauggcucccacuauggcggcuuccucuccuuucccaggcucuggcauuccccauaucccauucagccagaagcugaaagaggagagaauuacaagcuguaacugagauuuagguuugggguacauaaagcuuuuccuguuuauccuuaauuuaccaaaaaaaagggaaggaaguugagaagcucgcccccccccaaaaaaaagguaggaacuuugaugaugcucugagacccucauucaguaauugguuacacacacacacacauacacacacacacacacacacacacacacacacacacauacacacacagagagagagagagagagagagagagagagagagagagagagagagagagagagagaggcggagauuugccccaggucuaaggaacuggucucccauguuacagcaauguccucccuauggggcagaguccuuuaaaugaggcuucaguuaaacgcuaagauauucugggucuuaagauccucagaagcuccugcccuucaaguguccuggacacucagcagauaauagcuccaagcuaccauuuuggagcucaggugauaacacacauaucccagaagcaugcugggagcugaacagaacacugcaggaucccugcuguuucagagauccaccagcuguaacagggaggggcuuucacucaucuccucccuuuugaccuucacgaucacuccagggaagaaaacaaagguacagaaacccacaagccacacaauggcauggcaugccuuagagucuggcuagaauucugggguggauuaacaaccuagaugcuggcccuucacccugcgcuguguguccugacaucugcagcucccgaagcuguucgccaaacacgcugcacuaaauaccacagcucuguuuuaucuugcccuucugugucucuuucccagcgcucugcuaagauaaugggcuuauaaggauuauuuacaauggccugaaugccaggacagggacugccuuggauuccuggagggcuaugcggcaucccagggcucucuacccccuacugacugagcaacccuuagccagaccgcugaagccccgacuacccccacuccaagacucccuuugcgcuccgcuuuaagaauugaacacaggacugaggaugagucuccaauggcagaguauucaccucugcacuauguaggaaccgagcagucauuaggucagcauggagugcaagacuaaggcgguccuugaggugaagggcuucauuuugaucuuacuguuguucggaguucugcccauuguguuuucaauuuccuccuccuccucugcuaugaccuuccccaaagaggaacaaguguuccuucacuuccaaugcauccaaaaguguacccgucccuaucacacacaugcacccuugcacauugcuauguuugaaaacccuaaggaugaaaauaagcuugguuauacacagacacacugguucaaacuaguucaucccgugcuuuuauaccagcagaagaauuucucuaggugcucagauuagaauauuaaaaaaaaaaaaaaaaaguucgucaccaaaaguuaagaacugguagggagaaauugagagauggcuuagccauuaagcauuggcugcucuuguagaagcucagguucaguucccagcaccuauauggcuuauaaccacauauaacaggggaugcaauauacuuuucuggcuucuguggucugcaugaguguggugcacacaaacucugcagguauauacacauuauaaauaagcaaguaaauaaaucccccuuuaaaaaaguccagaguuuaaagguaguuucggaaguuagccucaggcccaccuccaaagcaagccuuguggugacugcuggguuuuguuuuucauccaggucacaaggaggagcccagagaauuccaucggcucaguccagugccuucaucccacaugugccaucucuauaagugccuucuguccuugucucccucuucagagcuccaacccugccaccuuagcauggccuaagacacgguugagguaaggcccgcagcugccaauguuggagcaaaacucuaugcauccccuaagaacuucccacagauagggcugaugcccaaggacagagccccggggcuucaugcagggccucaaccuugccaaggccagagaagcccaucucccaagaagcacagaagagaagagcaggcauccugcgccuucuccaaccccaucaucgcacagagcuccagcgugacucagagccaggcacgguccuggccggaugcccaggcugacaagcuaaugcaggagcugaaguacucgcgccaaguuuauaaaugccuccaagagcugugcacacucucgccuacagagaaccauuugucuggcacucagcacaucuaacaauacgagggaaggagacuuuccacagaacuaagacaacacacaaccaaugugcccaacuuuaaaagguugcagucguuugagcuaaaauccaacaucacagugcuucaucuuuuuuacagagcaaacuauguacugcaugccugaagucuugccaagauacaggauggugauuccuuguguucauggcugagcugugcuuuguacauaacagccauaagucacgggugcaaacagcaggcagacguucccagugcccauguucugcuccaggcuacaggaacaaucuaagcacucagaacucccugguugaugucauuuuccacauucucccuugcucuuagcaagcaaagucauuucagggguuuaggugcaggcuaagucauagacccacaagcccaggacuuacagugcaucccuuccuccagccaguguccgugcucagacaccuuccuugccuuggauccucuguauccuccaacugugguaccacacaggccucuaucaguaagccuuucacacucccuagacccuaaagucugucccuacacucagagcacccagcauaacacagaccaguagugucuccuacaaggaguuagauaugcaaccccugccucuuuaacuucuuacacaagucccucucacacaagcaaggccuccuguauuuccuccauauguaacacuuguuggcucaaauugucuguuuauaaaaccuuaggauucccauagguuuaacauuaagaucuuaagguuuaagacuaagaagaauuucaugaagccauuagaggcaaaggcggggggggggggggggcugagagaugguugaaagcaaaucuuuaaacucauccugauuccuagacaagaucaucucugaggaaagacaggggcaaggaaagucaaacuggcggggagcuuggcaucauaccagcacuggagccagagaggagaggcagugagcaggccagccaccuucacgcaggaguccugggugcaggcuguggagacaagcccaucauggucccagaagugugaaaugaaagccaucuccucguucuccuccaaagccaauaaucaaacaaaucauaauucaacuauuccgaucucccacuuuaugaaacaauugauaguacuucauacccccuagagaacuccagccucucuggagagagagagagagagagagagagagagagagagagagagagagagaauaugaaucauuuuaucuuaaauuauucacuuuuucaaauuucauucuuuuuuuuuuuucuugaauaggaugggacuacuaauccagaaugccuggcacugccaugguacgugggcuccaaacauguauguauaagguacaucacugagagcugaaugaaaugaaccugucaggucaguguaguuagaaguuccagugagacacccugagguucaacucuauggggugcuggcuaaggcuggcaucaguuucugagagcugucucugaagcaccauggcuagugggcaaauucuggacuuugacuuucugagaguucacuuuaaccaacauuuaggccggggaacauguuggugauuggggcguuugccuucuaucuuccccauuuugaauuguuugguugguuuaggcguggcaggauuuuauaagguaauauaauuuaaagggcccagccuaaggcacaagccuugugacugauaccaccauggccauagguuucuauguccgcaugugugcuggggaggcugaucugcccccugugugcaccugugccaaucucucuccccaagagggacugacugccuuugaaauggagccaaggcagauccuuccacauagcuuucccuggagauaggaaccauaaggaccauaagguuagagcauuccuugacaacucucagccuccugacaauccaauccacuuauugggagguggccaugacucacaaguggagaaagccuuggccuaagaagcagaaagucuggauuccagagcugauccugccauucuguuacuuucuagagucuuacuuccucauggccugugauggcaagagaaaaaucaauggccuucugcgguuguucagaacauccgcugaaaucucaccagugauuauauuuguaaaccauaaggcauuauucaaaacugccucauauuauugauaauggccccaagcauuuuauaauagggaaugcgguucauugguucaugccauuccugggcauaaaagcaugcucaauauucauuuauacugaauaacuuauuauguuuugucucuuuaaugcuccccacaaacacuacguauuaaaugcucaguugucagccugaggaacucuggggaaguagugaagcccugagaaggucgaaccucgcagaaggaagucaggucuccagggggacgcucuugaaggggacucugggaucgccugucggcucuuuuugcuuccuggcugccauguuggacagcuuuguuggacuuuuguuccccaccacauggcucuaccuugcugcgagcucaaaguacuggggcugagugaguguauguaacacaaacgaacacaauugaaauugugagcccaacuaauuuuucuuagaaauuggucaucucagguacuuugcuucagcaauagaaagcugaccgacacacgcccagaauucuagaaaacaaagugaucucgguguucugccagaaucucaagaaucaaagaaagccgaauccacuccuuugagaguaccccagccucugaaaagaucacucucccacuacgcagaauacucuuuaacuucugcuucuaguccuuacugcuuccuccggagacacggaguacuuaugaaaacaucucauacuuggaggaaacaccuuggccauaaaccaucucucuuuuaaccccucuagguugcagaaagagggacugaagucuauaaaaguaugcacucucacacacauacaugugcaccucuacacacauuccuuuguuuacuguucauuuucucuccccuugauugugcuuucuacaaccaaaccuguauauaugacugaacucagaaauuagcacuggucuucaggauguauccaggagaaagcccuuauauccucugcuccucuccaaggggagaaagcauggccaaacugguaagacccucuuaaguuucagccuuuuccaauauaaacuggauccauaccacucuaucaacaaaacagcuuucuccaugagucagaaaugugagcauguuucguacauguaacugccccacaucagugucaggacauuauugcaauuaccuuggcaugugcugacagaugaagcacuaaacaguuucucaucacaauaaaaucugggaagacuuccguguagaguauauaaucaccauccuuugagccaaccacacugacguccagaaaagguucagaagaggaugaauaaccagcugccccacccccaucacgacaacugcaaacacugaacaccugugacuuuccagacgcugagcuacaagcuggacuuauaaaaggcuguccacuccuccaauagguggugacaaccacccaaaggaugggaaugcuuaaccgauaagacagggguggaggcaaacauagugaaggggagggaaggggaggugaugaggagaggaugauggggguuuuaacugaggucuacacagcagaaaaugcuaagugucugggcugagucuuaacaggucacuguuggcuccauucuguggacucugggcuccaaaaauuccaaguggagcgaauagcgcgagcagaaauggguguuacgcacuguucugaaauauccacagcgcgggagcagaaucaguguucaucccuggagagaggagagcuuguguauuguaugagcaggucaccugucaacuaaaaagccugugaccuauagcuuaggcaggaaauacgagguggaacauccgggaggcagaaagaaucaugggagugucccaggagggagauccaccaggaagaugugacuagcagaugccugauaccugagcauguguagccagccauggggcagaauauagguuaaaauaaauagguuauuuuagugaugaucuaauaagaaaaaagccuagcaauauggcaaaguuauucauaaauauauuuagagucugggucuuauuucugggagcaugagacuggaaggaagaccugggccaaacuucuagaaaagccuuucuuccuuagggugcuuucguuaggugucugacagcagcaaccagguaagcaacuaauacaaccaucaaugccuuccguucagccaacugugaauucuccccggcaguaucagugagagccaagucacucugcaugcguggacaucacugucccagaccaggagcaagauacaguggggccacaugcagcaguauuugugugagucccagagaaacacacauaguuaggggagcacccugcccccaagugcugcugccucagucaggcacaaaacauguuuacaucuccagaccuucugccuuuuaauuaagauguuugcacuugggaagguagcuugaucaaguccuauacagauaacagggaacaaacaaccuuggaguucaagagaacagaaggggcagaaacugggguuggcuuaaguuuacuaacccaggagacagggugaacuuccuaggacaaagcaucuugugacacauuucugguacucggacagccugugauccugaaccacggggcacaccaccacccgaggagggaagcagaucaguuguucuggcuggcugcugaggcugccaaaagcgcuaguccaucacugccuggauucacuggugauccaugcccggcagcucuaaaucagacucacaguguauccuuaucaguagugcaggaagagugagcagauggaaaaccagggacccugauggcagaccuccaagacagaacaggacugagucaccauggaagggucuccaaagugcaggcucggggacaccuaugcucuuacuguccccauuuuagguuuauagugaaagugaagcccugagagacaccuaguuucauacugugaguguaaccacaguaagagaaaccugcuucuggucuuaggagaaaaacaggacaaagccgccaugggugugauacucccuggccauuauucaucauccugugcagggccccgagugugcugaugguacugacagacauucuccuucugagucugaugagucacagccagagccaggcauacaggagcccucucccacuggguacccaagagaccuauugcuauaggcaaaggccauggcccugccacuagcuccccagagggcugcagcucugcuucaggcuguaguacagauccccaccuuacugucaccucccuguacugucaauucaaccucgcaacagucccuauccaggaacuggccuuucuuccuuucacacacugccauggugaaucgcacuaagauaaacacuagagaccuaaggaucaaagaggugccugccuaguauguuugaaagcaucucucuagacagaggcuaagaaggccugcagacacacacacccgagaggcucugcuggccuucucuucccugccucaccuuccucgacgucagcaccgcuagcuuugggaagaugggaacguagacgauaagucugggauccagagguuaacagguacccaaugggaucucugaucacaaagacagggcgggcaaagcuauaccuggaacagaucugaaugccagccaaugagacagaaggauuccccagucaccacuucccgcuugucagugccgugacagcaaaaucacacccguauuuauggacgggagcuggagugugggaccaacccacauaaacccuugagggaaaggcucaccacuuguucuggaagcauagcuguuucucuuuaggacagcuaccuucaccaacaggguccucgguauuuagacuaacccugccccgaggaagguucucuauucagcgucgcccccaaguaagcugucuauacuagcguggguuccagguaggcuguucauuccagcaaagaccuaagggaaagaccagaauggcuuccauacaaacaugguccccaggaaggccuuccacaucagcguggcuccugggaaagcauacacaagcacggcccuuaggaggcacucccaacauucacacacacacacacacacacacacacacacacacacacacacacacacacacacaaacacacacacgcacucccaacauucacacagacacacacacacacacacacacacacacacacacacacacgcgcgcgcacgcgcacgcgcacgcgcacacacaugcacgccaagggaguggaaagcaccuucccuuccauagcgcgcuauacccugugagaggugaauccucuggccucagcaugaggcugcaggcggacgccauaagaacagcuggauaaacacagugcuucaauguccagaaacuuacacucucauuaaagccacuuuuaagagguaccacagcagcaaaccacaaacggcagcucccgagcuugcccugaaauucuccuucugccugaauaaacccuucacccucuagucuuaagcuugcauucauuuuuauccacugcuuuuuaacggagugggcacggggacuguuaaaauaccguuauuggaaaguaguuacaaaugaaaacacccauuucuaaaaauaacaguuuauauaugaaaccacgauaguaauagcaugaaccaaaaacuccaguaagcauuuaagaacguuccucggugccacggcccauggcucugggccuuccacagccucccaagacccuugguguuaguuuccagugugggaggggaggccugggccaguccuacagcugagcuagauuugcagccugaagaccagcuuagauacuacuggagucagagucagggacuuaagacuucccagaugcuggaguaagcuaacuguugggagacuccucuguccuuguuuuaauuaaaaaaacauagacuaaccaggggaagaaaaucccauacucaugccuagagaugugugggugagccacccagacgacaagaccagcccuguuucauuaggggcaacaugugcuuacucaccccacagauuccuggucuuuaggguaaaaauugcuaguacugauaauaucccuaucuugacuugggcuaugacaacauguacgagucuggguagauuacacaacauaaauuguucucucgcaguuccgagagccgaaaguccaagaguaaagccaauuugguucuuaggagaacuccuauucugguuuucagaugacugccuuggcagugucucacacggucuguguacgugugcacacgaagaguaggcuaucuggggucugggugcaaggacacuaauccuaucggacuagauucguagccuaugacuuccacuaagcccaacuauuuccuuagcagccuaucuccaaacugggaugagggcgucaccauguauguggaagaaggaacauaaaaaugucuucucaacaaagcuguucagcaacuguguauaaucaaucaugcauuccuaugguuuagaaagcaaucccggggucauuucuuuucaagcagagaagguucucugguuagcuaccaacccugugaagaagggguucauguucaaugucaauuuauaagacgcucauagucuuacugaaugaagaauuaaaacaccgccaacaacaguuaaaacccacagugcugugaguugugugggccuuuguggguuccuuucuguugagguuuaguuuauugcuauguauuuauacugccccccaccccaccccaccccaagaucuaguuguggccaaugaagagauccucacauacucaagaaguguuauguaaccuuacuccuuaaucuaaaacuauuggcugaauaaagaugccuacagcccauagcugggcagaagagggguuggggucugagacagagauuacuaggaagaagaggagagaggagaggaagaaaaaagauaccaugagguagguggcucguaagcacguggccaugagggccugcaugguagaguaggagggucccaggcagaacguggcaaguuauauccugggguuauugacugggaagcagacaaaauagcauagagggaugauauuugugcuuuuaagguuuauuauaaaaauaacgguuuugagucuuugggggaacuaaaagaucuaagguggggcagaaacccccaacuuccacccccaauauuuaccacaacacuuuucuucuuccuuuggcugaugaucagcaagguauuaauauuccuguacaacccuagaacagcacucuguccccauuuguaacauauuucugguccuuuaagauauagacauuaaauaucagaacuauauguaacguaaagguaagcagacuagggcugaggagucugagguggagaugcugacagggaucuaggacagugguucucagucuuccuaaugcuguaaauucuuuaauacguuccucacgugguacugacccccagccauaacaguauuuuguugcuacuuuauaaccguaauuuugugguuaugagucauaauauaaacaucugagaugcaagauaucugacaugugaccccggugaaagggucauuugacccucaaggguuugagacccacagguugagaaucacugaucgagaagauccuaagauauagcccuauaagagauuaagucagccuccgagcauaccuaugagagaugaccuagauugaguucauuagaagugggaagauucacuguaacugugggcggugccauccccugggcugggguucugggcugaauaaagaggagaaaauagcugagcuccagccuucaucacucucugccuccuaaccggggauacaaugugaccaucuauaucaaguuccugcugcugccaugauuuucucuccaugacugacgacaugcucaaacugugagucaacauacacucuucaaaucugggcuugcuuuagucaagaaugaacacagcagaaguguugcugggcuggcucucagccugagcucugcggggccugagaacuucuucuugagcauccuucgaagccucaagcugccccugacaucuagauacugaugcaggagcaacgaguccaugugggagauggagaguaucucaggagaugcaaagaaggaccaaagcugagucaggcuggcucaccaugugugcauaauuacacaaggacucaaguaggcuuagagaagacccacccaguagagccuaacccaugcugcagaaccauucgauauaaaaugaugguuguuuuaagcuacuguguuuuaggcuagauauuacacagcacuagguuugaaggagggaaaguagagaacguaggaacgguuuggucagagagucucaaagccacugcugcagacccaaggaccagccuugggaaacuggucaguuaagaacuggugggucuaagggaccagagagaauaagccagccauugcugccaccugccaccugccuccuguccacccagcuguaaagaaagagccggaugaauauaacaucaugacaucagcugguaccugguaaacguggacauaaacccucuguuaggggccgguacaaugugagguuaagaucacucugagaccagaccaucagggcucaagccaugucucucacaguuacaaaugccuuauagaacuuccugaauucucugugccucuguuuccucaucaaccagcgaagaagacagugcccaccccacaugacucuccugaagacugaguucuguguucaaagcaagacagcaccugaccccugcugggagccagcuacuguguagcuguucacugucagcuacaggagugucuguuccaauaguuacugaguuuugcuucuaagauuucaaaucacagaaaauacugcaguuauuaaaagucauucugagaucuguuuuccauauucaucuggguuucuccccucacacaggaaguuaaaaaauaaauuauauuucuaguaaaguuaaagaaaauuuagcaaaucacugagaaaaccugacaagugggaugugcaugggcugagaccccacccccacccggagaaccauggagaacagaggugggcaaugaacugcaccgugcuaccugcgaaccugcaccugcuacugcgaacaggucccuuaaccuguccucaacuggaagagauguuagcuguugucccaccugcccugacccccagaggugggguaaauuaaguccaaauauaaaaagcccacguaacaccuaaggcaucaguuaagagcuaggucauaucuuacaucuauuuauggaauuucacagucugcaacaauacucucuuccauuucugaagguuuucaaauaaaccccuaaugaucccugcucacgaggaaagccacagcaagggccuuuuacaagugcuaacaagaagcccauuuucuuuaugaaccuaaagaguaggcauucuuuugaaaacucucaaaaauagcucagaccauucaggaaaaccuccuuugaaaaugagaagaaagaccucuccagcacuccacaccuaagcgcaauaggucacucugcagcgaaggcuuugcauaaaggggaggcagaagggccugggguucugguugggucugcugacgaccugcuauucugaugucuggggcuugcuuuguccuuccugcuccccccuuccuccuguuuuaacaauuuauaaaagggcuuagaagucauauuucugccccacugguucuucccaccauggcugggcuugggccagauuuagcccauggagcagcaggugaugcaaacugguugucacaggucaccuagugcuguccagggagagacaggacaccuuuccuuccaccucagaauucagaaucaccuaagggucaaaccagaucacauaaaaggagggagagugaggacccagggaagaaauuucucucaaauacuccccuccaagcccguuagacaugucacuugcaguuuuccuaggaccugaggugagccuuacagaacuuccugagcagcagcgggccagcaguccgggagcagucuggcuucucccacccaguucugccccugacccacauagcaaagcugcugacagggauucuuuuccuacuuugcaggggccguugggucggccccuuccauuugcacccaggucucauguaggggugaggucaaccuguuuuugagaagagugggagcccagaagggauuguuccucccaucaaccuggacugaccuaaggugaggaagacauuacccuucucugugcaacugggacggacacuacucagaaggaagaccgggacauaaggcuacagcuaucuguccuucacagucuguggcugccacagucccaaaugcuauucaccugcuaggagaccacaggucuggcugcacagcauagaucacaacaaaaccggccucggagcugggcuguuugccaauaggcuucauagcugccgcucacuggcugacugaaacucccuaucuucuugugcccuggucuccaucucaggcuuggcagagcaacuguccacuucaaagccauaugccagcgacucuccaagugccugggauccccagaaaacccugggagauaucacuggggagggggucggguggggagggguccuucucuaguauaaagacuggggagagaguucucuaagguuccagugccccaguagcuuccuggcuuccacaauuuuacuagcaucucugggggauuagaaaccaacuuauccuucauggcacaccaauucaaagagaaacuccccugggaaucaaucauggugacagcagccuugaacacuaaagcagccugucucaggcaggacgagcugagccagaggacacagaugagaguguacgucagcaggacacuggaugagcagugggaucuacuccaagcggggcugggccacuucucuggacaguagcuagcacaaugacaaagccaguuauucuagugaccacagcgguguucucaccagcccuggcugcuuugccaugugacacaucagcuuuuacugcucaggacagugaaacuuugaagccaggcauucaaggugacuuauuuuuauauuauugugaagagauaccaugaccaaugcaauuuauggaaaaaaaaaaagcauuuaauuugcgggcuuaugguuucagagguuuagaguccauagccaugacugucauggcagagagcaugcagcugagagcuuacauuucucaggcagaggcagaaaggagagagagaugauuagaaauaauaaaugaauggaaauggauggaaaccacaaagcccacccucacugacauacucccccaacaaagccacaccuccuaauucuucucaaauaguuccaccaccuagagaccaugcauucaauacaugagccucuggggcccauucucauucaaaccaccacaguggaucaaucacccaggaaccacauggcugccaacugugaaucaugcuccaugccaggcaccaaggaugucagguggaguaagacacacuguguaucauuagggaucucaaaguauauggaggggaacagauggaagaagaagauucugcacggagggagagaugucauaacuggaucauucacucagcccaaccgcaugacauucaagggauccugaauaaagccgggcaugccugguguguuguguaaauuacuuacacccucuaccccagcucuuuauccauaacacugggaugaauaaaauuacaugagguuuuacagugauaaccagcauagaguacuuaccuucauuuauuuauaaaacaaacguuuaagaagacuuucaccuuugaguuaaccauggaauaauacacuaaaguuaugcacagauaggagguuguuuuuuguuguuguugguuauuuuuuuugguuuuucgagacaggcuguccuggaacucacuuuguagaccaggcuggccucgaacucagaaauccgccuugccucugucucccaagugcugggauuaaaggcaugugccaccacgcccagcuaccgauggaguuuuaaccuuucucauauuacacaaacacuuucaaaacauucaguccuuacauauuuguagucuguagcuggagucugacucuuuuuguuguuguuuguuuguuuguuuguuuugagacaggguuucucuguguaacccuugcuggacuguaauuuaugcuguagacaggcuggccuugaacucacagacauucgccugucucagccuagugaugcugggauuaaagguaugagucaucaacauuggcuggagcccgacucuuuauuagucacuagggugacuacauaauugacugaccaaacaggcugucugagaguggaaacaaaaaggaagagcuaacaaucccacugagguaccaggguaaacuugauacaccauuuuuaaaaauggcauuaaaguuuuaaauacugaauucaggagugugauguguacuugcuguauaaaucuauacauuucauaauguuuuugauaaaguacaucauguacuuaacuauauucacuaacccauaacaccaccccccuuuccuauuucuccucccacccugcaccuccauuucccuuuccuaaauagaucuccuauuuucaugugugugcaucauauauauauauauacauauauauauguauguauauauauacacacacauauaaauauauauguauguauacauacauaugauacauacauauguguguguguguauauauguguguguauauacauauaaaaccuaggucugcaugacagaaaauggauuaccugucuuguaggucuagcuuacuuuguuuaacaugaucacaccaauucuguccauuuuuauucuucuuuauaccuaaauaaaacucuauuacauauauauguauauauacauacauauacauauauauuauauacacacauauauauauaaauuaucaauuuuuaaaaauaauccauucaucugcuggugaacaacuaggaugauuccaaaacuuggcuauaguaaguaucugcugcaucauuuuggacagaauggaaguacuagucaccuuauccauuauccccaagccaaguucacagucaagguagguagccaucauugugucuaucuuugggaauugccauugagguagagugugaguccaguaaaacccugaacuuaucugagagucccauggaaaggcacggacaccccacagcucacccagccccuacuaacaccaagggucaagccccagucuuagcaucgcgggaaaggcacagacaccccacagcucacacugcccuuaguaacaccagagaaggguggggcuccagucuuagcaucugccucuagggcuucaucucaccccugccgacuaauaacaucugucuucuaggguuauuagucauccuuucugcuuacuccgugugcaugccccuuaccucaagugucccaagcuguagaagcgggacucuccgucgguggagcggaccaccugcagggugaacauggguugcagcugccucagcuccagcaggacgauggcaagguaguggaugaaaagcagcgcguccacaagagagacugcguauugcacgauguccuuguaauuuuggucccgagaguccaaaaugcggaccccauaaaaaagccaguaagaaaccacaaaaagaaagauaaggaccaguaacagcgcucggaacacaaacacccgcggcacauccgcucuuugcuugcggaagaaaagugcccagguuccgaugagcagaauaagcaguuugaaugauacagaaaugagaagucccucacaaauggcgccacaggguuucagcuccucccuccacaggauuugggguagcaggaugaaggcaaugggggugaggaagacaaguaguccaaggaacgaggcaacggugaggcccagauagcgcuugcaauccagccccacacuguccuccauguccuugcuaauccuggcaauguccucuugggauauacugugcucugaggugccugugauugcggugguggucucuccccaguugucauccugaugacagagaagauaacgaggaugauuuauaaaagccacaacaaaauaaaauacuucaauuagccaacuuuuuuggaaguguucauagaaucagcuuuuaauacagggacauuuuuaacuauagcuauuuucauugaaauuuucgccauauauuuuauguuugcccuuugaacccagaaaacacaaucuaaccuuucaauuuguuugggagauuucauuacuaugacaccuugucaucccucgaauugaaaaguucugggaagcccugggucuaggccuuucugcucugacauuaauagcagcuguuagacugagcugagcugacuccacuacaggagaacagccacccuuaccgcaguaaacuccgcccaugcuaaguucuaggcuuacaaagcccacauccagacacccccgccccccaguagcuccacagagcagagagcauaaaacaggaauucccagcacacagaggucaaacucacccacagcugaaaacacacuaccuaaacuucuguaugacauuuauaggacucacuucgguacagaacagcauugaggauucuuugacaucauuucucacugacuaaauaaagaaaauucaaaacucuauggccagaagagcucaaaaauucucucuaaaacauguuuucauaauaaacugagugaggguauaggacuaucaggguuauuauaucuuucacuucauuauuuucuccuuuaaugcuucuaggcaguugcugcugugggcuccuggugugaucauucaacaagagucuggugcuagacugucagaugcuuuugcuguucuggaaacuaggacuccauuucagggcacaacagagcuggggugcaccagaaaccaugugagcuccgugcauaugacuuaaccaggaaaaauaucccauauagaacaaaguguuggaaugaggacacagauggagucucagcucauagguaaagcaacagcauaggucgcucauaaccaaaccaagcacuucacacucauuuguggaucccagcgcugaaucuuuggcuuugugugcuugaucuggaguaacuguagaaucuggggagcaagagagggggccauugguggcggggaggaacaagggucuuaaagggagaguauaggaaggggaaaggggagacggaaagggguggggagaggaguuuggguaagggauaacuacuacuuuacaagcaucacccauacauauauucauauaaaagaguuuagucacccuacacaagacauaaaguuccucccagaaggcccagguuaccaaauacugcccaguacuggauguguccaccagaacucaacaguaagaccuuacugcugaagacgucacacucucugguuauaggaaauggagacaucaaguagguacugacgaggaaccucccucccugcuggccaguuuccacaguacaggggggucaucaguagucuuacucucagagaacucucugagcuacaguaaugaccagcaugggaagagaccccuaaggcugcaauaguggcacaaguguuaugaugguaaccaacugcuuucuguuggucaccuguauuuaaagccugcuccacaggaggaaacauaccuaguacuauacaucuggccaagaauccaugguuggggagcucacagaucuuagggggauacuacuaccauuauucugcuaaacagucauaauauauuucucuaccaauagguuaauguagcucuuagaccucgucagaaagguuucucuauaaaguaggcggcaacuacacagaaauucaggacuaguuagacuaaaaggaaagugagucagucacaaauggggcaucuuguuucacaccccuucuguaugagggucagggaccacugcagaggaggggaugaaagauuguaagguccagaauucagggaggacccaggaaaacagugucuuugggacacgauaggaugcugcacuccugaauucacagcagcugugucugcuugcacaaaacuaacccaguuaacaacccaguguggagugggaaagugcucaugaguccccaugugguuacugggauuugaacucaggaccuucggaagagcagucagugcucuuacccacugagccaucucgccagcccccaaauuuuuuauuuauuaaggccugagcaaugcugggaguggguaguaaggauuucaaccucgggacacagaggccaucaacuuaggaagucagaaguaucacagagcaugacaggaaugauguagacaauaguuagaagcagccaguuccuucaggcacugcugguagagguuuaagaugguuuaauaccaccagaaaaccagccugacacuuucacagugauuuagguacgcauuuaacuauacagaccagccauuugacuccuagauuuuaucaaaaguuaauggaaaaaauguucacaaaagaccuauaaaaauauucacaagagcuuaauccaucauaauuagagugugugcaccuuaaauguccacccaccagaacaaauaccaaacugcggucaguucaguggaacacuagucagcaaaaauaauaaagagugaacuguugaaucacauagaacauggauaaauaucaaaaucauccugcugaguggagaaaaacucauaugauuccaauuauauucaauucuacaacaggcaaaaccaauccacugagauggaaaucaaaacagcaguugcccugcagagguggggguggggguagggaacaacuaggaagagggaggagugguuugcgcugagaggugugggcucaucuguuaaaauuuaccaaaguauacccuugagaaccauuugguuuauguguguaaauuuaggucaaucuccuuuaaaaaguacaucgacaagagaaaacacaccacaaaagucauacaacuuggaguucacaggcuauagaaaacaguuggcuucacaguaauugucucagagaagacaaaugcuggauucuacacaugcgauugauaaaucccugcugaaguaagcauuacuaauaucauguugacauucuguuguguaauaucacugcucugacucagcugugcguccaacuuccugccagugcacugcuaacuaaaucucuguucauuuuaaggacguauguacaucuuugucuaaaaaaguagggcuauccaaaggcuucuuucaaauuugaggucuucagggguuggggagggugggaaaugcaucugaacuugaugagucucaucccuuagagucucagaagcuggggacaacaaaaguuuaauuaccaaguugacagagcugcugaaacacacaaccucccaaggcuuccucaucacaccauccugcuguaagcagcaacagcuucccaggggacucaggggacaaagaaagaaaugcuuuucacaguggguuacuagcacccccgaauacacuucuaggaggaaacugaccugugaagcuuuuaagaaugauccaguccuaagacugaccacauccaucccccauccauccauccauccauccauccaucuauccauccaucugccuuccuagaaccaaagcaagcagcgcgacgacauuagaggaauuugcucaccacugaacaaaccccacauucagugcagaagcacagcuaugagucucaguggcaucuguauccuuggagggacuguaguucagucuuccuaacugauuacaaaugccucucuguggguuccuacaggugugcauggauacaugcuuaucucuguuccuguaucuuuauagcuguguauuccuucauugcuuuguuuauaugaggcaaggcugggcauguaacauuucaggagauggagguuggggggcagugcaaacauacuucugagucuagcucacacauuuauuuaaaucaacgaggcugccaaacaguugggacucgaaggcaaucccacacaacuuucuuuuauuuuuuaaguaauaaaguguugauauuuuaaaacugauugacuccgcuugaaguccuaaugcuaauauuacuaaaacaugcaaggccuggcaaccccaaauuccuacaguccugaguggcugcaggcuggaccacaguccugaguggcugcaggcuggaccacagaagcugcuggaucuugacagaggaaauccagucuccagaucuguccagucccaaccuguguaccccaaagaccaccgcuacuaacuccaaaguuugcuggacuccuuucugccccaucuuugacucaguauuaucacagucaccagauuuccaugcuugccaucugaaugccaagcccuugauuucucucuuauaccgaguccugggcuggcucuuggagucauuguuaagcacucccugauggugcauuuuuuguuuuguuuuuguugguuuuuuuugguucagugguuuuuuuguuuuguuuuuguuuuggguuuuuuuguuuuguuuuuguugugguuuuuuuuguuuuauuuuguuuguuuuguuuuguuuugguuguuuguuguugagggaguuuccggcccucuccaguccugcuccauuuuggaauuagucuccagggacucuugccuguaacuuuucccuuuucugaccugucaucagucaagcuggcuucuuuccaacaccauucaaaggaggcuaaccaaucacagggcagaaaggaucgccccacucccuagcucuucaaggguaggacguguugugcuuagaccaacaagaaagccagggaaauagauaaacucauuaaaaugcuagaaaaacgaagauuaaaaacccaagagaacuuagugcaacaagacaggaacacgcaggcgggagcccaggcugaguggcaguuggcugacagcagcgccuuugagccuuaccugaacuuccucugcgccugugcgggcagagucauuugccagcaggggcucuccagcaggagccuggauggugacagacuuuucugacccucugccaucuuuauuccuuggugauuugugucuuucucuuguucuuucccuggggggaaauaauccaauaaucagacaccaaaacucaugccagguuaguuacucucuagcucaccccucacaccgcauccaugccuacccauccccacagccugccaggaguaagagugucuuaaauuucccaacuauuuucaaaacaaagacugccacuccuccaccaacaacggucacauuuuucagagccuuguuuuagaaagccuugcuuuaaagccuugcuuuagaaauuauuacacauuucacuguaauaauuacucaguugauuugguuaucauuugccuaaacuaauucguguuuuacuggacaaacacuauacuguaucauaucuaaacuucaaucugaaaaaaagaaagaagggaaagaaaaaaaaaucugggacaugauaucgcucuacaguuugggacgagaagagaagaaaggaaaaccaaagccgggacagagaauccuguacuugucuuucuuacaaauucaacaugaaaagccacucuguggguuuugacuguguucaaagacacccauagaaacaaagaaggugaaacaaaacauucccgggggugugcuugucccaggccaccuaagagaagcaggcucucuguacucucucuguaccagaggaacuucguggguggucuuccuccagagacagugggaggacacccugcugcugagucuuaaaacuacaaaaggcaccagccacaguggccgagcccuagaggucacaagcuggucaauaagcaguaaaggagaggggcaccaaggcagcccugcaguggccaaagccagugugucuccuuggcgaccugacaucagcuuuccccauuccuacuuguccucaugcccaagguuucccauuuugugugcaaagucagacagucagcucuccuaugugugacuuugcacagguugaugaccucaguuuuccuuuguggggaacagaaugggggccaugauuccucauacacagggagagugcgugugcucaguacagaggcguggagugaguaccaauguacagcagccaucuuuggccaauggcaaaaaauggggucugaacuuugugaaggagagugugauaucucuaucccagagagugugauguccuggagagaaggacacaaaagagccaugagcacaccauaggcccaccaccaaacccucuuccccacuacacauuuaucuccuacuaaccuacuacuuagcaacaacaaugaaccccuaaaacugcauggcagaucuauugucagacuccuaucuugggaaccucucccuaggaaaggcacuauucaaacuaggaaaggauaacuauuucaaggaacaaaggguuuguggcagacaauguuuccaugacaauaacuccauucuuagccagauaacuagacaaagauguguucugguuagcuguguauggcucccagacagguaacugggggagguggggaggggggcaguaaaauaagcagagaaucuaacuauucacccagagcuguaucaaaugaugucaaucucuccugcccugcccccuucacgcagcacuuggcugaguaugugacuucauucaauuuuaacaaauaauucugaggccaguauuacugccccauuucucagauaagaaaaacuaaggcacagagaggucaagcaccuugcaaaaguugugguaaggagcagaacaggaaccgaucccaaaucuguugccaccauuucuauucaaaaccgccaugugacauugcuuugaggaacgauuucauuuuuaaaaacuagcauauauaauuauauaagacaaugagauuuuaccaugguacuuuucauacauaaagauaauguacuuugauuauguucacccuucuucaccccucccccacuggcccccuuccuuuccuaaaucuucauaaguuggagauuucauaaggucaauauuccuagcccucaucuucaccccccuauacagucucacugcuccgaguuaggaaauaggccuucgaggucacuguuggcugugaccauggauagccuuaguuguguguuguccaaaaccagcaccccaaaggguguucucugugagcaacaguaagcagggugggagauuugagugaauuuuaggcuagguccagaacuguuaauucaccagguuccaccugcagccggcuggaugacccuggaaugauccccaccccuuccacuuccccugggaucccccauuugucacucauguuggccaccagccuagucacaugcuuaucuaaccugguucucuauugaaaacucccacaggucaaauacugugacagcaaagauucuacugaaacaaaacccuuuugcuuugugccaguuccugauuccugaacaucacaggggugaaaagcaggcggaaacuaaccaggacuaaaaauggcugcagugcucuuuccaggaucacccggcuggguucuuaaaggacccaagggcacugagaugggaacagcccacacugggcagcuuugccucucagcuccccgcguaacccugccguaagccagguaagagcaucuuguauaggacgccaaggacauuccauccuccagcaccugcccccuacacccguguucucacuucucagaccccuggugcagacaaaccaccagggcugcagagauuggguggcccugcccuccgagaaucugucugggaggaagaugacaggaaucuacauuuuuucaccagcaccccaggucaucaggaugcaggugaugcaagaguuguucaggaagacuuucccaucccauguuucuagggcggcuguggggauuccuacucagggaaguuuguguguauguaaaacgccucgugaaucacagguuaucaaaaucauggaugcucaauuagguguguagcaccauaacacacagugugucauuauuaacagaguggggcuggagagauggcucagcaguuaagagugcuuacugcucuccuagaggaucugaguucuguucccagcaccccacauccagagacuggcaaauaccuguaacuccuguuccuggguucccucggcaccugaagacacuuacacagacccauacacauaaauaaaaacaagcuuuucuuuuuaguauugcauggacauagggcaggaugcaauccugacugagaguaacccagaauaaugaggguccuaucagcgcugcaccaagagagcugcucuuguauuaccucacuguggaagggagugacugcucugggcaggucuccaagccagaccaggacuuagcagugauguccaagaacaacacugcugaucauccauccauccagugcuuucuaguuuauagaacgacaaaccucucagaggucauuugacugcagaacauaccuaaacacucaucccuguaacuguggaggcaggaacagggagagggagcuauagcucagucaguagagggcuugccuagcauugcugaagcccuggguucaaucccuaacaccacauaaaccagacauacugguacacaccugugacccuuggugacauacagaauuugaggccagcuugggauagcaaaaggaugauguaaguuuaagcgacaucuaucuguggcugcccauuauccuaggagaggguuccccaaggaugaagaugugucgaagaguguagaaauaaguaagaguccaggggagaguaaaugguuuaauaagucaauaaauggagcauuaggacacagcuaagauuuaacugccuaagcggucaggaucaccugggggcccuuuucugggaagcccuaggaaucuucgucuuuaucgcuaaaucugucuuccugcuuccucggcccacaggaguaaagauaagucuaucagugcaaagauaauucugucagugcaaagauaaguauaucugugcaccauacgcacacaugcaugagaggguggggagcgcaaguugcagcaugcaagaggcaaccgugugcgcagguaaaugcaucauuauuuagguaauuuguuagcugagcccuggagggcugcugcaaccccccaagccccagccggaaugccugcaauucccacacugucccuacuuacagucagcacuuccugggcaggccauuuccuccuguucuguugcuugucuguuucuaaauggggaaagccacccccucucccagccccccucccgcccccccuuguuacuccucccuuuccuccucucccaccacccacucacuaccuguccucccgcugaggguggaacaaacaggcucagaguccucggaaucugccacugcccgggcagcccuuuagaacaaugcauuuuauagcacauuagucacguucccuuucaaaggcggcauucucuuccgaagggcccacaagccugagucuugcagagggucuuccuggccugccaguaucugggaaccuuguuccuccccgugccucaguuucaucaccuauaaaacgggagcucccaacuccggcucugcuaggacuguugugagcacgggagagggagacucccgagaugaugcuuacugcuuccagcugcugcugacuacgggucagacgagauuggcuguagucucuacacucucucaacaaagcuaacuggacacucucuggggaccgcaggcaucagugaccucuuugucagcaaacaggauuggaaagcggccaacccucuaagacaaucagugucaucaggcacuacauuauuauuccuuucugagucggagcugugcucaaaucaccaaaagaccaagucccuuucuuucccacuccuccauuuaaacuccccacaaaucaucaagcagaguagccuucacagggcccuccugggacaagaaaugccugagaccgccagcucucaagccuguggagggcuccuucacugauggacacucuucuugcccaggcuaugcauuccacagcaccuacuuacugugaguguauacaaccucugcccccugaauucuuaugaccucugugguccucccucaaaugcaccaggaggcacaggggcuucaaagaugcaccaagagcacacacagccccacagcucaggcccccucacucugcuccacuuggaacaggcacucugcaauauucccugcucaacugcagagaagccggagccccacucagcgcuccucccgguaggcaggcgcgcugcaacguuccuugaucaauugauuaaaagccucagcuccgacucacauuugccaaguacuuuccacaagggaucaagacagaacuaagcguucugcaugucaucuuaauugaaaguuauagucucuuacaguucccauaacagcacuagagaauccauuucuggguccccaggagguccagggaagcagcaggaagcagcaaggggccuggaagugugcaagucuuggugggugugccgaugaaagaagccagagcuggcuccauucagaauucugcaagcuauccuuccugcucagccccagccccagaggaaacccgaauuccuauucauaccaucuggaagaggaaguccaacaccgcaguaagccagcugcuuuuucuaguuaggucuaaaaagcagguauuugaaaacagcuguuucugguauuuuauaauaaaucugucaaguucgucuacagaucgaaaucugugauuauuuuuaaaaccagggcucucucggaaucggggcuguagaaugucacuauaggcuuuccccucccccgcucuugaagcacccacacccagagccuucuguccucacugaagauccagcgaagcacacaagcaauucagggauguuuagaaaauaaagugaaguuuccaaaagaaccagacagaagcccacuuccuuaaaacaauggcauuaaaacacuuccuuaaaacaagagcguuaucuuuaaagagcuuuccuuuacccuuuuauuccacucacauuuuugucuuaaagacaugggucucacuguguagcccugccugccuggucuggaacuuucuacuugcuaugcagcccaggcuggccuccaacucacaaaggucugcuugcucugcccccuaagugcucagauuaaaggugccugucccuuauggcguucauguuuaaaaaaguuacaaaguacaaauugguacagaaaacuaaaguuuaagugucuaacuucccauccaucagucaucacugccaagagccccuuccugaagaugccacaccuggcagcuugggaaacacuugcgggcuucuuuccagguguggccacccacacagagcccaugaaacccacaucuuauucugagaucucacucuggguacaguuacuuauauggugaucugcucacugagagaagcaaacaucaggacagccaccacuuccacacagcacacagcuguggccacagcugggccucugagcuggggucagcugucaccuuugaacaaaggugcugaaauaccaagacugggaauagcauuaacacagcuacaagagaggggccuccucccgggacugaguuaaucauuucccauguagauuucauucaacccuuacccguucuagaaggaggaaucccuauacccacuucacagaggaggagacaccuccauuggauuccuacccugcagaguaccacccauuucaucauuuaucuguuuguccauccauuuaucucuccacucauccagcauccugccccucggaaugcacuugguccccugaacagccacccaggucucuucguucagcagaggaaggggaacuuagccccauuacucaggacaguguuuucaaauccugacucacuuggaagacuaguuaaagacaaaucagguaccaggccaagcaagcaugugccugugugcgugcacucgugcacccacgcgcaugcguagccaacgagucagcagcuucgagugaagcagcaaguuaacaccugcuuuuuaacuuucacuuacaguauugguaaagcucugagagaacagauaccuauaagaaguauuuagaaaugagaagcauuuccaaugccagggaaacuuuaauuuaaaaccaauugugagaaauuaaggccaucaacucuaauggcagcuauaaaacguaaauuggcaguauuagugacuccccaagcaugucaacugcccuuacagcuugacuucucacgcaccagugacugaaccuuccacguccucagccuuucuggugggcugguggaaaccugauucucuaacagaaagcccuuccaaccuacaggcgcuuguacacagaaggauggcaugacggaucgcuuacauacccuugccugugagauuuuuuggaauggcuugaguaguaggaauauccagaauacguggauucgguauccauagcaauggcaagcuucgucugaugaaggagcaggggcuguccuuccgcgugcugucucacccacuagcucuaaaggccuuggaggacucagagacacuacucuucaacaggacucuguaaagaggagaaaaaggagagauuaauucucaaagucaaaggguugaaagauaaaccaacaacaggcagcucuccucuggggucccuguuauagaauaugggguaagcacaaaagccaaaccuccaaaugcaucacucagccaggaacaaguguggcaggugccugagaggcagcucgcaagcuggaccccaacucagcaggaggaagaagguuugggagagaccuggacauugggacauuuauuuccugaacacagcuuucuuacccuuauggcuuuggcuguagaguaguacaccaaccccuagauaaaugucuacuucacccccaacugucgguuauagaaacaacacccaaggaaaucccuuacucagcaauuuggccaucauuuccaaaagucaauuuguuuuuuuuuuucuuagucucugagaauccaaaacuccuagaaauuuaucuucgauaauuaaaacucaacaaccaccaugauugccucgcugccuaugauaacagaagucagcagccacguaaacaccuccccccagccaaggaagaaauagcuggaggaagacaggacucagucagucaaagaaaauaccacagaucuguacaaaaugacaauuacaaagaacggagacuuuaacaagcaggauaugggacugcaggcagccaauggaacuauagaaccauugcaaugauguaauaacuuauggaagggccgggaccacaggggacaucagcaauggugauuuauuaguuacaagguccuagguucuuccccacuucccucuaauauugcucugcaauaaaaauaaauuagaagcacuuccaaguacauuccgaucgagaaagcucuacagcucuaccucuuucugaauugcucucccagggcugcuggagccucaacagggcucccacccugcaggguccuggagccuaaaacugcaaacagagccagagauaagugggaaggaaaacaaaggaauugcaaaggccacgccccugccccucacgugggaggagauucuggcucccugaccccagcuacagagaagacauuucaaacugggagcccuaacugggccugaagucucaucugcacacaguuacaccaguccagagccuagaaguaguauucuguuccuuccaaagugaagagaaaaaacguuacuaaagagacccugugccuagggguuacacgcccuguccuagaugccucaacuugugacuuaggaauuuaucuuagagcgcuaauucuucaaggaaaaacauuaucuccucacuguccauugugaucaagagcuaaaaagaugaaagguccccuaauccaaagaauaggaaggaaacaagguucagcucuacccuaauuagcacauauguaagaaacaguaauuauugaguuagguccaaaggccaccaugcacucacucauccauuucguauccaaguuucuaagcagccagaagacccugcucaggaguucuaaggcugcagagcuaugacagagagcucacugcuuuccuugguucugcugguggcugguuuccauuugauggcacuuguagcacuucuccuccagcccucagcccccuuucucccuaucagguuaucacuuaacagccuuuggccaucaagagcccaagccuagccacaggaagccuggaguccagccaagcugagccaccugugaucagccccuuccucgccuugccuucuugaaucucagucugcucacuugucaaucaggaauccaagcgccggccaccaucucccagggugaagcuauaaacagacacagacuugacucgcuuccuagcuccaggaccucagucaagcgaugcgaucucuuugaagucccaucuacaaaaugugagcaucaggagugcuuugaugacucuaugagcuggcaguggugacaguacccagcgugggcaccacaugcacuggguaaguaaaacuggguggcccuucagugguuucuaaacuccaccaucuccgugccuuucucagucaaaggaaagcuuagagagccacaggguggagggccagcaccucccuccaggccaucccacccaagucucaccugcugugggcagaauggggcugccccuuaggcugccugcucacccaccagcuguguacuggaacacggcaguuuaaucucucagagcuguggauuuuccacccaguaaaagaaaggcaagcagccugcuugggaggaagggggcgauucuaaaaacuaaacaugaaacuaagcaggcaucucucagaacauuagcuuggcuucagagccgagucuaucagucuuucuccuccucccguuucccagggcuuucaacugccacucaaugagcuuccagcacacagugcucucccuuccuuucugcucuggcuugugcuccuuucccacuggccuucuggcuggcagacaaccaaccuuaggagguacagucaggauaugggggcaaagaacgaaagaaucuucucuccuugauagccaauagcuggacucuugguugaccugcagauuccaaggcuuggcaccuucuccagaacacugacuguucuucucuaggacagucagucacacccuuacccuccuucugcaggcccuucguaccccauugcuuugccuccauaucuaaugagcagccaccagacccugcucagcgguucuagggagauggcuucaacuggggcacaccaccugcccucauuaagcuuugcugacuagcucgaucuguguguuguuccuucuccucuaguauuccuucuuccaucccuacaucaaguuaucccuuaacaaucaagacacacccccuucuucuccaucuccagggauaagcuccugagucaggaggaauggcccccucccccaaauauucugaacauaacgggaacacuuccugaaacauaaggccaaaugcucccuuuccaccuggucagcucucacccacagccacucucuuaugcccugacuugaucuuucuaauauccgcuuacaguaaugcagccaucuuguccaguagacagaccugcucugcuguuuugaacacucucuccuguucauccgugcauccuacugccaccaagcucugcuuguccuuggauccucccaguucacagcaacagaggauaaccuagagaacaucuccaggcucccucaccugcccugguccacacagagccaagaccuuccuuucaccaugguuaccaacucuggccucaucuaagaugugggggaggagucaggaaguagacuaguaaggcaggguggacuccuuccagaaagggcaugaccucaggcgagggcucccguuugaguuaaugaagacacauuauccugacgcuuaacucugugaggaugcacuuaaaagaaacuaaagcaacuccugaaggggucagaauguuucccuuuaucagcaaaggcugauaucaagaaaggaaaagaaaucaauuucccugggucgcaaacuaaugaauuguuguggaggccagaaugggguacaggcagguaggagagaacacaggcaaaccuagaacccucaaggucugucauacuggccccugacaggaccuguauguguuggguucagguagggcagcagccaggcugacguaaccuucuuguucaaauccucccaugguauccccugaacuuuaaaacacagaauccuccauuugaucauauagucuugccagcuguuccaguuccuuggggccugguucuuuccagccucaggaccugagcccagcccgguguaucugcugaggcucacucucucacgugaaccauucggcuaauuccucucaguuugaacacccuucuuuuggagaggccuggcugacccuccaguucacaccuggccgcccacugccugcauucugccuacacuuggcucuaccaagucacaugcucacuugggugauuauccagcaccaggcucugaagaggcuccuggggugcggggaccacaguccuuucugucccccuggcugcuggcaaacgagaggcaccuaauaaauaguugcugagagaaaggaaggaaagaaggaaggaaggaaggaaggaaggaaggaagaaagaaagaaagaaagaaagaaagaaagaaagaaagaaagaaagaaagaaaggaagaaaaaaagccauguaccuaucuuagggcaugaaggcaugacuucaccauagaagaaagcucacagaggguagagaaaaugaagauuuucagaacuaucuagaacaaagcaguacugcugguacaaugcuuauucaguaacagaacauauaguccagaugugcucauggaagaccagcaccauuguuucagcuagugcugaagagcauccuacuccagucuggcuggaucagaguacaccaaacuacacagccuggggaacacugcugguagagcaucuuacagggugcaauucauuucuccuuccaccuuguacuaaaacaagcugagagccagugaucgauccaaggagagucuuccccuaaagucacaucuuuccuauaaaacacacaacuccuacuugaaagaaaaacaguaauacacgcaugcacgcaugcacgcaugcacgcgcgcgcacacacacacacacacacacacacacauaugggaaaugacagguuaugauaaugaccaugguaaauguaagcuaacuuuuaugaaaaggaaguuauaaaaacaucaacagcuccauguagagcuauuaauuaaagggccucugccugggaagguagaaaguuauugcacaagggguccagagaagagcauauguggguuuacuuggugggucucagguuaggaaaaaugguacagggacgugugacaaagccugaacgugcacguguaaaucauaaagcauuauccaagucugugaugugagugaggcucugcagggcucagacaccugggacaagucaaugauccccuuccaggaacacagcgcuucaagauguacagcuacaggccacuguugaccaggagagaaaacgcccgccucauuuuaccugguuugccaaugaguucaacucccauucccagacuaacugcucuuggccugagucauuaauuaccucuggagcaucccuggcagcuggauaaggguugcugaggagcugugagugguuacugucucuaggauggguauuucuuuucaagcaaagccuuucccccuaguagauucugaagcuucagccaccgccugaugcacaccacacaucccaugguguucuaagggggaucugggaugaggguggaggcagagcagcagaggauggaggcaguuugcuucugccuccaggaggacacagaguaccagaaacagcccagccacagccaccgaaucuugucuuccucguggaaaguggcacaguuaacuggccacaguuagcucacuccacagauauggcggcgauuaagacugaagucauuugcauaaaauagcucaaucuucagaacaagucuuuaagggaggcaaaauugaaugucauggcacaguuaaggggacaaggucacacacacaagcaagugcccccauauggcuuuaaccuucagagagccauggaaaacugaaagcuauguagcaauuaccaggauuguuuguuuacuuagagaagaggcaggcaacaauagugaauuguuccaagccacacauaaccucacaaagaauccugccuuucgacuccuacucauaggcucaguagaagggagacuguguguguguguguguguguguguguguguguguguguguguuuuggggggggggucacuuuaaggagaaaggaaauuaaucucaaacagccuccagcccaggugagaccuaugauuauuaaucagcaugaugaggcccccauccaauccaaacuacaucagacgcaaugcaaggugugccuuuggguauacaucagggggauaaagaguacuuggcacacucagcacauuaauucuucaacagacgguugucauggaauuguuacuugguaaggaaacuuuucaauuuccuguaugguuucauccuauugcucaagaaauaagacaauaacaacuuuuuugagacuuggcaggcagucucaaaaauaugacacucacaaagucuuucauuuuacuuacaaaugaaguugccaccaagugacacugucagcaacugcaucccugaaaauuucacacugggaguuuuggcuauucauagugggagucgccaaccuuuagaaaugcuaaaugcuccuggauauugcuuugaaauguagaauaaaacaguuuccucccacacaucaaagccccaaccauaucacacugauuuaauucaauucuaaaaacucuaauuagugguuacauaaaauggcuaauuaugccucccugggcuccgacgguuucugccauggcacuuacagagccuaggagcuguguaaucaacacgcccacuagaaggagaaggcuaauuaguauuguugauuggugacauaacuuauaauauuuuuucagcaaaccccguaaaacguauaaacacgucagugaaaacacuagucuucacagcuaacuuuuggaauucgccuguaagggcgcgcgcacuccugaccacaguccccucaaacggguucaaacuaacgcacgcaccaaccacacaaccaugccaauaaagaccccugccaccccuccaugaacuucagaaggagcucaucuucgcgaucugggcaucacacccgguuuggagacaugaaaauugagauugcccggcuccgacucuccucuccucaucacuuagcccaccaggcuacggcuccgcccccacuccugcuuccaccaccgacgcuuuuaaauuuuuauaaagcuucacacuucucugggcgcgcugcucggggcaguucaauggcugcaggaugaaauaagguucgacuggugucuaaggcugcccgagugcggcgagguugcccaggacagggacuccuccuuuggcugggacuggcugcucgccucugcuccgccccggcgcuuuugaaaguaaacuaccugccuguugcgcuccgcgaugcgcaacuggccgcgccccccaggccucccgggcugcgguuuuguaagcgaagugagaaacacgagccagcuccguuccugugcuggaaaaccggccaguugaccccggguccuggcggggacccccaucgcguucugcccugcaaggcgcguccagccacugguugccuccgacacgccgucauucccuggccaccacccggcacgcgcacucaggggcgcacuccgaaggccagacaaggcaaagaaguccgagguagcgcaggcugccccaggacuccgagcacuggaauggagcggagagagcccggggcagggauggaaggacccgcgucucggggagcucgacccggaggaacccaggggucucccgguccgagggcccggaccccagucggacugcuggggagcagggacacccgcaguuggccugaccucccacccagcucagucucgagccgccgcgccgcgccgcgcccgccucucccgggacucaccccggcgccggcccgucgcgcuccacgcccgcgcucucggcugcagcgcccgggcuccgcggccugcgcugggcugcaguggaggcacagccccgccgcggccgcuggucucugcugcuuuccgcuuccugucccggcgccgccccgcagccccagcccagcccugcuagcccggcgcggccgccagccaagagcugcgagcgcugcgggccccgcugccggcccggcccaccugcagcggagggcggggcacggggacacacacacacacacacacacacacacacacacacacacacacacacacacacggccuggccagggacugacaucuccccucccaaguggacccacuagcacacagccuaacaaaucucauccugaacacacacacacacacacacacacacacacacacacacacacacacggccuggccagggacugacaucuccccucccaaguggacccacuagcacacagccuaacaaauuucauccugaauuccugaauacaugacgcagggguugaugucucuccacccagcaccccaacauacccccaagaucacacacgcacgcgcacacacacacacacuuacaauugugcauaaaauccaagcccucauuguuugccaucauuaaaagcuccaacccgcauauccacauggcucaagaaccaauuucuaccccucccccaacucauacauuuuucagcacacauaauacacuuaaacuccaauguagcucaagagaugacccagcccguaaccaccaacgcccacaguccuacagcagcuucuccccgcuccucuucuaccagagcagacaugccugccuacuggaaacuaccaggagagcgcaucucugaaggcagggagccaaaaguuccagaccgauugagaccacuucccucgcuaagcuuccuuucccugucuggauaguggugaggacucuaauguccuugaaggguugaaauucuaguauuagaaagugcagaacaguuggcaacuguuuuugugaauauucucacccuucuuucuuagucgucauagaauccaugcccagaaugacagaucuauagcugccaugacaaaaugcucccgcgaaggcacgcacagcgggaagugcugaaucugcaguuuguuugcaggaaugcugggggugauuugccuugcgaaaaugcaggcucuuugugaaguagccuuguuugggaaccuguagccucaggaaguccuuacugucugcuuuuuccuaacuccucuauauuccauuuucuccaccauccaggccacguccuucuaaguacacccagauguucacgguggcaggacgauguuccacacuccuagccuc

SEQ ID NO: 6 - RNA, 71078 nt, Mus musculus
gaggcuaggaguguggaacaucguccugccaccgugaacaucuggguguacuuagaaggacguggccuggaugguggagaaaauggaauauagaggaguuaggaaaaagcagacaguaaggacuuccugaggcuacagguucccaaacaaggcuacuucacaaagagccugcauuuucgcaaggcaaaucacccccagcauuccugcaaacaaacugcagauucagcacuucccgcugugcgugccuucgcgggagcauuuugucauggcagcuauagaucugucauucugggcauggauucuaugacgacuaagaaagaagggugagaauauucacaaaaacaguugccaacuguucugcacuuucuaauacuagaauuucaacccuucaaggacauuagaguccucaccacuauccagacagggaaaggaagcuuagcgagggaaguggucucaaucggucuggaacuuuuggcucccugccuucagagaugcgcucuccugguaguuuccaguaggcaggcaugucugcucugguagaagaggagcggggagaagcugcuguaggacugugggcguuggugguuacgggcugggucaucucuugagcuacauuggaguuuaaguguauuaugugugcugaaaaauguaugaguugggggagggguagaaauugguucuugagccauguggauaugcggguuggagcuuuuaaugauggcaaacaaugagggcuuggauuuuaugcacaauuguaagugugugugugugugcgcgugcgugugugaucuuggggguauguuggggugcuggguggagagacaucaaccccugcgucauguauucaggaauucaggaugaaauuuguuaggcugugugcuaguggguccacuugggaggggagaugucagucccuggccaggccguguguguguguguguguguguguguguguguguguguguguguguucaggaugagauuuguuaggcugugugcuaguggguccacuugggaggggagaugucagucccuggccaggccguguguguguguguguguguguguguguguguguguguguguguguguguguguccccgugccccgcccuccgcugcaggugggccgggccggcagcggggcccgcagcgcucgcagcucuuggcuggcggccgcgccgggcuagcagggcugggcuggggcugcggggcggcgccgggacaggaagcggaaagcagcagagaccagcggccgcggcggggcugugccuccacugcagcccagcgcaggccgcggagcccgggcgcugcagccgagagcgcgggcguggagcgcgacgggccggcgccggggugagucccgggagaggcgggcgcggcgcggcgcggcggcucgagacugagcugggugggaggucaggccaacugcgggugucccugcuccccagcaguccgacugggguccgggcccucggaccgggagaccccuggguuccuccgggucgagcuccccgagacgcggguccuuccaucccugccccgggcucucuccgcuccauuccagugcucggaguccuggggcagccugcgcuaccucggacuucuuugccuugucuggccuucggagugcgccccugagugcgcgugccgggugguggccagggaaugacggcgugucggaggcaaccaguggcuggacgcgccuugcagggcagaacgcgauggggguccccgccaggacccggggucaacuggccgguuuuccagcacaggaacggagcuggcucguguuucucacuucgcuuacaaaaccgcagcccgggaggccuggggggcgcggccaguugcgcaucgcggagcgcaacaggcagguaguuuacuuucaaaagcgccggggcggagcagaggcgagcagccagucccagccaaaggaggagucccuguccugggcaaccucgccgcacucgggcagccuuagacaccagucgaaccuuauuucauccugcagccauugaacugccccgagcagcgcgcccagagaagugugaagcuuuauaaaaauuuaaaagcgucggugguggaagcaggagugggggcggagccguagccuggugggcuaagugaugaggagaggagagucggagccgggcaaucucaauuuucaugucuccaaaccgggugugaugcccagaucgcgaagaugagcuccuucugaaguucauggagggguggcaggggucuuuauuggcaugguugugugguuggugcgugcguuaguuugaacccguuugaggggacuguggucaggagugcgcgcgcccuuacaggcgaauuccaaaaguuagcugugaagacuaguguuuucacugacguguuuauacguuuuacgggguuugcugaaaaaauauuauaaguuaugucaccaaucaacaauacuaauuagccuucuccuucuagugggcguguugauuacacagcuccuaggcucuguaagugccauggcagaaaccgucggagcccagggaggcauaauuagccauuuuauguaaccacuaauuagaguuuuuagaauugaauuaaaucagugugauaugguuggggcuuugaugugugggaggaaacuguuuuauucuacauuucaaagcaauauccaggagcauuuagcauuucuaaagguuggcgacucccacuaugaauagccaaaacucccagugugaaauuuucagggaugcaguugcugacagugucacuugguggcaacuucauuuguaaguaaaaugaaagacuuugugagugucauauuuuugagacugccugccaagucucaaaaaaguuguuauugucuuauuucuugagcaauaggaugaaaccauacaggaaauugaaaaguuuccuuaccaaguaacaauuccaugacaaccgucuguugaagaauuaaugugcugagugugccaaguacucuuuaucccccugauguauacccaaaggcacaccuugcauugcgucugauguaguuuggauuggaugggggccucaucaugcugauuaauaaucauaggucucaccugggcuggaggcuguuugagauuaauuuccuuucuccuuaaagugaccccccccccaaaacacacacacacacacacacacacacacacacacacacacacagucucccuucuacugagccuaugaguaggagucgaaaggcaggauucuuugugagguuauguguggcuuggaacaauucacuauuguugccugccucuucucuaaguaaacaaacaauccugguaauugcuacauagcuuucaguuuuccauggcucucugaagguuaaagccauaugggggcacuugcuugugugugugaccuuguccccuuaacugugccaugacauucaauuuugccucccuuaaagacuuguucugaagauugagcuauuuuaugcaaaugacuucagucuuaaucgccgccauaucuguggagugagcuaacuguggccaguuaacugugccacuuuccacgaggaagacaagauucgguggcuguggcugggcuguuucugguacucuguguccuccuggaggcagaagcaaacugccuccauccucugcugcucugccuccacccucaucccagaucccccuuagaacaccaugggauguguggugugcaucaggcgguggcugaagcuucagaaucuacuagggggaaaggcuuugcuugaaaagaaauacccauccuagagacaguaaccacucacagcuccucagcaacccuuauccagcugccagggaugcuccagagguaauuaaugacucaggccaagagcaguuagucugggaaugggaguugaacucauuggcaaaccagguaaaaugaggcgggcguuuucucuccuggucaacaguggccuguagcuguacaucuugaagcgcuguguuccuggaaggggaucauugacuugucccaggugucugagcccugcagagccucacucacaucacagacuuggauaaugcuuuaugauuuacacgugcacguucaggcuuugucacacgucccuguaccauuuuuccuaaccugagacccaccaaguaaacccacauaugcucuucucuggaccccuugugcaauaacuuucuaccuucccaggcagaggcccuuuaauuaauagcucuacauggagcuguugauguuuuuauaacuuccuuuucauaaaaguuagcuuacauuuaccauggucauuaucauaaccugucauuucccauaugugugugugugugugugugugugugugcgcgcgcgugcaugcgugcaugcgugcaugcguguauuacuguuuuucuuucaaguaggaguuguguguuuuauaggaaagaugugacuuuaggggaagacucuccuuggaucgaucacuggcucucagcuuguuuuaguacaagguggaaggagaaaugaauugcacccuguaagaugcucuaccagcaguguuccccaggcuguguaguuugguguacucugauccagccagacuggaguaggaugcucuucagcacuagcugaaacaauggugcuggucuuccaugagcacaucuggacuauauguucuguuacugaauaagcauuguaccagcaguacugcuuuguucuagauaguucugaaaaucuucauuuucucuacccucugugagcuuucuucuauggugaagucaugccuucaugcccuaagauagguacauggcuuuuuuucuuccuuucuuucuuucuuucuuucuuucuuucuuucuuucuuucuuucuuucuuucuuccuuccuuccuuccuuccuuccuuccuucuuuccuuccuuucucucagcaacuauuuauuaggugccucucguuugccagcagccagggggacagaaaggacugugguccccgcaccccaggagccucuucagagccuggugcuggauaaucacccaagugagcaugugacuugguagagccaaguguaggcagaaugcaggcagugggcggccaggugugaacuggagggucagccaggccucuccaaaagaaggguguucaaacugagaggaauuagccgaaugguucacgugagagagugagccucagcagauacaccgggcugggcucagguccugaggcuggaaagaaccaggccccaaggaacuggaacagcuggcaagacuauaugaucaaauggaggauucuguguuuuaaaguucaggggauaccaugggaggauuugaacaagaagguuacgucagccuggcugcugcccuaccugaacccaacacauacagguccugucaggggccaguaugacagaccuugaggguucuagguuugccuguguucucuccuaccugccuguaccccauucuggccuccacaacaauucauuaguuugcgacccagggaaauugauuucuuuuccuuucuugauaucagccuuugcugauaaagggaaacauucugaccccuucaggaguugcuuuaguuucuuuuaagugcauccucacagaguuaagcgucaggauaaugugucuucauuaacucaaacgggagcccucgccugaggucaugcccuuucuggaaggaguccacccugccuuacuagucuacuuccugacuccucccccacaucuuagaugaggccagaguugguaaccauggugaaaggaaggucuuggcucuguguggaccagggcaggugagggagccuggagauguucucuagguuauccucuguugcugugaacugggaggauccaaggacaagcagagcuugguggcaguaggaugcacggaugaacaggagagaguguucaaaacagcagagcaggucugucuacuggacaagauggcugcauuacuguaagcggauauuagaaagaucaagucagggcauaagagaguggcugugggugagagcugaccagguggaaagggagcauuuggccuuauguuucaggaaguguucccguuauguucagaauauuugggggagggggccauuccuccugacucaggagcuuaucccuggagauggagaagaagggggugugucuugauuguuaagggauaacuugauguagggauggaagaaggaauacuagaggagaaggaacaacacacagaucgagcuagucagcaaagcuuaaugagggcagguggugugccccaguugaagccaucucccuagaaccgcugagcagggucugguggcugcucauuagauauggaggcaaagcaaugggguacgaagggccugcagaaggaggguaagggugugacugacuguccuagagaagaacagucaguguucuggagaaggugccaagccuuggaaucugcaggucaaccaagaguccagcuauuggcuaucaaggagagaagauucuuucguucuuugcccccauauccugacuguaccuccuaagguugguugucugccagccagaaggccagugggaaaggagcacaagccagagcagaaaggaagggagagcacugugugcuggaagcucauugaguggcaguugaaagcccugggaaacgggaggaggagaaagacugauagacucggcucugaagccaagcuaauguucugagagaugccugcuuaguuucauguuuaguuuuuagaaucgcccccuuccucccaagcaggcugcuugccuuucuuuuacuggguggaaaauccacagcucugagagauuaaacugccguguuccaguacacagcuggugggugagcaggcagccuaaggggcagccccauucugcccacagcaggugagacuugggugggauggccuggagggaggugcuggcccuccacccuguggcucucuaagcuuuccuuugacugagaaaggcacggagaugguggaguuuagaaaccacugaagggccacccaguuuuacuuacccagugcauguggugcccacgcuggguacugucaccacugccagcucauagagucaucaaagcacuccugaugcucacauuuuguagaugggacuucaaagagaucgcaucgcuugacugagguccuggagcuaggaagcgagucaagucugugucuguuuauagcuucacccugggagaugguggccggcgcuuggauuccugauugacaagugagcagacugagauucaagaaggcaaggcgaggaaggggcugaucacagguggcucagcuuggcuggacuccaggcuuccuguggcuaggcuugggcucuugauggccaaaggcuguuaagugauaaccugauagggagaaagggggcugagggcuggaggagaagugcuacaagugccaucaaauggaaaccagccaccagcagaaccaaggaaagcagugagcucucugucauagcucugcagccuuagaacuccugagcagggucuucuggcugcuuagaaacuuggauacgaaauggaugagugagugcaugguggccuuuggaccuaacucaauaauuacuguuucuuacauaugugcuaauuaggguagagcugaaccuuguuuccuuccuauucuuuggauuaggggaccuuucaucuuuuuagcucuugaucacaauggacagugaggagauaauguuuuuccuugaagaauuagcgcucuaagauaaauuccuaagucacaaguugaggcaucuaggacagggcguguaaccccuaggcacagggucucuuuaguaacguuuuuucucuucacuuuggaaggaacagaauacuacuucuaggcucuggacugguguaacugugugcagaugagacuucaggcccaguuagggcucccaguuugaaaugucuucucuguagcuggggucagggagccagaaucuccucccacgugaggggcaggggcguggccuuugcaauuccuuuguuuuccuucccacuuaucucuggcucuguuugcaguuuuaggcuccaggacccugcagggugggagcccuguugaggcuccagcagcccugggagagcaauucagaaagagguagagcuguagagcuuucucgaucggaauguacuuggaagugcuucuaauuuauuuuuauugcagagcaauauuagagggaaguggggaagaaccuaggaccuuguaacuaauaaaucaccauugcugauguccccuguggucccggcccuuccauaaguuauuacaucauugcaaugguucuauaguuccauuggcugccugcagucccauauccugcuuguuaaagucuccguucuuuguaauugucauuuuguacagaucugugguauuuucuuugacugacugaguccugucuuccuccagcuauuucuuccuuggcuggggggagguguuuacguggcugcugacuucuguuaucauaggcagcgaggcaaucauggugguuguugaguuuuaauuaucgaagauaaauuucuaggaguuuuggauucucagagacuaagaaaaaaaaaaacaaauugacuuuuggaaaugauggccaaauugcugaguaagggauuuccuuggguguuguuucuauaaccgacaguugggggugaaguagacauuuaucuagggguugguguacuacucuacagccaaagccauaaggguaagaaagcuguguucaggaaauaaaugucccaauguccaggucucucccaaaccuucuuccuccugcugaguugggguccagcuugcgagcugccucucaggcaccugccacacuuguuccuggcugagugaugcauuuggagguuuggcuuuugugcuuaccccauauucuauaacagggaccccagaggagagcugccuguuguugguuuaucuuucaacccuuugacuuugagaauuaaucucuccuuuuucuccucuuuacagaguccuguugaagaguagugucucugaguccuccaaggccuuuagagcuagugggugagacagcacgcggaaggacagccccugcuccuucaucagacgaagcuugccauugcuauggauaccgaauccacguauucuggauauuccuacuacucaagccauuccaaaaaaucucacaggcaaggguauguaagcgauccgucaugccauccuucuguguacaagcgccuguagguuggaagggcuuucuguuagagaaucagguuuccaccagcccaccagaaaggcugaggacguggaagguucagucacuggugcgugagaagucaagcuguaagggcaguugacaugcuuggggagucacuaauacugccaauuuacguuuuauagcugccauuagaguugauggccuuaauuucucacaauugguuuuaaauuaaaguuucccuggcauuggaaaugcuucucauuucuaaauacuucuuauagguaucuguucucucagagcuuuaccaauacuguaagugaaaguuaaaaagcagguguuaacuugcugcuucacucgaagcugcugacucguuggcuacgcaugcgcgugggugcacgagugcacgcacacaggcacaugcuugcuuggccugguaccugauuugucuuuaacuagucuuccaagugagucaggauuugaaaacacuguccugaguaauggggcuaaguuccccuuccucugcugaacgaagagaccuggguggcuguucaggggaccaagugcauuccgaggggcaggaugcuggaugaguggagagauaaauggauggacaaacagauaaaugaugaaaugggugguacucugcaggguaggaauccaauggaggugucuccuccucugugaaguggguauagggauuccuccuucuagaacggguaaggguugaaugaaaucuacaugggaaaugauuaacucagucccgggaggaggccccucucuuguagcuguguuaaugcuauucccagucuugguauuucagcaccuuuguucaaaggugacagcugaccccagcucagaggcccagcuguggccacagcugugugcuguguggaagugguggcuguccugauguuugcuucucucagugagcagaucaccauauaaguaacuguacccagagugagaucucagaauaagauguggguuucaugggcucuguguggguggccacaccuggaaagaagcccgcaaguguuucccaagcugccagguguggcaucuucaggaaggggcucuuggcagugaugacugauggaugggaaguuagacacuuaaacuuuaguuuucuguaccaauuuguacuuuguaacuuuuuuaaacaugaacgccauaagggacaggcaccuuuaaucugagcacuuagggggcagagcaagcagaccuuugugaguuggaggccagccugggcugcauagcaaguagaaaguuccagaccaggcaggcagggcuacacagugagacccaugucuuuaagacaaaaaugugaguggaauaaaaggguaaaggaaagcucuuuaaagauaacgcucuuguuuuaaggaaguguuuuaaugccauuguuuuaaggaagugggcuucugucugguucuuuuggaaacuucacuuuauuuucuaaacaucccugaauugcuugugugcuucgcuggaucuucagugaggacagaaggcucugggugugggugcuucaagagcgggggaggggaaagccuauagugacauucuacagccccgauuccgagagagcccugguuuuaaaaauaaucacagauuucgaucuguagacgaacuugacagauuuauuauaaaauaccagaaacagcuguuuucaaauaccugcuuuuuagaccuaacuagaaaaagcagcuggcuuacugcgguguuggacuuccucuuccagaugguaugaauaggaauucggguuuccucuggggcuggggcugagcaggaaggauagcuugcagaauucugaauggagccagcucuggcuucuuucaucggcacacccaccaagacuugcacacuuccaggccccuugcugcuuccugcugcuucccuggaccuccuggggacccagaaauggauucucuagugcuguuaugggaacuguaagagacuauaacuuucaauuaagaugacaugcagaacgcuuaguucugucuugaucccuuguggaaaguacuuggcaaaugugagucggagcugaggcuuuuaaucaauugaucaaggaacguugcagcgcgccugccuaccgggaggagcgcugaguggggcuccggcuucucugcaguugagcagggaauauugcagagugccuguuccaaguggagcagagugagggggccugagcuguggggcugugugugcucuuggugcaucuuugaagccccugugccuccuggugcauuugagggaggaccacagaggucauaagaauucagggggcagagguuguauacacucacaguaaguaggugcuguggaaugcauagccugggcaagaagaguguccaucagugaaggagcccuccacaggcuugagagcuggcggucucaggcauuucuugucccaggagggcccugugaaggcuacucugcuugaugauuuguggggaguuuaaauggaggagugggaaagaaagggacuuggucuuuuggugauuugagcacagcuccgacucagaaaggaauaauaauguagugccugaugacacugauugucuuagaggguuggccgcuuuccaauccuguuugcugacaaagaggucacugaugccugcgguccccagagaguguccaguuagcuuuguugagagaguguagagacuacagccaaucucgucugacccguagucagcagcagcuggaagcaguaagcaucaucucgggagucucccucucccgugcucacaacaguccuagcagagccggaguugggagcucccguuuuauaggugaugaaacugaggcacggggaggaacaagguucccagauacuggcaggccaggaagacccucugcaagacucaggcuugugggcccuucggaagagaaugccgccuuugaaagggaacgugacuaaugugcuauaaaaugcauuguucuaaagggcugcccgggcaguggcagauuccgaggacucugagccuguuuguuccacccucagcgggaggacagguagugaguggguggugggagaggaggaaagggaggaguaacaagggggggcgggaggggggcugggagaggggguggcuuuccccauuuagaaacagacaagcaacagaacaggaggaaauggccugcccaggaagugcugacuguaaguagggacagugugggaauugcaggcauuccggcuggggcuugggggguugcagcagcccuccagggcucagcuaacaaauuaccuaaauaaugaugcauuuaccugcgcacacgguugccucuugcaugcugcaacuugcgcuccccacccucucaugcaugugugcguauggugcacagauauacuuaucuuugcacugacagaauuaucuuugcacugauagacuuaucuuuacuccugugggccgaggaagcaggaagacagauuuagcgauaaagacgaagauuccuagggcuucccagaaaagggcccccaggugauccugaccgcuuaggcaguuaaaucuuagcuguguccuaaugcuccauuuauugacuuauuaaaccauuuacucuccccuggacucuuacuuauuucuacacucuucgacacaucuucauccuuggggaacccucuccuaggauaaugggcagccacagauagaugucgcuuaaacuuacaucauccuuuugcuaucccaagcuggccucaaauucuguaugucaccaagggucacagguguguaccaguaugucugguuuaugugguguuagggauugaacccagggcuucagcaaugcuaggcaagcccucuacugacugagcuauagcucccucucccuguuccugccuccacaguuacagggaugaguguuuagguauguucugcagucaaaugaccucugagagguuugucguucuauaaacuagaaagcacuggauggauggaugaucagcaguguuguucuuggacaucacugcuaaguccuggucuggcuuggagaccugcccagagcagucacucccuuccacagugagguaauacaagagcagcucucuuggugcagcgcugauaggacccucauuauucuggguuacucucagucaggauugcauccugcccuauguccaugcaauacuaaaaagaaaagcuuguuuuuauuuauguguaugggucuguguaagugucuucaggugccgagggaacccaggaacaggaguuacagguauuugccagucucuggauguggggugcugggaacagaacucagauccucuaggagagcaguaagcacucuuaacugcugagccaucucuccagccccacucuguuaauaaugacacacuguguguuauggugcuacacaccuaauugagcauccaugauuuugauaaccugugauucacgaggcguuuuacauacacacaaacuucccugaguaggaauccccacagccgcccuagaaacaugggaugggaaagucuuccugaacaacucuugcaucaccugcauccugaugaccuggggugcuggugaaaaaauguagauuccugucaucuuccucccagacagauucucggagggcagggccacccaaucucugcagcccuggugguuugucugcaccaggggucugagaagugagaacacggguguagggggcaggugcuggaggauggaauguccuuggcguccuauacaagaugcucuuaccuggcuuacggcaggguuacgcggggagcugagaggcaaagcugcccagugugggcuguucccaucucagugcccuuggguccuuuaagaacccagccgggugauccuggaaagagcacugcagccauuuuuaguccugguuaguuuccgccugcuuuucaccccugugauguucaggaaucaggaacuggcacaaagcaaaaggguuuuguuucaguagaaucuuugcugucacaguauuugaccugugggaguuuucaauagagaaccagguuagauaagcaugugacuaggcugguggccaacaugagugacaaaugggggaucccaggggaaguggaagggguggggaucauuccagggucauccagccggcugcagguggaaccuggugaauuaacaguucuggaccuagccuaaaauucacucaaaucucccacccugcuuacuguugcucacagagaacacccuuuggggugcugguuuuggacaacacacaacuaaggcuauccauggucacagccaacagugaccucgaaggccuauuuccuaacucggagcagugagacuguauaggggggugaagaugagggcuaggaauauugaccuuaugaaaucuccaacuuaugaagauuuaggaaaggaagggggccagugggggaggggugaagaagggugaacauaaucaaaguacauuaucuuuauguaugaaaaguaccaugguaaaaucucauugucuuauauaauuauauaugcuaguuuuuaaaaaugaaaucguuccucaaagcaaugucacauggcgguuuugaauagaaaugguggcaacagauuugggaucgguuccuguucugcuccuuaccacaacuuuugcaaggugcuugaccucucugugccuuaguuuuucuuaucugagaaauggggcaguaauacuggccucagaauuauuuguuaaaauugaaugaagucacauacucagccaagugcugcgugaagggggcagggcaggagagauugacaucauuugauacagcucugggugaauaguuagauucucugcuuauuuuacugccccccuccccaccucccccaguuaccugucugggagccauacacagcuaaccagaacacaucuuugucuaguuaucuggcuaagaauggaguuauugucauggaaacauugucugccacaaacccuuuguuccuugaaauaguuauccuuuccuaguuugaauagugccuuuccuagggagagguucccaagauaggagucugacaauagaucugccaugcaguuuuagggguucauuguuguugcuaaguaguagguuaguaggagauaaauguguaguggggaagaggguuugguggugggccuauggugugcucauggcucuuuuguguccuucucuccaggacaucacacucucugggauagagauaucacacucuccuucacaaaguucagaccccauuuuuugccauuggccaaagauggcugcuguacauugguacucacuccacgccucuguacugagcacacgcacucucccuguguaugaggaaucauggcccccauucuguuccccacaaaggaaaacugaggucaucaaccugugcaaagucacacauaggagagcugacugucugacuuugcacacaaaaugggaaaccuugggcaugaggacaaguaggaauggggaaagcugaugucaggucgccaaggagacacacuggcuuuggccacugcagggcugccuuggugccccucuccuuuacugcuuauugaccagcuugugaccucuagggcucggccacuguggcuggugccuuuuguaguuuuaagacucagcagcaggguguccucccacugucucuggaggaagaccacccacgaaguuccucugguacagagagaguacagagagccugcuucucuuagguggccugggacaagcacacccccgggaauguuuuguuucaccuucuuuguuucuaugggugucuuugaacacagucaaaacccacagaguggcuuuucauguugaauuuguaagaaagacaaguacaggauucucugucccggcuuugguuuuccuuucuucucuucucgucccaaacuguagagcgauaucaugucccagauuuuuuuuucuuucccuucuuucuuuuuuucagauugaaguuuagauaugauacaguauaguguuuguccaguaaaacacgaauuaguuuaggcaaaugauaaccaaaucaacugaguaauuauuacagugaaauguguaauaauuucuaaagcaaggcuuuaaagcaaggcuuucuaaaacaaggcucugaaaaaugugaccguuguugguggaggaguggcagucuuuguuuugaaaauaguugggaaauuuaagacacucuuacuccuggcaggcuguggggauggguaggcauggaugcggugugaggggugagcuagagaguaacuaaccuggcaugaguuuuggugucugauuauuggauuauuuccccccagggaaagaacaagagaaagacacaaaucaccaaggaauaaagauggcagagggucagaaaagucugucaccauccaggcuccugcuggagagccccugcuggcaaaugacucugcccgcacaggcgcagaggaaguucagguaaggcucaaaggcgcugcugucagccaacugccacucagccugggcucccgccugcguguuccugucuuguugcacuaaguucucuuggguuuuuaaucuucguuuuucuagcauuuuaaugaguuuaucuauuucccuggcuuucuuguuggucuaagcacaacacguccuacccuugaagagcuagggaguggggcgauccuuucugcccugugauugguuagccuccuuugaaugguguuggaaagaagccagcuugacugaugacaggucagaaaagggaaaaguuacaggcaagagucccuggagacuaauuccaaaauggagcaggacuggagagggccggaaacucccucaacaacaaacaaccaaaacaaaacaaaacaaacaaaauaaaacaaaaaaaaccacaacaaaaacaaaacaaaaaaacccaaaacaaaaacaaaacaaaaaaaccacugaaccaaaaaaaaccaacaaaaacaaaacaaaaaaugcaccaucagggagugcuuaacaaugacuccaagagccagcccaggacucgguauaagagagaaaucaagggcuuggcauucagauggcaagcauggaaaucuggugacugugauaauacugagucaaagauggggcagaaaggaguccagcaaacuuuggaguuaguagcgguggucuuugggguacacagguugggacuggacagaucuggagacuggauuuccucugucaagauccagcagcuucugugguccagccugcagccacucaggacugugguccagccugcagccacucaggacuguaggaauuugggguugccaggccuugcauguuuuaguaauauuagcauuaggacuucaagcggagucaaucaguuuuaaaauaucaacacuuuauuacuuaaaaaauaaaagaaaguugugugggauugccuucgagucccaacuguuuggcagccucguugauuuaaauaaaugugugagcuagacucagaaguauguuugcacugccccccaaccuccaucuccugaaauguuacaugcccagccuugccucauauaaacaaagcaaugaaggaauacacagcuauaaagauacaggaacagagauaagcauguauccaugcacaccuguaggaacccacagagaggcauuuguaaucaguuaggaagacugaacuacagucccuccaaggauacagaugccacugagacucauagcugugcuucugcacugaaugugggguuuguucaguggugagcaaauuccucuaaugucgucgcgcugcuugcuuugguucuaggaaggcagauggauggauagauggauggauggauggauggauggaugggggauggauguggucagucuuaggacuggaucauucuuaaaagcuucacaggucaguuuccuccuagaaguguauucgggggugcuaguaacccacugugaaaagcauuucuuucuuuguccccugaguccccugggaagcuguugcugcuuacagcaggauggugugaugaggaagccuugggagguuguguguuucagcagcucugucaacuugguaauuaaacuuuuguuguccccagcuucugagacucuaagggaugagacucaucaaguucagaugcauuucccacccuccccaaccccugaagaccucaaauuugaaagaagccuuuggauagcccuacuuuuuuagacaaagauguacauacguccuuaaaaugaacagagauuuaguuagcagugcacuggcaggaaguuggacgcacagcugagucagagcagugauauuacacaacagaaugucaacaugauauuaguaaugcuuacuucagcagggauuuaucaaucgcauguguagaauccagcauuugucuucucugagacaauuacugugaagccaacuguuuucuauagccugugaacuccaaguuguaugacuuuugugguguguuuucucuugucgauguacuuuuuaaaggagauugaccuaaauuuacacacauaaaccaaaugguucucaaggguauacuuugguaaauuuuaacagaugagcccacaccucucagcgcaaaccacuccucccucuuccuaguuguucccuacccccacccccaccucugcagggcaacugcuguuuugauuuccaucucaguggauugguuuugccuguuguagaauugaauauaauuggaaucauaugaguuuuucuccacucagcaggaugauuuugauauuuauccauguucuaugugauucaacaguucacucuuuauuauuuuugcugacuaguguuccacugaacugaccgcaguuugguauuuguucugguggguggacauuuaaggugcacacacucuaauuaugauggauuaagcucuugugaauauuuuuauaggucuuuugugaacauuuuuuccauuaacuuuugauaaaaucuaggagucaaauggcuggucuguauaguuaaaugcguaccuaaaucacugugaaagugucaggcugguuuucuggugguauuaaaccaucuuaaaccucuaccagcagugccugaaggaacuggcugcuucuaacuauugucuacaucauuccugucaugcucugugauacuucugacuuccuaaguugauggccucugugucccgagguugaaauccuuacuacccacucccagcauugcucaggccuuaauaaauaaaaaauuugggggcuggcgagauggcucaguggguaagagcacugacugcucuuccgaagguccugaguucaaaucccaguaaccacauggggacucaugagcacuuucccacuccacacuggguuguuaacuggguuaguuuugugcaagcagacacagcugcugugaauucaggagugcagcauccuaucgugucccaaagacacuguuuuccuggguccucccugaauucuggaccuuacaaucuuucauccccuccucugcaguggucccugacccucauacagaaggggugugaaacaagaugccccauuugugacugacucacuuuccuuuuagucuaacuaguccugaauuucuguguaguugccgccuacuuuauagagaaaccuuucugacgaggucuaagagcuacauuaaccuauugguagagaaauauauuaugacuguuuagcagaauaaugguaguaguaucccccuaagaucugugagcuccccaaccauggauucuuggccagauguauaguacuagguauguuuccuccuguggagcaggcuuuaaauacaggugaccaacagaaagcaguugguuaccaucauaacacuugugccacuauugcagccuuaggggucucuucccaugcuggucauuacuguagcucagagaguucucugagaguaagacuacugaugaccccccuguacuguggaaacuggccagcagggagggagguuccucgucaguaccuacuugaugucuccauuuccuauaaccagagagugugacgucuucagcaguaaggucuuacuguugaguucugguggacacauccaguacugggcaguauuugguaaccugggccuucugggaggaacuuuaugucuuguguagggugacuaaacucuuuuauaugaauauauguaugggugaugcuuguaaaguaguaguuaucccuuacccaaacuccucuccccaccccuuuccgucuccccuuuccccuuccuauacucucccuuuaagacccuuguuccuccccgccaccaauggcccccucucuugcuccccagauucuacaguuacuccagaucaagcacacaaagccaaagauucagcgcugggauccacaaaugagugugaagugcuugguuugguuaugagcgaccuaugcuguugcuuuaccuaugagcugagacuccaucuguguccucauuccaacacuuuguucuauaugggauauuuuuccugguuaagucauaugcacggagcucacaugguuucuggugcaccccagcucuguugugcccugaaauggaguccuaguuuccagaacagcaaaagcaucugacagucuagcaccagacucuuguugaaugaucacaccaggagcccacagcagcaacugccuagaagcauuaaaggagaaaauaaugaagugaaagauauaauaacccugauaguccuauacccucacucaguuuauuaugaaaacauguuuuagagagaauuuuugagcucuucuggccauagaguuuugaauuuucuuuauuuagucagugagaaaugaugucaaagaauccucaaugcuguucuguaccgaagugaguccuauaaaugucauacagaaguuuagguaguguguuuucagcugugggugaguuugaccucugugugcugggaauuccuguuuuaugcucucugcucuguggagcuacuggggggcgggggugucuggaugugggcuuuguaagccuagaacuuagcaugggcggaguuuacugcgguaaggguggcuguucuccuguaguggagucagcucagcucagucuaacagcugcuauuaaugucagagcagaaaggccuagacccagggcuucccagaacuuuucaauucgagggaugacaaggugucauaguaaugaaaucucccaaacaaauugaaagguuagauuguguuuucuggguucaaagggcaaacauaaaauauauggcgaaaauuucaaugaaaauagcuauaguuaaaaaugucccuguauuaaaagcugauucuaugaacacuuccaaaaaaguuggcuaauugaaguauuuuauuuuguuguggcuuuuauaaaucauccucguuaucuucucugucaucaggaugacaacuggggagagaccaccaccgcaaucacaggcaccucagagcacaguauaucccaagaggacauugccaggauuagcaaggacauggaggacaguguggggcuggauugcaagcgcuaucugggccucaccguugccucguuccuuggacuacuugucuuccucacccccauugccuucauccugcuaccccaaauccuguggagggaggagcugaaacccuguggcgccauuugugagggacuucucauuucuguaucauucaaacugcuuauucugcucaucggaaccugggcacuuuucuuccgcaagcaaagagcggaugugccgcggguguuuguguuccgagcgcuguuacugguccuuaucuuucuuuuugugguuucuuacuggcuuuuuuaugggguccgcauuuuggacucucgggaccaaaauuacaaggacaucgugcaauacgcagucucucuuguggacgcgcugcuuuucauccacuaccuugccaucguccugcuggagcugaggcagcugcaacccauguucacccugcaggugguccgcuccaccgacggagagucccgcuucuacagcuugggacacuugagguaaggggcaugcacacggaguaagcagaaaggaugacuaauaacccuagaagacagauguuauuagucggcaggggugagaugaagcccuagaggcagaugcuaagacuggagccccacccuucucugguguuacuaagggcagugugagcuguggggugucugugccuuucccgcgaugcuaagacuggggcuugacccuugguguuaguaggggcugggugagcugugggguguccgugccuuuccaugggacucucagauaaguucaggguuuuacuggacucacacucuaccucaauggcaauucccaaagauagacacaaugauggcuaccuaccuugacugugaacuuggcuuggggauaauggauaaggugacuaguacuuccauucuguccaaaaugaugcagcagauacuuacuauagccaaguuuuggaaucauccuaguuguucaccagcagaugaauggauuauuuuuaaaaauugauaauuuauauauauauguguguauauaauauauauguauauguauguauauauacauauauauguaauagaguuuuauuuagguauaaagaagaauaaaaauggacagaauuggugugaucauguuaaacaaaguaagcuagaccuacaagacagguaauccauuuucugucaugcagaccuagguuuuauauguauauacacacacauauauacacacacacacauauguauguaucauauguauguauacauacauauauauuuauauguguguguauauauauacauacauauauauauguauauauauauauaugaugcacacacaugaaaauaggagaucuauuuaggaaagggaaauggaggugcagggugggaggagaaauaggaaaggggggugguguuauggguuagugaauauaguuaaguacaugauguacuuuaucaaaaacauuaugaaauguauagauuuauacagcaaguacacaucacacuccugaauucaguauuuaaaacuuuaaugccauuuuuaaaaaugguguaucaaguuuacccugguaccucagugggauuguuagcucuuccuuuuuguuuccacucucagacagccuguuuggucagucaauuauguagucacccuagugacuaauaaagagucgggcuccagccaauguugaugacucauaccuuuaaucccagcaucacuaggcugagacaggcgaaugucugugaguucaaggccagccugucuacagcauaaauuacaguccagcaaggguuacacagagaaacccugucucaaaacaaacaaacaaacaaacaacaacaaaaagagucagacuccagcuacagacuacaaauauguaaggacugaauguuuugaaaguguuuguguaauaugagaaagguuaaaacuccaucgguagcugggcgugguggcacaugccuuuaaucccagcacuugggagacagaggcaaggcggauuucugaguucgaggccagccuggucuacaaagugaguuccaggacagccugucucgaaaaaccaaaaaaaauaaccaacaacaacaaaaaacaaccuccuaucugugcauaacuuuaguguauuauuccaugguuaacucaaaggugaaagucuucuuaaacguuuguuuuauaaauaaaugaagguaaguacucuaugcugguuaucacuguaaaaccucauguaauuuuauucaucccaguguuauggauaaagagcugggguagaggguguaaguaauuuacacaacacaccaggcaugcccggcuuuauucaggaucccuugaaugucaugcgguugggcugagugaaugauccaguuaugacaucucucccuccgugcagaaucuucuucuuccaucuguuccccuccauauacuuugagaucccuaaugauacacagugugucuuacuccaccugacauccuuggugccuggcauggagcaugauucacaguuggcagccaugugguuccugggugauugauccacuguggugguuugaaugagaaugggccccagaggcucauguauugaaugcauggucucuaggugguggaacuauuugagaagaauuaggagguguggcuuuguugggggaguaugucagugagggugggcuuugugguuuccauccauuuccauucauuuauuauuucuaaucaucucucucuccuuucugccucugccugagaaauguaagcucucagcugcaugcucucugccaugacagucauggcuauggacucuaaaccucugaaaccauaagcccgcaaauuaaaugcuuuuuuuuuuuccauaaauugcauuggucaugguaucucuucacaauaauauaaaaauaagucaccuugaaugccuggcuucaaaguuucacuguccugagcaguaaaagcugaugugucacauggcaaagcagccagggcuggugagaacaccgcuguggucacuagaauaacuggcuuugucauugugcuagcuacuguccagagaaguggcccagccccgcuuggaguagaucccacugcucauccaguguccugcugacguacacucucaucuguguccucuggcucagcucguccugccugagacaggcugcuuuaguguucaaggcugcugucaccaugauugauucccaggggaguuucucuuugaauuggugugccaugaaggauaaguugguuucuaaucccccagagaugcuaguaaaauuguggaagccaggaagcuacuggggcacuggaaccuuagagaacucucuccccagucuuuauacuagagaaggaccccuccccacccgacccccuccccagugauaucucccaggguuuucuggggaucccaggcacuuggagagucgcuggcauauggcuuugaaguggacaguugcucugccaagccugagauggagaccagggcacaagaagauagggaguuucagucagccagugagcggcagcuaugaagccuauuggcaaacagcccagcuccgaggccgguuuuguugugaucuaugcugugcagccagaccuguggucuccuagcaggugaauagcauuugggacuguggcagccacagacugugaaggacagauagcuguagccuuaugucccggucuuccuucugaguaguguccgucccaguugcacagagaaggguaaugucuuccucaccuuaggucaguccagguugaugggaggaacaaucccuucugggcucccacucuucucaaaaacagguugaccucaccccuacaugagaccugggugcaaauggaaggggccgacccaacggccccugcaaaguaggaaaagaaucccugucagcagcuuugcuaugugggucaggggcagaacugggugggagaagccagacugcucccggacugcuggcccgcugcugcucaggaaguucuguaaggcucaccucagguccuaggaaaacugcaagugacaugucuaacgggcuuggaggggaguauuugagagaaauuucuucccuggguccucacucucccuccuuuuaugugaucugguuugacccuuaggugauucugaauucugagguggaaggaaagguguccugucucucccuggacagcacuaggugaccugugacaaccaguuugcaucaccugcugcuccaugggcuaaaucuggcccaagcccagccauggugggaagaaccaguggggcagaaauaugacuucuaagcccuuuuauaaauuguuaaaacaggaggaaggggggagcaggaaggacaaagcaagccccagacaucagaauagcaggucgucagcagacccaaccagaaccccaggcccuucugccuccccuuuaugcaaagccuucgcugcagagugaccuauugcgcuuagguguggagugcuggagaggucuuucuucucauuuucaaaggagguuuuccugaauggucugagcuauuuuugagaguuuucaaaagaaugccuacucuuuagguucauaaagaaaaugggcuucuuguuagcacuuguaaaaggcccuugcuguggcuuuccucgugagcagggaucauuagggguuuauuugaaaaccuucagaaauggaagagaguauuguugcagacugugaaauuccauaaauagauguaagauaugaccuagcucuuaacugaugccuuagguguuacgugggcuuuuuauauuuggacuuaauuuaccccaccucugggggucagggcaggugggacaacagcuaacaucucuuccaguugaggacagguuaagggaccuguucgcaguagcaggugcagguucgcagguagcacggugcaguucauugcccaccucuguucuccaugguucuccggguggggguggggucucagcccaugcacaucccacuugucagguuuucucagugauuugcuaaauuuucuuuaacuuuacuagaaauauaauuuauuuuuuaacuuccugugugaggggagaaacccagaugaauauggaaaacagaucucagaaugacuuuuaauaacugcaguauuuucugugauuugaaaucuuagaagcaaaacucaguaacuauuggaacagacacuccuguagcugacagugaacagcuacacaguagcuggcucccagcaggggucaggugcugucuugcuuugaacacagaacucagucuucaggagagucauguggggugggcacugucuucuucgcugguugaugaggaaacagaggcacagagaauucaggaaguucuauaaggcauuuguaacugugagagacauggcuugagcccugauggucuggucucagagugaucuuaaccucacauuguaccggccccuaacagaggguuuauguccacguuuaccagguaccagcugaugucaugauguuauauucauccggcucuuucuuuacagcuggguggacaggaggcagguggcagguggcagcaauggcuggcuuauucucucuggucccuuagacccaccaguucuuaacugaccaguuucccaaggcugguccuugggucugcagcaguggcuuugagacucucugaccaaaccguuccuacguucucuacuuucccuccuucaaaccuagugcuguguaauaucuagccuaaaacacaguagcuuaaaacaaccaucauuuuauaucgaaugguucugcagcauggguuaggcucuacugggugggucuucucuaagccuacuugaguccuuguguaauuaugcacacauggugagccagccugacucagcuuugguccuucuuugcaucuccugagauacucuccaucucccacauggacucguugcuccugcaucaguaucuagaugucaggggcagcuugaggcuucgaaggaugcucaagaagaaguucucaggccccgcagagcucaggcugagagccagcccagcaacacuucugcuguguucauucuugacuaaagcaagcccagauuugaagaguguauguugacucacaguuugagcaugucgucagucauggagagaaaaucauggcagcagcaggaacuugauauagauggucacauuguauccccgguuaggaggcagagagugaugaaggcuggagcucagcuauuuucuccucuuuauucagcccagaaccccagcccaggggauggcaccgcccacaguuacagugaaucuucccacuucuaaugaacucaaucuaggucaucucucauagguaugcucggaggcugacuuaaucucuuauagggcuauaucuuaggaucuucucgaucagugauucucaaccugugggucucaaacccuugagggucaaaugacccuuucaccggggucacaugucagauaucuugcaucucagauguuuauauuaugacucauaaccacaaaauuacgguuauaaaguagcaacaaaauacuguuauggcugggggucaguaccacgugaggaacguauuaaagaauuuacagcauuaggaagacugagaaccacuguccuagaucccugucagcaucuccaccucagacuccucagcccuagucugcuuaccuuuacguuacauauaguucugauauuuaaugucuauaucuuaaaggaccagaaauauguuacaaauggggacagagugcuguucuaggguuguacaggaauauuaauaccuugcugaucaucagccaaaggaagaagaaaaguguugugguaaauauuggggguggaaguuggggguuucugccccaccuuagaucuuuuaguucccccaaagacucaaaaccguuauuuuuauaauaaaccuuaaaagcacaaauaucaucccucuaugcuauuuugucugcuucccagucaauaaccccaggauauaacuugccacguucugccugggacccuccuacucuaccaugcaggcccucauggccacgugcuuacgagccaccuaccucaugguaucuuuuuucuuccucuccucucuccucuucuuccuaguaaucucugucucagaccccaaccccucuucugcccagcuaugggcuguaggcaucuuuauucagccaauaguuuuagauuaaggaguaagguuacauaacacuucuugaguaugugaggaucucuucauuggccacaacuagaucuugggguggggugggguggggggcaguauaaauacauagcaauaaacuaaaccucaacagaaaggaacccacaaaggcccacacaacucacagcacuguggguuuuaacuguuguuggcgguguuuuaauucuucauucaguaagacuaugagcgucuuauaaauugacauugaacaugaaccccuucuucacaggguugguagcuaaccagagaaccuucucugcuugaaaagaaaugaccccgggauugcuuucuaaaccauaggaaugcaugauugauuauacacaguugcugaacagcuuuguugagaagacauuuuuauguuccuucuuccacauacauggugacgcccucaucccaguuuggagauaggcugcuaaggaaauaguugggcuuaguggaagucauaggcuacgaaucuaguccgauaggauuaguguccuugcacccagaccccagauagccuacucuucgugugcacacguacacagaccgugugagacacugccaaggcagucaucugaaaaccagaauaggaguucuccuaagaaccaaauuggcuuuacucuuggacuuucggcucucggaacugcgagagaacaauuuauguuguguaaucuacccagacucguacauguugucauagcccaagucaagauagggauauuaucaguacuagcaauuuuuacccuaaagaccaggaaucuguggggugaguaagcacauguugccccuaaugaaacagggcuggucuugucgucuggguggcucacccacacaucucuaggcaugaguaugggauuuucuuccccugguuagucuauguuuuuuuaauuaaaacaaggacagaggagucucccaacaguuagcuuacuccagcaucugggaagucuuaagucccugacucugacuccaguaguaucuaagcuggucuucaggcugcaaaucuagcucagcuguaggacuggcccaggccuccccucccacacuggaaacuaacaccaagggucuugggaggcuguggaaggcccagagccaugggccguggcaccgaggaacguucuuaaaugcuuacuggaguuuuugguucaugcuauuacuaucgugguuucauauauaaacuguuauuuuuagaaauggguguuuucauuuguaacuacuuuccaauaacgguauuuuaacaguccccgugcccacuccguuaaaaagcaguggauaaaaaugaaugcaagcuuaagacuagagggugaaggguuuauucaggcagaaggagaauuucagggcaagcucgggagcugccguuugugguuugcugcugugguaccucuuaaaaguggcuuuaaugagaguguaaguuucuggacauugaagcacuguguuuauccagcuguucuuauggcguccgccugcagccucaugcugaggccagaggauucaccucucacaggguauagcgcgcuauggaagggaaggugcuuuccacucccuuggcgugcaugugugugcgcgugcgcgugcgcgugcgcgcgcgugugugugugugugugugugugugugugugugugugugucugugugaauguugggagugcguguguguguuugugugugugugugugugugugugugugugugugugugugugugugugugugugugaauguugggagugccuccuaagggccgugcuuguguaugcuuucccaggagccacgcugauguggaaggccuuccuggggaccauguuuguauggaagccauucuggucuuucccuuaggucuuugcuggaaugaacagccuaccuggaacccacgcuaguauagacagcuuacuugggggcgacgcugaauagagaaccuuccucggggcaggguuagucuaaauaccgaggacccuguuggugaagguagcuguccuaaagagaaacagcuaugcuuccagaacaaguggugagccuuucccucaaggguuuauguggguuggucccacacuccagcucccguccauaaauacgggugugauuuugcugucacggcacugacaagcgggaaguggugacuggggaauccuucugucucauuggcuggcauucagaucuguuccagguauagcuuugcccgcccugucuuugugaucagagaucccauuggguaccuguuaaccucuggaucccagacuuaucgucuacguucccaucuucccaaagcuagcggugcugacgucgaggaaggugaggcagggaagagaaggccagcagagccucucgggugugugugucugcaggccuucuuagccucugucuagagagaugcuuucaaacauacuaggcaggcaccucuuugauccuuaggucucuaguguuuaucuuagugcgauucaccauggcagugugugaaaggaagaaaggccaguuccuggauagggacuguugcgagguugaauugacaguacagggaggugacaguaagguggggaucuguacuacagccugaagcagagcugcagcccucuggggagcuaguggcagggccauggccuuugccuauagcaauaggucucuuggguacccagugggagagggcuccuguaugccuggcucuggcugugacucaucagacucagaaggagaaugucugucaguaccaucagcacacucggggcccugcacaggaugaugaauaauggccagggaguaucacacccauggcggcuuuguccuguuuuucuccuaagaccagaagcagguuucucuuacugugguuacacucacaguaugaaacuaggugucucucagggcuucacuuucacuauaaaccuaaaauggggacaguaagagcauagguguccccgagccugcacuuuggagacccuuccauggugacucaguccuguucugucuuggaggucugccaucagggucccugguuuuccaucugcucacucuuccugcacuacugauaaggauacacugugagucugauuuagagcugccgggcauggaucaccagugaauccaggcagugauggacuagcgcuuuuggcagccucagcagccagccagaacaacugaucugcuucccuccucgggugguggugugccccgugguucaggaucacaggcuguccgaguaccagaaaugugucacaagaugcuuuguccuaggaaguucacccugucuccuggguuaguaaacuuaagccaaccccaguuucugccccuucuguucucuugaacuccaagguuguuuguucccuguuaucuguauaggacuugaucaagcuaccuucccaagugcaaacaucuuaauuaaaaggcagaaggucuggagauguaaacauguuuugugccugacugaggcagcagcacuugggggcagggugcuccccuaacuauguguguuucucugggacucacacaaauacugcugcauguggccccacuguaucuugcuccuggucugggacagugauguccacgcaugcagagugacuuggcucucacugauacugccggggagaauucacaguuggcugaacggaaggcauugaugguuguauuaguugcuuaccugguugcugcugucagacaccuaacgaaagcacccuaaggaagaaaggcuuuucuagaaguuuggcccaggucuuccuuccagucucaugcucccagaaauaagacccagacucuaaauauauuuaugaauaacuuugccauauugcuaggcuuuuuucuuauuagaucaucacuaaaauaaccuauuuauuuuaaccuauauucugccccauggcuggcuacacaugcucagguaucaggcaucugcuagucacaucuuccugguggaucucccuccugggacacucccaugauucuuucugccucccggauguuccaccucguauuuccugccuaagcuauaggucacaggcuuuuuaguugacaggugaccugcucauacaauacacaagcucuccucucuccagggaugaacacugauucugcucccgcgcuguggauauuucagaacagugcguaacacccauuucugcucgcgcuauucgcuccacuuggaauuuuuggagcccagaguccacagaauggagccaacagugaccuguuaagacucagcccagacacuuagcauuuucugcuguguagaccucaguuaaaacccccaucauccucuccucaucaccuccccuucccuccccuucacuauguuugccuccaccccugucuuaucgguuaagcauucccauccuuugggugguugucaccaccuauuggaggaguggacagccuuuuauaaguccagcuuguagcucagcgucuggaaagucacagguguucaguguuugcaguugucgugauggggguggggcagcugguuauucauccucuucugaaccuuuucuggacgucagugugguuggcucaaaggauggugauuauauacucuacacggaagucuucccagauuuuauugugaugagaaacuguuuagugcuucaucugucagcacaugccaagguaauugcaauaauguccugacacugauguggggcaguuacauguacgaaacaugcucacauuucugacucauggagaaagcuguuuuguugauagagugguauggauccaguuuauauuggaaaaggcugaaacuuaagagggucuuaccaguuuggccaugcuuucuccccuuggagaggagcagaggauauaagggcuuucuccuggauacauccugaagaccagugcuaauuucugaguucagucauauauacagguuugguuguagaaagcacaaucaaggggagagaaaaugaacaguaaacaaaggaauguguguagaggugcacauguaugugugugagagugcauacuuuuauagacuucagucccucuuucugcaaccuagagggguuaaaagagagaugguuuauggccaagguguuuccuccaaguaugagauguuuucauaaguacuccgugucuccggaggaagcaguaaggacuagaagcagaaguuaaagaguauucugcguagugggagagugaucuuuucagaggcugggguacucucaaaggaguggauucggcuuucuuugauucuugagauucuggcagaacaccgagaucacuuuguuuucuagaauucugggcgugugucggucagcuuucuauugcugaagcaaaguaccugagaugaccaauuucuaagaaaaauuaguugggcucacaauuucaauuguguucguuuguguuacauacacucacucagccccaguacuuugagcucgcagcaagguagagccaugugguggggaacaaaaguccaacaaagcuguccaacauggcagccaggaagcaaaaagagccgacaggcgaucccagaguccccuucaagagcgucccccuggagaccugacuuccuucugcgagguucgaccuucucagggcuucacuacuuccccagaguuccucaggcugacaacugagcauuuaauacguaguguuuguggggagcauuaaagagacaaaacauaauaaguuauucaguauaaaugaauauugagcaugcuuuuaugcccaggaauggcaugaaccaaugaaccgcauucccuauuauaaaaugcuuggggccauuaucaauaauaugaggcaguuuugaauaaugccuuaugguuuacaaauauaaucacuggugagauuucagcggauguucugaacaaccgcagaaggccauugauuuuucucuugccaucacaggccaugaggaaguaagacucuagaaaguaacagaauggcaggaucagcucuggaauccagacuuucugcuucuuaggccaaggcuuucuccacuugugagucauggccaccucccaauaaguggauuggauugucaggaggcugagaguugucaaggaaugcucuaaccuuaugguccuuaugguuccuaucuccagggaaagcuauguggaaggaucugccuuggcuccauuucaaaggcagucagucccucuuggggagagagauuggcacaggugcacacagggggcagaucagccuccccagcacacaugcggacauagaaaccuauggccauggugguaucagucacaaggcuugugccuuaggcugggcccuuuaaauuauauuaccuuauaaaauccugccacgccuaaaccaaccaaacaauucaaaauggggaagauagaaggcaaacgccccaaucaccaacauguuccccggccuaaauguugguuaaagugaacucucagaaagucaaaguccagaauuugcccacuagccauggugcuucagagacagcucucagaaacugaugccagccuuagccagcaccccauagaguugaaccucagggugucucacuggaacuucuaacuacacugaccugacagguucauuucauucagcucucagugauguaccuuauacauacauguuuggagcccacguaccauggcagugccaggcauucuggauuaguagucccauccuauucaagaaaaaaaaaaaagaaugaaauuugaaaaagugaauaauuuaagauaaaaugauucauauucucucucucucucucucucucucucucucucucucucucucucucuccagagaggcuggaguucucuaggggguaugaaguacuaucaauuguuucauaaagugggagaucggaauaguugaauuaugauuuguuugauuauuggcuuuggaggagaacgaggagauggcuuucauuucacacuucugggaccaugaugggcuugucuccacagccugcacccaggacuccugcgugaagguggcuggccugcucacugccucuccucucuggcuccagugcugguaugaugccaagcuccccgccaguuugacuuuccuugccccugucuuuccucagagaugaucuugucuaggaaucaggaugaguuuaaagauuugcuuucaaccaucucucagccccccccccccccccgccuuugccucuaauggcuucaugaaauucuucuuagucuuaaaccuuaagaucuuaauguuaaaccuaugggaauccuaagguuuuauaaacagacaauuugagccaacaaguguuacauauggaggaaauacaggaggccuugcuugugugagagggacuuguguaagaaguuaaagaggcagggguugcauaucuaacuccuuguaggagacacuacuggucuguguuaugcugggugcucugaguguagggacagacuuuagggucuagggagugugaaaggcuuacugauagaggccugugugguaccacaguuggaggauacagaggauccaaggcaaggaaggugucugagcacggacacuggcuggaggaagggaugcacuguaaguccugggcuugugggucuaugacuuagccugcaccuaaaccccugaaaugacuuugcuugcuaagagcaagggagaauguggaaaaugacaucaaccagggaguucugagugcuuagauuguuccuguagccuggagcagaacaugggcacugggaacgucugccugcuguuugcacccgugacuuauggcuguuauguacaaagcacagcucagccaugaacacaaggaaucaccauccuguaucuuggcaagacuucaggcaugcaguacauaguuugcucuguaaaaaagaugaagcacugugauguuggauuuuagcucaaacgacugcaaccuuuuaaaguugggcacauugguuguguguugucuuaguucuguggaaagucuccuucccucguauuguuagaugugcugagugccagacaaaugguucucuguaggcgagagugugcacagcucuuggaggcauuuauaaacuuggcgcgaguacuucagcuccugcauuagcuugucagccugggcauccggccaggaccgugccuggcucugagucacgcuggagcucugugcgaugaugggguuggagaaggcgcaggaugccugcucuucucuucugugcuucuugggagaugggcuucucuggccuuggcaagguugaggcccugcaugaagccccggggcucuguccuugggcaucagcccuaucugugggaaguucuuaggggaugcauagaguuuugcuccaacauuggcagcugcgggccuuaccucaaccgugucuuaggccaugcuaagguggcaggguuggagcucugaagagggagacaaggacagaaggcacuuauagagauggcacaugugggaugaaggcacuggacugagccgauggaauucucugggcuccuccuugugaccuggaugaaaaacaaaacccagcagucaccacaaggcuugcuuuggaggugggccugaggcuaacuuccgaaacuaccuuuaaacucuggacuuuuuuaaagggggauuuauuuacuugcuuauuuauaauguguauauaccugcagaguuugugugcaccacacucaugcagaccacagaagccagaaaaguauauugcauccccuguuauaugugguuauaagccauauaggugcugggaacugaaccugagcuucuacaagagcagccaaugcuuaauggcuaagccaucucucaauuucucccuaccaguucuuaacuuuuggugacgaacuuuuuuuuuuuuuuuuuaauauucuaaucugagcaccuagagaaauucuucugcugguauaaaagcacgggaugaacuaguuugaaccagugugucuguguauaaccaagcuuauuuucauccuuaggguuuucaaacauagcaaugugcaagggugcaugugugugauagggacggguacacuuuuggaugcauuggaagugaaggaacacuuguuccucuuuggggaaggucauagcagaggaggaggaggaaauugaaaacacaaugggcagaacuccgaacaacaguaagaucaaaaugaagcccuucaccucaaggaccgccuuagucuugcacuccaugcugaccuaaugacugcucgguuccuacauagugcagaggugaauacucugccauuggagacucauccucaguccuguguucaauucuuaaagcggagcgcaaagggagucuuggaguggggguagucggggcuucagcggucuggcuaaggguugcucagucaguaggggguagagagcccugggaugccgcauagcccuccaggaauccaaggcagucccuguccuggcauucaggccauuguaaauaauccuuauaagcccauuaucuuagcagagcgcugggaaagagacacagaagggcaagauaaaacagagcugugguauuuagugcagcguguuuggcgaacagcuucgggagcugcagaugucaggacacacagcgcagggugaagggccagcaucuagguuguuaauccaccccagaauucuagccagacucuaaggcaugccaugccauuguguggcuuguggguuucuguaccuuuguuuucuucccuggagugaucgugaaggucaaaagggaggagaugagugaaagccccucccuguuacagcugguggaucucugaaacagcagggauccugcaguguucuguucagcucccagcaugcuucugggauauguguguuaucaccugagcuccaaaaugguagcuuggagcuauuaucugcugaguguccaggacacuugaagggcaggagcuucugaggaucuuaagacccagaauaucuuagcguuuaacugaagccucauuuaaaggacucugccccauagggaggacauugcuguaacaugggagaccaguuccuuagaccuggggcaaaucuccgccucucucucucucucucucucucucucucucucucucucucucucucucucucucucuguguguguauguguguguguguguguguguguguguguguguguguauguguguguguguguaaccaauuacugaaugagggucucagagcaucaucaaaguuccuaccuuuuuuuugggggggggcgagcuucucaacuuccuucccuuuuuuuugguaaauuaaggauaaacaggaaaagcuuuauguaccccaaaccuaaaucucaguuacagcuuguaauucucuccucuuucagcuucuggcugaaugggauauggggaaugccagagccugggaaaggagaggaagccgccauagugggagccauggggaguguaggagccagcagacuuuccugggagggcuaccuugacuuacaauugaccugacucagaaagacuucucauuucagccccacugaauuccggugaaaaccccgcauucauuuuugcccucauuuuacagcauccagcgagcagccuuggugguucuggaaaauuacuacaaggacuucaccaucuauaacccgaaccuccuaacagcauccaaauuccgagcagccaagcacauggcuggccugaaagucuacaauguagaugguaugugcuugaaaccguuugggggggggggcgcacaguuagguggcucuguggcuuaaaccucauaguacguuugcuucaacccuguauucugugcuugccuuacggucuuuucucacuuuagaacaauuuauauuuuuaguuuaaauguagacaaacauuuuuuuccgggggaaugucaguuacagucuauauauguguauauauauaucaaguucauccacuuggagauuuugguauuggaaacuguagcuguguuuccugccuccugcugggaacacuuuagauugaaaguccucggaaaggaauguuuuucaaagucugagcuguuuaccaaaagacugcgaugcucucagggcuuucggccuagaauacuccacccuggccuagaaacguauucagccuagagagucagcuaucugggagcuccucucuagucucucaguccuggccaggaauggcaaccagaagcuggaggcagacucaccaagucagaggccaguuucauucagggugucagaugcuuaagugugagaaacaggacucccucuuacgucuugcugggcaccugggcuaagacaagagcuuugcagacucccagagagauucauguugucaguaagacaucugguuuacauagguaucaguuuuugguauuaguguucaaauauuuuuuuuuuuuuuaaauuuggcuaugugagggguaugacugguaagccucacccuugauugggaaacuuaguucucuaaggcacccagaagaaagcauuagguccuggcugugucuuugugauaagcuaaguugggucaugcucagggugauacgggacuuguaggucgauucacagauggggcggggcguauugcgguugcugggcuuugguguugggggagauagcacucggcuuagcuuguguuccuguguguggucacugucagugucccuugacuucucuuuucucugucuguccuuguucucccauccugcccacucucucucauuguccgcuguaugcgaugucccagcugcccuuauggccaaacugaaacuuuguguagcagaugguaagugaccucuucggcacgcuccggcggguguuguucuuggccggcguuuucaggggugagcaguuggcagccccuucagaguucuuuuuccauuuccccaucacacugggguuagaucuccuggcugccaugagcguggaguacugcgcaggcccagccaggggugcuccguaggggcgugggugggcgcuaacuagcagaccacagacccuggugcugcuucucggucccauuuccuggcguuuaccguuaaagcuaucuaccuuucuccuuucaucaaagggccuaguaauaacgccacuggucagucccgagccaugauugcugcagcagcucggcgcagagacuccagccacaacgaguuguauuaugaagaggccgaacacgaacgcagggugaagaagcggagagcaaggucugugacccuugcacgccugggcccuccucccgcugaacauuuuauucuuacuuaaaaaaaaaaauuuuuuuuaacuuccagaauuaauuuucuguuuguacgcaugcccuggaugacuguuuucagaccacguuacucucacguuucucagacuuuguguguaaucaccaccagacauaccucuaaacacccaucacagguccugggcccacuuacaaggcuuaccacguggucugugggccuaagccugggccugggaaucugcauucagagcagauuuccagggggcaucuguggcugcccuuggagggggcaagacccacccacaccauuucccaugugaauggaaggugacaaagguggcuucccuuaagccugucaccucauucuuccccuuccugaguugcuggggggcuggggggagggguaaguggaacaaggggacuaaagcucugcuugcuugcuuuucuuuucuuuuucuuuccuuuucuucucuuuucuugucuuuucucuucuuucuuucuuuuuuuguagccuaaccaggccuuaaacucucuguauagcugaggaugauauugaacuucuuuuuuaaaaccuuuuuaaacaucuauguguguguguguguguguauguacauguguacauguguguacauguaugugugcauguacauguaugugugccuguacauaugccacagugaauauauggagagcauggcuuuuggggauugguucuuugucuucucucacacgaguucuggggggucaaauucggguugugaggcuuggcugcaagcaccuuugcccugagccaucuugucagcuuggcuucucguguggccuccaccugcugagugcuggaucaggagcgugugccaccacaugaggugcuggggauuugucccaggucucugugguacugggcaagcccucugccaacuaaagcuacccaagcucuggcucuuuagcagcugugucugcacgcucgcuuucgcuuucccgauggagugugaacagaagucuuuauuucgcuuuuuaaaaaauuggauauuuuauuuauuuacauuucaaaugcuauccccuuuccugauucccccaacucagaagcccccuaucccuucccccuccuccuacuucuaugagggugugcccccacccacccacccacucccaccucccugcccuugcauuccuuuacacuggggcauugagcuuucauaggaccaagggccucuccucccauugaugcauaacaaggccauccucugcuacauacacagcugaagccacgggucccuccauguguacuccuugguuggugguuuagucccugggagcucuggagggggagggggaucuggcugguugauauuauuguucuugcuaugugguugcaaaccucuucaguuccuucaguccuuucucuaacuccuccauuggggacccugugaucaucaguucaaugcuuggcugcaagcaucugcuucuguauaugucaggcucgggcagagcuucucaggagacaccuuuuauugaagaaaucaaagcacagguuaaagugagcuuucugagcucauuauuggcagaacugggaggcccagcgauaccacccacccacucccaucucauuucugcuguugcuucucuucucccaggcucuuuccaucuccuagagggauacaguaugacagagccuuggggaaguuggugguaggccagggugcuucagucaauaaaggcccucugcaucuuaugggacuguccccagacccugcagugggcgcugccuugcugacugucccgaaucuccuuccagacugguaguggcuguggaggaagccuucauccauauccagcgucuccaggcugaggagcagcagaagucucccggagaggugauggaccccagagaggcagcccaggccaucuuccccuccauggccagggcacugcagaaguaccugcgcaccacacggcagcagcacuaccacagcauggagaguauccugcagcaccuggccuucugcaucaccaacagcaugacccccaaggugcgcugcuaggucggggcuggggcagaaaugucccuggguuuggccggucacaugacaucccaugucuccacuguugcucaccacguuauuuaagacuuacuuuugauuuugauaucuauguacuuguguguuucugugugagcaucuuucauguuuggaugucccuugcaaaggcuagaagaugacauucuccuggaacuagaguuacaagugauuguaagucuccuaauauggccaguaggaacugaacuugggucuucuggaagagcaauaaaggcucuuuaacuaaugagccgucucucuggcccaucaucuuauuuuuuuaacacagggucucucacugaacauagaacucagugauucugcuagacuggcuggcuagugaggcccuaggauccucccucucuuccuuuccagcacuguacguggggguccuaagaaucugaacauagauccccacacuuguacagcaagcacuguagcccugagccggcucccuagcccggaacaauuauuuuuugaaguacauguuuugaaggccucuagauucuauaaugcugcagacuaucccccuuuuugggucuccuaucugcguggaacgggucucugguugcagguggacaaggaguuggugaaugacaaacagaagcgacacaugagauuguguagaaucugaauguaauuugucaaaucgagcaucaaacuuuuuauacagaagaaaauagggaaguugggugacacacuggcuagguacaaagagguuacuggauucuuacacaaaacagaggaaugcaaacacagaaggacugacaggaaccaacugggguaaaacucaguguuaacaacugggaucaaaaacagcuccaccuaagguccacuuaaucuuagaagccagggucaagggcuucgugcccuugccauaguuccuacucuagucuauuguauaguccagcuucccccuaggccauuguaaauacuuguguauggguguaacucagcuaucuauaguucuaagugucuacucugguuccuccuuagaucacaaacuuccuucuuccuagauaaagguaaauuccuguguagggcagugacuuagcuauccaugcccagggucggaucaaggacugccuagaaucuaacuuagcuauuugucaaaguaucaauccuuaggagcacuuguaauaaagcaauauuaaaagcacacggaucuguuuaccaacuaaagcaaggacauuggagcauucuauauacaggaugccacgauuccaggagacuacguuuccaugaacuuuucgccucaggacagugcccagguuuucggggccugucgcuuauuacuacuggaguggauguagcacuauaacagaggaaaaaaaucccaccuggaaccaguacaguguaguggugaggguggucaggaaaauguguacacgcuuaguaugacaggaaaguguauguacacacucagugugacagugaagcauguguacaugaucagugugacaggaaaguauguacaugcugaguacaugcuaaacugacccauuuuaaccugggcccuccaccaacugucuugcuguacaaccuuggacaauuagcuucugguacugugccucaguuuccuaaccagugaauugaggauguucuucauaccucauguuaauucaugugauaaagucauaccuaucauuugauaaaagucugacuaaacagcuguugauuuuuggcagaaacgaugccaccauuuuggauguuguagacuuuguuuuuggaucguggcuuuaguacacuguaagggauagauguugcagucaucagcaguguaaauagaggacuggggcaaaaagagaaagggugggcacaguggguaucaugguggguucggauucucgcccauccauucaguugguuuguagcugugcacaaguuuuucuauaaugauuccucccguaugaagcagggauagcugccugacagaguuguugugugagggaugaugauaagagaggcuauaagcauguaagucucauggaagcauggaugaccuuggcauucgugcacaagugacauccaaucaccuuucaucauaaggacaucuuacucuuacacuucucacaaguacuaccagcuugggaaagccaugcagaaauagccaugauaaacuguaaggcuuuucauuucuuugauucagucgucucccacccaggaaaauauccagcacagcuguguccguagucagcucgggacccaucuguggagucggcuagccauggauggaaacauguaucucugcacugagugcauacacaugcacuccugucauacuaagugcauguucgugcuucccugccacccugagcauguacacacguuccugucacuguccacuaaacaacacaguguagcagcuacuuagcaucacaguggaguaggugcugcaagccauguagagauuaagcauucuaaaguacacggguaacugcaggguacaugcaaacggugagcccguuuauaugagagacuugaacaucagauuauaguauauaaggggcauccuagaaucagcuuuucaauuaguaucuguauguacaacucuacauuaaagguagguugcccacccccagaauauuauucuguguaacuucaaacuggaaaucguuuacaaaagcaagagugucuagcaugcugugguauaucaucuguugcaaugugggugaacacuugaauauuuuguuacaaaaguccacauacaacagguugcaaauagaaaacuauuguccccuugugcagaggaauagcuucugucaaggagaagggaccgcugguuuccuaucuccaggguuucuuaaaguugucugauauauucccguuucauuuuuuaaauguaugcuuucuuggauuuuuauuuaaaaaagaaaaguccaauguagaaaauuauguuuucagccagcugugguagauuaucaccguaaucacacugcuugggaggccaaggcagaaggcuuauggauucaagaccacccugugcuauguagugaauucugguccagccugugcuaccuaucagaaacuuucucagaaacaaaacaaaaacaaacaaaaaaacaaccaaucaaacaagaacaaaaccaaaaccgaaacuggagcuggugagacggcucuuuggauaaaggugcuugcugccaagccugaguucaggccccagaacuacaugcuggaaggagagaacugacucgggaaacuguuuuccagcacacacaugccauggcaugcauaggcgugcacacacacaaacucagagagagagacagagacagagagaacacaaaguaauuagaacccccacacuaucaacaaaaccgcacucugcccccaccccccacuccuuccaguucgggcugacguguguucucuuagcugagucugagucuagcuuuuaaggcagagaugcuuuaauacuagacacgccugcguuuuggaagccugcuuucuucacucaagguuucuuggaucauucauuccauacacucagaucugacucacgcagcuuucacugugaauagcugcucccgauuccaccagauauguagauuugccuaaccacuugucuguuggugcaccuuugaauuaaguuucacuggucaaagccagggguuggcuguuucugugacuccgauuucacuggagcacagcagcgcuuucuugugugccuaucaccauggcuacagcugcuugcacugcccggcagaguggaggaguuaugaaagaggauugcuugaaacccaaaaagguccucaccuuggccuaggaccagauggcuacaugccaguauuuuucaauuuauauugucaguucauucuuucucccaaccaaacugauguauguauuuaauuccaugccaggcacauuagaaagucauacuuuaaaaaguggaagacaggguugacguaguucuuaucuucuacaaguuugaagccucgaggggaggagacagcaagucagcagaguucaggaagugaacuauggcaugacgucaucgccagggguuucaggagcuuuggcaaaagaacacguugauccaucugagggauaguguaagaugugaaggucuaggagggauuucugggacagcucucagcaggagggauggcacaugaagauguaguggaaucagagaacuucagucugcuuggugucgugucccuggagcaagcacucaggagaggggacgugggucuggccauacggagcccuagccacacaugcaucaguucugcaugacagacaacacccacagugugccuacugggagugcuuugugcaccucuuggcagcucagugggcgagguugagagaaccgggcaaaugacugagcaaggucacacaaccagcaggugguagagccaugcaguuuugucugugcgguuguccuugucugucugcccaggauucacugacuacgucucuguuccaggcacucagccugcccucggggauucuuggcuuuagcagggagggagaggugcccgugucuucagguggcauguuacaucaacagugguagccaauccacuucccucaacucacccucugauuguaaauugccaaaagaaaauuccgaagcccaaggagucuuccuucuacagagagggucucgugggccuucagcaugagaggcugaacucuagucuaagguaugggguaguuggguaacauuuucuagggaaaacaagauggagccuagcuauaacgcacagcaacccuuguaacuucaccaauguucuuccuuggcuuucaggcuuuccuugaacgauaccucagugcgggccccaccuugcaguaugacaaggaucgauggcucucgacacaguggagacuuauuagugaggaggcugugacaaacggguuacgggauggaauuguuuucguccuuaaaugcuuggacuucagccucguggucaaugugaagaaaaucccauucauuguacucucagaagaguucauagacccuaaaucucacaaguuuguucuucgcuuacagucugagacaucagucuaaaauuucuauacuuguggcuuuaugaaaaacaaaagaauauauaaauauauauauauauauauguccaggaggaaguucuuuuauaaagauuuuuuaaaauucuucaaugcugacucaaacuggcagaggauagaccaguauccuucgaccaucugcacuuuauuuggaaggaagcaggagaugcccaccccaacaagugacuguuggcaucugacuuuaauagaugggacuucugaagaagcuguucccuggaguuucugugacagcuguaaaccaaaguguagcugcuguguguccuugggagccucgccuuacaacuggucccugccuguggcccaguaccacacccgccuggacuucuggucuaccaccucauagauccuaggggccucacuuuauucugcuucaggaagccaaacacuacacacccacuugcguguuugugcauguaguuauccacaucaccacaccacccuggggaguggugggcaguacaggaaauguccaaccgccugaguuuuuaaucauuuguugccuuacauugcgaagagaaagaaacugauaggaaaugugcacugccguuuugcagcuguuaagugauuggcuuuccauuuuccccugagagagagccuaccugcccuguuuuuggcccugcuccucuguuggcccuucccuagcccugggauugccuaccugggcuucacucuaacgcccacucuccuuagcaucuggaccacagcuguacauggugggcagccuggccaggcuagcuugguccuccagagaugucagggauuuggcuuuccaaguauacccacagcucuuugcacagccucucccagucuuucucccgagaaguaggguaugacucuggggaucuauucagccgcagcaccucccuuaggcugcagcaggagcccauccacccaguccuccucagcccugcuucacacaaaccaggagagaccaacacugugacucccaguuggcaggugccccauguagccaucuaauuucccagggagacaaguauucaacaaagcucaugugccaagcuucccugccacgggaaaccaaacagugcccaccacccuggcaacuacugcugucccaucccugagguuugugaccaccaccacugugcaacuuaucacaaggaaaagggucgcugggaaagggagaguugagucagccgugcagucccgaaggcuccuucugucagcauguuguagcugguuucagaggacaaugcccuugaugucccauuuguagacauagcugcuuccuggcagaguccugugcaggggagugcccaaggagucauuuccugacaccuuguagugggcugucccagucucugcuugccuacauccgaagcaaugcuccaccaaguacucuuuccuuuaucaguuucagggaucucauuucaggaaaggagaaggccgccaucaucuccgugcccauauauguguacccuucugucugugcauuccacgaaccaagcgauuuugucugucauuaaaaaaaaaaaaaaaauccaaauuggcauggaauauuugugauacaccugugcuuagaaaagccaauguuauuuuuuuguucaauaacuuuugcucagaaagaugugcuagagaaggaagagaaaccugugacacacacacacacacacacacauauaguguaaccaggugcuuuggucuuacuuugaaaccuuuaggucccuucuacuggaaguuccucaggaugucuuacucaggaaauauuuuaggagaacgagguaaggggugggcagucugugagagaccagcuguguguggaggguaaugucacagcagagcugcuccgccaccaacaccauucaguuguuaagugccauaaauguaaguacugcagcguuaaagguaacaucuuacaguacuaugcuuccugcuccugguuaaaccaugggucuuaaagggguuaaauuggagcccuguguugguaugugcauucccagaagggcaaagaacgguuuaaauuaaggaauuaauuuauuuucccuccuggccccucuccaucuccuuugcauagaacuucagacuuccugaaauuauuguuuugguuguaaauugaauaucgauuuuuuuuuucuucaaaaugcuuaaguuugcaucgauuccugaaagaaaagccaaaaucacaagcaggauccuuuaaagucuuugugcucccagcguuuuaccaggccgaguugacguggaagcgaacgguguagaggagaguuugcaaaagaaaugugaaguugcagaaagcugcaucacacaacugaagacaauaaaguuuuauuucauuucuuggacccucauagccuacucuuuuuaaaggauguaaauugcuccccaaggcuaguaggauacaugauccuauuagaggacacaggauuccauuaccuuaaacguuuauagauuccccccccccuauaacuucuaaccuaaguuauuaaaauucuaacauuaacuguggaagaacucaaugaagaguguaggucugagauugccgucuuucccgggugauuuucauuaucuacaaagguagauaagacaacuuuuguucagaauugugugcuuaaaaaaaaaaaaaagaaaaagcagucuuuaauaguccuggaauugaaugcucaggaagugggaauuaaaauggacuuuaagguuaugaggcucacacauccuuagguaacccguggggucaaaacugucuuggcuaaaguucauaaaguaaaugcuuacccaacauuuaucaucucccuucuuuccucuaacucccuuuugagaucugcaagaagacagauucuuuuuuuuuuuuuuuuuuacuuuuggguacuuuauugaguuguuuucccuacuacccuucaccucccuuaucccuuccaauccccugacacuagguaggagagagagaaggugagagaagaaaggggacaucggaauucuuaaaccacuuccuguuguuuagggguguugagguccuuggugcagguccaaucuucaucaucaucaucaucuggauauaagaagacagauucuuuauagcacagaguaugaagucaguggccuggguauguuugccuuaucacaauucacuguuagugugggcuuuucuuuucuuuucuuuucuuuucuuuucuuuuuuuuugguuuuucaagacagaguuucucuguauagcccuggcuguccuugaacucacuuuguagaccaggcuggccucgaacucagaaauccgccugccucugccucccgagugcugggauuaagaguguggggcuuucuaaugaauggggagacuggccaugcagauaagccuuagaaaggucuaggguacucgaucuugccaucuccugagucagaggugguggugagcagcucuaauuucuacaucaucuucuggagugcauguauuaaaugcaauagcuugcuccagucagagacacuacugcuacgaugaaacaccgugaccaaagcaacuuggggaggagaggguuuuuuugauuuaugcuuccacaucauaguucaucaucaagaaagucaagacaagaccucaaacagggcaggaaccuggaggcaggagcuggaggcaggaacauggaggagugcugcuuacuggcuugcuucucaaagcuuucucagucugcuuccuuauagcuuccaggaccacaagcccagggauggucccauccacaguggggugggaccuccacggauuacuaauuaagaaaaugccuuacaggcuuauccacagaccaaucuuacuaaggcauuuucuuaguuggcacuccuccucucugacucuagguugugucacauugacauaaaacuagccagcacagaguucugucugugaacuccuaccaacacacuguacucauggaaauugacuacccacucucaccacugccaaucauugacccagugaaccaacgaagcagagaccuugguuugcccucuucaacccuggcccugcugugcaagacucccuacagguggaugcaaaucagggaagaagaggaccuguucccaccugaacuucucggagugugcguugccauguuugcacgcuggcagucauaacauccacguggccagugacaagucguugugugucucguuuguacauguggguauggcugagucuguucacgaccguuccucaaagcuggcucauuguccucuccuucauucuuuauacuggcuucuccaugaggagcugucugugggagcccguugucaccuugcaggcaugcccauuucuuucuuucuugccuugggaccucugugaccuacaaacagcaagaaacaagaccaaaaccaggcaaacuuggggugggguguuacuguucaaacuucacuccccagggagccucccgugcaucuauuuaauguaacuuaaaagaaacaaccaaugauucgugacugaaauugacagggaugucuguaugaucauuugaagagagcccugcagcagagacccuacaauuagaacgcagcauaacguauuucuggguaauguuugcucuuuauggaucuuguuacaucagaaaaacaaauaaaucacuacugugaacuuacuaauauguaaucuuaucauauccaauuauaaauaaaacacgccuuguuuuuauguccauagugcaguucuugaaugguacucacagaaucgugagcagacaccaguucgacuccauugaaaccacguuuaauugaaugggugcucaaaaaaaaaaaaaaaaaaaaagaaaaauccaauuggggaccacauuuugugauuaacuuuuuuguguuaguauauagagugauggauuucauugugaaauuauucuaaugaaaauuaauggaguccccauuuugacaaaacauuguauuuagggaggggaagggaagggaagggaagggaagggaagggaggggaggggaggggaggggagggugcugacacucuccagcuguuacacaucagacacugugcagcacagcuugccccucccccacggugucuuaauuagggauccuuucauuugcaggugaaauaggagaaaguugaaagaagagacuugccugguugguuaaagggaucucugcaggugcucagaaccccgccccucugcccacucuccccagcagugaucuaagugguuuggcauuucuggguguggaggagggaccuggagacaccaaccgugagugggaaccugagucugagaauuccuugggagaaaggucauuucuuucccuuuggguuuauaccgcuugguccuguggggagccucaccaccaggcugaccuauugggauauauaaugagaaaaacccaagagacccuccucccaggaaagccuuaaccuggcaggccugggcugccgccacugagcugccagcaaccacagccauuugccuggucagguccagcugccucucucuguuggaccugaccaggccaagaggcuuacuuggcccuugggcacaggggccugaguuggcuuugugggugggagagcuaagguggcccagcugaggugcgauaugcgauuggcugcagcugguggcucuggagccuuuugucuggcuccuugacucuguucucagcuucucuccccuuccccauaccuacccuuuggacugcaggcagaguacacauaaaauagaauccaagggucaaaaggaaagaaaagaagaccuguuuuuccucugccccaccguguguaaguuauacuuugguugugcuguuggaggggaggauagacagagauggcaggauagugcucacauuaucccugcauugggaauuaagauucugaggguagacagagagugggaaacuccugauggaacaagagccccuugacuccaucugucccauuucuaccuaacuugcuuugccuaugaaacgugcuucacugguggauuagaguggaacggaguuuuccagccccauagagagauuccuggagccugaggcagugccggcaagguggcuuucucagaaaaguccaaagauucauucagcgagauaaagacacuuuugaauuaacucccagggacaaauguaacaaccuccagagcuuuuaucuugagucucugauucuuuugaccgugaaacagcauuaggauaaaagcauuugagcaugcaaauugucuggcuuugccugucuuucugucucucugagccuucagacauggccaggugcguucccuggugaauucauucauguagaacagugguucccaaccuuccuaaggcugugacccuuuaauacagucucuaauguuguggugauucccaaccauacauuuauuuugguugcuacuucauaacacaauuuugcucugcuaugaaucauaauguagacaucuguauuuuuuccgauggucuuagaagauuccugagaaagaucauucaacccuuccccaaaggggccaugacccaaagguugagaacugcugauguaggccuugccaaacugccagccuacaaaaacaucaaacaacagacccuugccuagagaauuaguuauggcgcugagacaccugaugcacagugacaaguucaguucacgcuauauuauaaguacuguaguggaagcauguggcauagcuaggagccaggaagggagauauagcccuugccuucaggugcuguugccccuccguuauagacaugaaggaauagucaucuaguaugaucacugugccuaaaaaugggaccacaaaaaccuguaauguuaauaauaucuuauuuuuauaaagguuacuccaugcuuuaacuuuucagauccucuggaacaccaaaaguaugaccugcuuaacuaaaguuaauuuuaaguguucacagagugugggacaccagcaaggaugcagccauggcaggcacugucccacccaggguaugaauugaacucugauaaggaucagaccagagauaccugggccaggcuuuaagggaaagguuuuuguuaccaaggauuuuaaucucugaauuuugaacccaacuuugauccuuaucugguagaguccaacaauacaaaauagauagccagagaccauauuauucuugaauacuuuagugccgugcuuuauaaccaagagaggcaguucuggcuuagccuguacuuacagucagcagauaccaugugcguaugaccacgucugaauauauguugcacucucacuggacauuuuugaacauauaaaugacugaauuauauggcuccuugccauguacacaagucucuuugugucacgaagguuugcuguaugaaauggauucugaucaugauguuggugagggcuggugucugucauggacacacuguaucuaguauccaacguuauuuggcuuucuuugggguccuccauuaguguccuccccuccuuccaaaugagcauuuacacauugaauaugcucuaaucuuggaaauugggguucccguuguauaccguuucucugacugaugugaguaucuuagcucuaaggucuguuuacuucccagggaacaucuucgaucuugauuugauuuugcagcaaucucacauguuccugugacaaucaggggacgugugauagaggaggagggcaaugagaggcagugaucagaguuacggaaaacgaacauuugccgaucauuuuauggcgagggaaauucuaagugaauaggcagcaaaagauaaaacccuuagguucucaaaccuggagaggaagccaaccuugugaguaaauaaaaaaaaagagagaaaacaacaaccaaaaagaaaaagaaaaaaaaaaaaacauuugagauguggaaagcaggagaccugguauacauuggauaggggcgugagauauacagacagacagcuguguuugauaauucguuuucccuugauaauugauuuuaaauuauugacuuacuuuagaugagggagcuagauuagcugcugaagaaauguugcugcuuucugccucuguacucagcuccccuucccuugcguggaauguugauagcacacacauucuugccaguuucauggacagggaucagagaaagcaauugacucggagauacucaucguauagauuaaugauaagcuguuuccuugggccaucagcccagaugcucacaguucauaaguucacaagcaaaaccugcuggaacaaaauuaaagccacaugcagacggcagccaaaggcccuuuucucuuucggucuuuucccgggguuguagcuguagaauguggaggaguuuugagaaucuccgaugguaaacugucacauuaaggaaguggggugaagacaucaggacagcaguagggaaaucccagagcaagaggcagggccugcuggcacagauaggaucucaguuguaggagagaggaggcuacucaccauuagugccaaugugucacgggaccauccucuaguuacacaggcucaguuuccaaacuuagagaugacuuuuggcucugcuuucugggucaauguccacagguguuucuguggucuaagucuuuauaauauuucaggaaauaaugaaguugccuuuuucagaacuaaagcugggugcuucggacauuuuuuuucucucuugcuucucugcucagcugcuccauuuacaaccugcuuguucuugccuucccuaaucuaugugugacaaaguuuaggggucuauuggucuauagacuguuaaaaaggcugugaguuuuaaugggcgaguggaugaaugagaacagaaggacauucagcaucaaagcacugacuacaaacuaaucgaacgguguuacauaggaggagcgucaaggcugauggcagucccagcguuaucacucugacuugcaguuaucgauaaaggguucagauuauuaaaauaucacacugauuccaaagacuccucuuaauccaucuugcaaauauuuuggucugcuagguggcuguggucauuccauucccucgugaugugacacuucuguacuccuuucuagcugcugcucagucccucacaaaggagggcuguguuucuggaggacuuugcucacuugaggaaaaaggucacccuacaugacaagcauccuuugugagcugagaaguuuuccuggucggcuucuguagcagucugcuauccuaagcuaauccaaacagcugauaccaugcuaccaaaagcuguugguuuauauucacuuuaaauaaucacuggguugaggaguguguguauuuuuaauagggauaauagccaugagggucaaguuguaucauguuuauaaaguugucacaagauuuauugcuugcccacccaaauuugggcagaguagaaaugacuaaaacagucuuuccccuaagguugcuaucagaccuguaugugaagaauguguaccacugaaagugagauuauauguggucugcacaagguacagucaugguuccucacagcgugacaaacacgaaguccagaagaccugaggggucacacucucuucuagaaaaggcaggaucuuuucaaguucugagaugcaguuucaucaacacacacugaagggggugcuugguucuagauaacauucaugaucuuacuccucuuuuuaacaggauagcagaucuuguguuuuuuaauuagcccacacuuuuaguucuguuugaguugauuaugaacucagaaugggaagauaaauggguucaagcaauaaaaagaguuauuggaaauucacuugagucuguccucagacaugcucugagggaaaaagaaugcaguguuuggguucuuaaugcaaauccuuuuaaguauaaaaugaaggguuaucugugacccuucagaguguuuguguaaugcugagaaguugcuugagcucucucugccucucuuuauuaaggacaguaaccagacgaaucuucuaaucugcuguaagaauuagcugugauaacauggaaggcauuuagcauuguacuccaggcaugcaagaaagugcucaacccauaucagcuuagagggcucaguacugacuacacagcaccguccaggcagaaccagauggacucccagagauccuaaugcaggaacaucagagcauaguuucagcuucacacauauuucuaggccucugagaauagcagaucuuccugggcugagaaacagaccacuuuugcaauggaccacaucccucaacuccuuggcuacuugaaaguuuuggcauugagaccucgaaggacaaucacuucccuaagaguuugcuugagcuuuggcugggcuuggguggguggaacacagcacagccugcuuaguuuugugaggggagaaaauuauauugaggcccugcuuuauagacugaauuaugcauccccaaaaucaugcauuugaacacaaggcccuuucagaugauaauuacagugaaaugaagucauaguagcaagacuuuaauuugacaggacaggcauccuuucagaagagaauuaccuauuuacuacuauauaucuaucuucaucaucaucuaucucuaucaguuaucugucugucugucugucugccauaugcaaacagaaugaaaagccaccaaaaaagcccugagcaggaaccaacacaauuggcacauuggcauuagacuaaacugugaaaggcagauuuuuacugaauaacccacccagacugaagcauucugcugugauaugaaugugaguaucuuccaagacuuauuauguauugaaaacuugauccccgaugcagcuauauuuagagguggggcuuuagaggugaccagaucgugacgugacuaaccucaucuuggcuuguucugaguucacaacuguguggacucucaggagacuagaaaguaggucacuggagggagggacacuaagggauaguuuggaaucccgaucccucccuuguucucugugauuccugacugcagugaggccagcagcugcucccaugguucccuucugccauagcuccagcugcaggcuguggaggcaucagaccuuaagcuaaaaccaaugauauuguaagcugaaguaaaauccccucuuuucaguuguuucucucaauuauuuuguuaccuaacacagcgugaggcaccuuaugugcccuguaaacuccacugcccagcacagcgaggcaauggcagcugcuuuggcugacccguuguucaccgauugauucaauaacuaagcucugcuuugugaugagcgaagugcuuggaauacaaagauaaguaaacgccuugucccuuaaagccuguauuuagugaaaggauggccaugcagugaguuuuaucaauucaaugaugagugcugugaccacgagugugcacccagugccgugggagcagaagugagcaaggcacuuccaggcaccuagacaauggcauagacaguaauagcaaucauccaggcuggggcuucauggaaaggacaagcgucgaggggaaggagaauggauaaaggcuuuguuguguugaauuugaaguuugcagcuugaauccaaguggaucaaacaccaaggucaaagaugaaggguagagacccacaguggaggucguuaacacucggguagugguugauggguguggaugcucaugccuggagacauggauaguggggagagacacagugaaauacuaaaccuagaagggcagccagaggugcagagagguagaacuggauccagccaggcaaaacugaacaaacccccaaagaccgggguaggaucaucaagauagccucgaucuuuucaaaacaugagucuaauguccauuaguuuauuacuauuccauaaaaggacugccccaguuucaaaaacaacaccacacagagucuucuccauguuaacagauuucaaaaauaaguuaggacacuuagcaacuaacacuaccaagcacacuguuacuuucagacaauucaaaaggcacuuggggauucuuuucuuuucuuuuuuuuuccuuggugccucagggcaucgugaacucuuaauggucgcugcccuggucaacugugggagugcugaugaauggggagaguuaauugaccaguggauaaagcgauuuuaacucagaaugggacagcucacuagcggggacagagagggugcauucaguucccagcucacucugggcagccagcagacccauucagagaccuaaacggucuccaucagaaaaaugaaaagccuuuuauccuucagccucucuuaccacuggugaauauaugaggcuuggcaauuaaugggauguucauagagcuagaugacccccacucaucauccuaauauuccagaaaugauggcaaugcccacacauuucaaggcauuucuaauugacauccaaaggcuugggucugaguucacagaugcucuggguuuggcgggagauuggauaaucaugugcccuuccuggacucugauuagaaggccacucccugcuugugaacuaauagcaagcugucaguucugucaccaucuggaucaaagacaguaaguaaacuugaguagaggugucaggagauacaguccccagacucccagaauuccaugaccccugauugucuagcaaagaacaagggcugauuguuccucaaugguuagaaguagucagcaugggaaucacuccccuucugucccugcagugugagccugcuggguuuggaaaggcauucacugaaauguaccacuccugccaagaacagacuagaaaaagaugcuggagaaaggaaaagagcugacuaggugugggcaccacugcuugcugcccccuugggcugucuguaugguacauggugguuguaaugucacucaucagaaucacccagggcuggagcuauucaucgucaucaucgucaucaucacugucuucauuauccucaucagaauuaucauuaucaucgucgucaucaucaucgucaucguugucaucaccaucaucaucuucaucuucauugucaucaucuucaguguugaucuuuccagaaagcacaucuucaauccagucuuccagcuccucagcugugggcaggucgucaucaucugggaucuccauccagauacugucagccugcaaugaggaacagaaugagcccaugagcaaauggguggaggccgaggcagggcagcauuuuccaagcuguguugaaugggccuccaagucucuaauaccuagcaggaauacauacagauagacaaaugcaaaugccaaguugcagaaauggucuugcacaguauucuguuucaauaacaguaaaagaaaucuguauucuacuacccaagagaauacauaugugcacacaugcacacacacagaauuaauuauuaaguaauuaauuuacauucagauuucaaacugguucacaaaagucaggaaauguauagacugcuaggguacuuucuauggggcaaaaagacauugcuaauuggcccuauucacaaaagaauauuccuguacuagcugaggugggcccucauuauagcuccuucuucccacuguuaaccucauugaaucugccccacuucugucuuguugcauaucagaugucuggacugagucaaaauuucuucccacucugucacaucaucccacuagcccuucucacccucaguucaucagugcucaaacuucugucaggagguuucucuucuguuaucagugucgccugacugcaggguggguggccgcuagcaugggauucugggugucaaucucuuauccaccuuagguaaugguugcucugggcaugaguagccuguguaagaaggccuuguucuuuaguucaggaagaggacacaagagaauguucuugggcggaaaguccuaagucaaugagucggguugggcuagcuccauaagcaaggaaauguacuccuagagaggguugggacuggcuagagcccagucuugggccauacugcaagaguuuggaaaagacccaaggguuccucacuguuguagacuccugagugauuuugugcuugggcuugcauagcugccaacagggugucugaccagcccucgguaagaauacucacaucgguuacauucaccaccccaaucuguggcuugaacaggucaaucuugaaagucuucucccaguaagcaacaagcugcagcaacaaaaaggccaaguuagacaguggguggagggcucucccuguggcuagacccaccugccagccuuccauaguagccggauagggacugguuaaaugccuuugaaaacagcuguggacacuuaggaaauugaaggcugccuccagcauuagagcucuuuaaagcauugaguaaaagauacuauagcauuaacugugacaacguagaccauaaaugcuuccacagcucucagggagacuaucacaaagauggcuauucccaaauuugacucguucacugauauuauguguguaaugaaagagccauuucuuuccaccuccgcuucaauguuccauucuuaaaagcccuuaucuggugccucccagccacaugagauggcugggagaacucugauaggcucuaacuuggcauaaacugcagacacgagucaaaugucuucagcccagcagggcuccaucuggacaaaucucuggcuggggcaggcuaacugagcuaaagggguccauaaagcuaagaaaauagagguguucaggggcaggggucucccugguaaacacauggccuagaacagacugggauguugguggguuuggaaauuagaacugucuggagauugcuuggcaagaaccaaggucgauguagaacugcccaaaagaauggccgaucacuuaaaaguugacaugaugaagcaguccagggaaacugaacauacccagcauuaaaucaacagauuaauccuguaugcuucuguggccauggcuuucuuauguugacccagaauuaugccauuggcuucaauuaccauggaagucucugccuuugguucacccaaucucaauguguguaggauucgaugccagcucuugcuguccaaucaguuucacaagucaugaccuauguaucucacagccagagagcaaccaaacuuguaucaucacuaguaguuaaccuuaccagaaacacucaauagagcaagcuaugacuucacuaugagucacaguaggguuuaacaucugcucaguuuaacaucgcccuuucuucgugagauaagaauuauaauaguaccugguuuuagggcuguugagggaaugagcuaugaggacaucguuaaacaaauaacuguaaucuaagaccuauguguuagucuucaaagcauuugaaaagacccagguucuaugucaugcagugcuggggauccuggcucuuggugccgcauugaacuuggccaauaaggaacuuggccaauaaggaacaauagcagaggauguggcuuccuccacuaucaucacuguguccaugcauggugugaauuccauguacuguguccaaaauuaagaauuaacaacgcuuucuugcuauugcucaucaacacaggcuagcaccaugguggcaaauuucuccugccuucuaaggagcugugacaaacaagcuaggcauggauucuguccucagacuggauucuccuuugcuucaucagggucuuaauucugcaauuauucccuaauaauuuagguugcuucuagaaucucagggagugguggguagagacacaaaggggucauauuauugcuuaaagaaggaauguuucuggccccccuggcuuggccucuccaagaguagucaccucuuggugucccagaaguaaggaaaaugguuagucuggucacuaccauaaccacacgaggcuauaggcuguauuaaaaguauaugaacacacuccauacgcauuagccucugggcuucuucaaacacauucaacuauuuuaguuugucccucacgcuugaauguuuuaugcuaaacacaaauaugggugguaaaggcccugaugggugggggacggggggagguuggccugggccacucaccaguggaaagucaucugggucaauccacaagaugcucaagucaggauugucaguguugucccgggcaaccuguuucaggaucucuaggaacucauagccaucugaauaggguucaagaaaguugagucagccagcaugcacacugcuccucaugaggaucucgagagcacgguuuuuccacaggcuuucuuggccaucugguacauacccucaauuacagagugagucuauaaaaugagucagaugaagagccgcagacacaaaggagcuucgacacagaaaacaauggccacuuugaacaaagaaaucugaaaggucacagggaaaggccccauucuaaacgaagggucaccuucaucuguucaccaggagaugaaaacugaguagcuuuggugaucauggccagucccagggcaguggaagcugucugccuguccccaauaauccuguauuuccaagccugugccguuccuggauuuccuacaacaucugcucuacagacuaagagcaaccuggaguccccaacaccuucaaauggggucagcauccuuccuucuucccauugcuccagcacaagcuuugguacacacagcuuucccugcccucugucagcagcucucucugccccagagaggagagcugagucauaggaaaagcagagacaagucuuccacacuuggagccuaagcccuacagcauacaguuuuuuuccauaagcaaaauguuugaaagaacauucaguaagugauacuauaaacccugaacaccccccgucccccccccccacacccaacagagcagagacaagugguuugauccugguaggucccuggcaguaaauguguguguguguguguguguguguguguguguauguguguuuauuuagguguauauguauguguauauguguauguguuugccuacacgugaagaacaaaguccuguauuuauauaucuacaugaagaaucucuggaaguucaggggauccagaagagaacucauacuuugcuaagcaauuaaauuaaggaaaauggaaaaaaaucaaggaagcccuuagcaaaggccccuacuacucaugcaagaaaguugugcaugagccaccaacagccagugugucuuagaaacaugagcagagaugugaucaagguggcaaauaugacaaugucuugcaggugggaggaggaggcuggggugaccugcuuggaacaaggaccacagagccagccgaacagacuucucaacagaugccaguaugugcagaugacaaagaucccauccauccauaucuggguaccaaggugucugguggggcuagaggaccaauugucagaccagcuuccaccauucaguagugcaucguucaagauagaaauuuuaaguucaguucuaaauaaugguuacgugcuagcugaguuguggccugagagucacgucacgcccucuggacaaacauagagcugugcuuuagaauucacaugcuugcugcuaagcggagggggaaggggaaaacagucuguauuggcugcaugcaggugugacugcaaaagcccagacucccuucuccaaccccaguuguccuugcugcuguuugaguuacgcuguaacuccucuucuggccuugugguaauguccaaggaggggguaauauggaacuuaauggagaguauucuguggauuuaugguuucagaugcauagaccagaagaaggcauuccucccagacaccugcagcugugacuccacuccucggagaagaaagggacaauaacugaggugacauggccaguucccuggaagaugggaugcaaaugugaaagggaccuggauagguucguaagucacaaagacagcaagguucaacaacacagaugauguucaaguagacuugaguuagugugaggcuggguccacugcagagagcagagaugccucaugccacgguuacagaggggcccggccugugaccaggccuacagcugagcacgcaccauggcacucccauguucuguucagcucaugugaugcugagauuucuuuaaaggaauauuacauacaagaguacacugcggcuccagccuucauccuagagcagguucagacacggagcaaaaggaagcaaaauuugggaucugcaaaacagugcauucaaaucuguguuaaacaaaagaauucauaaggcuuaauuuccauguuuaagauuguauauagggguguguguguguguuguguguaaagaauguuuuucauguucuagggagagcaaggcaaacucaaauacuaucuauucccagaacaaaaugaauacaguugacaggaacggcacagaaacuaaaucaagauccaaggacagccuugggaugccaaggcuaagaaacucuauaugcaccugccugcagcucuagggauuuucauucacuuuugugccacacuuauccacauggcucuugggaccaagugaccucagucccaaucccuuagauugucacuuaaggcaauaucuaagaugucaccuuuccuugugaauuaauggguucguaauaauaauagcuacuugucuuaaaguuugcuuuuacauccacuuaccuaucuucugugcauguacauuucuguggcucacgagggagaggguuguacacaugcuaccuugucauuguguguguggacaccagaggcuaaccugcugucucucuucucugcuguucucugcuuccauaacaugggucccaacguuugaacuugggucaucagccuuaacagcaugugccuuugcccacugagccaucuugccuaucccaguaauagcuacuucauggcaguaaagccccaagcugacaaagagcuccaagcuuguaaaaagccccugcuggaaucucccccucuuauuucuaagaguaggucccucuuccccucucaaagucugaccccagagcuguuaauccuaauacgcacaaaaucuccuuuucuacacuaccuucuuugauggacagccacaugccacucggccccccucuuauaccgagcucuucuggaguaggaugcuuguguuucaucuuugcauuugugugcauggaagauuuuacugccuucacuuuccagagagcuggaaggagggggcuggcugcugucauucauggguaagcaacagagcagaacaacucuggucuucaagcuaugcccacagccauucgcuacccguccucccucugcggucucggucucagccucagcauuccuaccacauugcugccagcuuccuuccuccauucuguaccugagacucccaagcccucugugaaacuuaguucucagggaggcccaggcuaggugagggaggagauguccaguguggccuugaugcugggaugugggugggguagagcggauugagggcugccucugcucuucugacagagaaaucagagcaaagucccagcccugauucugaacaggcuccugagcuguguccuacugggggggugggaggguggggguggagauugcucaaugcagugaugcuuuaaggaaaucuggagucuccgagauggagauggccuaaauacagaagccugugagaacugcaguucccucccaggcccuagacaccaggucugugaguucaggaccuagggcugaggcgcuggccagguuucccacggcaaacaaguggccccugggaauagcaucuuugugggaagagaacccggucauuauccuuuccugcuucccuggcagaggauggugggaaugagccugcaccaagcccuaggggaccagcucuaggucacucacggccaucuagggaaagggcccuuuugcagaggugauugugucucagaccaagccauggcccaggagcaaacaggccuauuaugcuacccacucugccccuucuucccaaccuccucuuuguugcuacuuauguucaauccacacagauuggaggaugcccuuccugacuccacauuacaggcagccgugaacugaagggucucugucugcgcgccuacuguggaauccuaucgucguccauguggcuggugggcagcuaggcaggcuagaggccaguuuuacccagcuuggaggaugccuugaagaaucugcucuuuuccuugggugugacuuucucugugcuacagacccagagccaggcugagucagaggugacugaagcagaggacccuggagcucucucuccaaaagccccaguggucuuuacuuguaugcaguucuguacacuuggaccuuuagggagugggaggaagccacaaggucaggaacucgacauuucaaagagcgucugcugcagcgauguggccacucagaauaaaagccacagugggaugcgguggcuuugaagaugugcuguagcaggaaaguccugcuacuccuuacccagcaucucaccuuuggaucccagaauugguguggggaaaaaaaaaucaaaugaaccauuuucacaauacagaggcacauggggauagagggauggacuucugggcuggaguuccaguucuuccucugccuguugaugagagcuggggcugauauuuauaccuucaucgugcgcaugcucccuccucuguauauggaggaacacagaauaacugccuggaucugcacgguugguauuugcuagguguguaaguaccauucaacacccagcaauaaucaaauagcgagguuaguauaucaaauuuaaauuuauaaagcuccaggaagcacuuagugcuccuauuggagacacucgaucuucaguccguuuuuuuuuuuuuuuuuuuuuugcaagaaucccagggcaggaaaagcucaggugcagcagggcuugaagcauccuuccagggccuguugcuaaaucuguucugugcuugcagacagcagccauccucgugugccuagcuuguuagugugaauauucccagugcccuuggaggguuuccauccagcacgcgcucauguagaaacgccgcguggcaaaccuuucaucagauaucauaaagaagaugucagcccgaugcagaugcaaacgcaucugggagcagccaggaagagucuuucauuuucaaaccugucacagagcucugcucugagcacaagcagccuaagagaaggugcaugcagaggcggguggggagcaacagcuagccagcaagucuagaaggccugggaaugcccucauguccuucccagccaagccugccuuaaggcacagagaugaaaccucacagcaagagaggccuacagggcccagagagcggaaguggauucuugucagagaaaagauucugucaagggagaacacgaacucuggauggaaaggucagaacuguaaggagaauucuugggggccaggucacuggucagacaggugcugcuguugugcuguaaugucacaguccgcaucgaggaacaucagugggccugaggaggaugacuggccaggcaugggacccuccacugccaaguggcucagcuccagucucacucucucggcuugcucuucugaucuaccagcccuugccucuuccccucagcccugcugcaacaccacacaagcuugggaagugguaucagagagaggaccacacccaaggggagcccucagcaaacaucaacucaguuuucuaccgugccccuaacccuguaagccuaugcacaccaccgaaccaucaucugugguucaaauguugaaggcagagaagggcagcaugggaggagggagacacauugaaugaucaccuggcugucagauguugucugagaggugcagaagucugccugccuugugguuaaggguguaggcuagaaagucagacagcccacuguccauuccagugcucccucagcuucggcauccucccuccgccuuguuuaauuguugugauagugauggucacaacaccaccuuugucacuacuccuggugcauauggaugucacaagggcugguuacaaugucaaccuuggcuuagagaagcugggcagugugguucaauuaguuagucuuuaagacuagcuuuucucauccaccaccagaauaauaacaaucgccacacacacaucacagaguggccucaggauuaacauggccaucuccucacagcuccucaacacggaagcucucuaagaagcaucugcuauccgggacuuaccaccuuccucuuucagaaagggugcagucugguuaggcauaagguuguggaugaccuauuagcaagaggaaaggaaucugacuaacucuuugcuggaaugcacucuccagaacuacaacccggccuggccugggggcccccagugugcacaccacugcgcugcccagcagguaaauguugccugaccacaaagucgaggggagggacuuucaucaaagcaacuuucaguuggagcccugagugugaaggcaccccugccgcugaaagaccauguuccugaccucugcucccaacauugcuccauuccccagggacaagccucggcuugggauuuggagaaaaggccgggcuccagggcccagggguguuugcacagggaggagguggaaguaguuucagcagcuugauucaugacugcagcaaucucugucaaacagguuucugcaguucagggagaccucuuuguucuauuguuccagacagccagacagaccucucugcaacccuggaagggggcaguggggugggaaggaagcccccuggaguccugccagcagcaacuccggaucacacaacaccaaggauccgauucagucugacuaaagccuggaaaccuggggagccgagggugccagaucuguaaaaagcaucugacacuacaguaaaaacaaacccccaaaaccuagaccccccugaggaacauucccagcuccgccaaguguaugaugggaaaccuggcaaaucguggacauuugaaaaacuagccugcagaucauuugguuuugaugcaauagaauauuacucaaucuuauaaacagccauauacugauagauauuauaauagauauuauauaguaaguguauauauaauaauacauauaugugagauauauacuauauaugucauuaugcuaaagaaaagaugccggauacaaaagacuccauuuauaugaaauaucuggaacagacagaucgauaauaaacaauuagugguugucaucaacggaagugacucgguggguguuguugguaaaggucuagggugagguggugccgacaucugcacagccuugugaguuuaaaacccacucagacguuacguuuaaagaauggcuauaaugguguguggauugucuugauuuaaaaacaaaaucacauaaauaagaaagaucuaaguacuugcuccacaaccauuccccgggcaccugcccuguuaagccgcugcgagcaaucaggcuaauacggauggaugagacaauaggucccuucaucacagucucccgggaugguauucuuuuggauugaguugaaccucuccagcucuuaguuucuuagacucag

SEQ ID NO: 7 - RNA, 101365 nt, Mus musculus
uccaggguugcuucaguucacuuuauaacuucauaacucagagacagauaugaccugcagaugaaaacaaucccuguccuucccaggcugcuuuugauugugguuuuuuuuuuuuuuuuuuuuuuuuaccacagcaacagaaauaaaauuagaauaccucccaagacaauuuuaaggaccccaaaaugcuuuacaaauguuaaaaauuacagaauagagcugagcagugguggugcacaucuuuaauuccagcacuugggaggcagagacaggcagaucucugaguucgaggccagccuggucuacagagugaguucuaggacagccagggcuauacagagaaacccugucucaaaacaaacaaacaaacaaauuacagaauagaucuuuuuuuguuuaauuuuugggguagauuuuaauaagaaauggaacucacuguaauuuacagugaccgugauauagaaccaaugaaggcuucuggcaaugaauguauggcaaaugaaacgugauagacauuccuguggguuuuuugguuuuuuuuguuuuuuguuuguuuuuuuuuuuuuugccauaaacaauacuuagugucuucaggaaaauggauaaagguggagauaacuauuuagugaaugaaaccagucucagaaagacagacaccaucuuccuucauuuacauagacacgacaaaucauguaugucuuuaugacauuaagguagaugugaaacuguccgaggguggggggggguggggacaaaggugacugagggagggcugaagggggagagagagagagagaagagcugugaggcccauggcgugugccccacauuccaucugacuugugaucaauuauuucaaaaaaaaaaggaaaaugaaacggguaauguuaucuaucucuggaaaccaagggaagucucacccugcuggcuccucucugggugcuuauucuguaauuuuucaacacagcuucuaaggauuucugaggacagcucugugcugugguagcaggcuuaggaacaaacccugccauuugaaagacacacgauguggacuggagcgauggcucagucauaaagaguaugcacugcuacucuugcagaggucacaagcccucuucugcccuccaugggaaucugugugcaugcacacacacacacacacacacacucauacacauacacacacauauauacacauacacacacauacaggcacaugcacaaacauacacaugcacacacacacucauauacauacacacacauauacacacauacacacacacauacaggcacaugcacacacauacacacacauauacacacauacacacacacauacaggcacaugcacacacauacacauacacgcgcacacacacacuuauacacauauacacacauacacacacucaugcacauacacacacauacacacacacucauacacauacauacaggcacacacauacacacacucauacacauacacacacauacacacacacacucauacacauacacgcacauacaggcacacacauacacacacacauacacacauacagacacucauacacauacacgcacauacaggcacacacauauacacacacacauacacauacauucacauacacacacacucacacacauacacacacauauacacacaugcacacauacacacacacauacaggcacauucacacacacacauacaggcacaugcacacacacacaccacacacacacucacacaaacagacuaacacacacacacacaauuaaauaaaacaaauucuuuuuuuuuuuaacgccuggucucacucuauagcucugcuugagugacgcacaccuuuaaucccagcacuuggaaggcagaggcagguggauuucugaguucgaggccagccuggucuacagagugaguuccaggacagccaagacugcacagagaaacccugucucaaaaaaacaaaacaaaacaaaaacaaaaacaaaaacaaaaaaagagcagaggacuugaguuuugguucccagcacccacaugguaugagguaugucuggaggccaugcugugggucugagggccauacagagcuuaccacaacuccaucuauaugagauucaaaccugcccuuugaccucuaccgcaccagauaugcauauaugcugaauauacauucaugaagucaaaacaguuacacagcauaaaguacaaauucacguauugucugaccuccgguguacucuggucuuuuuuuuuuuuuuuuaaguuuuuuuuuuuuagauauuuauuguuauacauaaguacacugucgcugucuucagacaccagaagagggcaucagaucucauuaugggugguugugagccaccaugugguugcugggauuugaacucaggaccuuuggaagagcagucagugcucuuauccacugagccaucucaccagcccuacucuggucuuuuaaauuuagccuaacuacaaacuugcggucaugacaacacucagacuuccagcuggguugcagaaauacaaagugacaguugauacagaagcucaaucgauugcuguuauagaaggcuuuaucuugggacagacaucuaagcuuaauaaaugaaucagaaccccagccuuguuauuucaagggacaauuaaugagcuauguguggaacuggcuuaaacacagccagguagcaccggagauuucgucuaaugaagcaacagucccugguggcaggcacuccuuguugucuugagucuuuacuacugcuugccaaauucuccccaggcacucugagguaagaauagccacugugggugugugagccuuaaugguacaccagcucccagacccaggcacuaguuccucaccccagaacagcagccuggguguuucaagaaucucauuaguaaagauugguuggaauaucagaucccuaaagagucuauuucuguugucuuugcugcaaagcuaauuuuuuucaaagguauaaauugguaggaagagcugucuauggaucgaggcagucccccugggaggagacacaucaccagcagagagauuauagguccagagaagggacuccaaaguggaaaugacaguuaccugggggcaggugcaccugaacaggccagaacuugccucugagggacaagagucccacccccuauugaauagccuuggcccuggcuaaggaccuguuccucaaauguuauucuccccaccccacuccaacuuuccccauuucuggauuuuugucaccugauuugagucuugugagcuagguaggauaggcuggggauagcuggaggccacauagccuucauuaagccucaaaccaccaccuacccaggaggccuagggucuaggccuuggugaccucccccuagcccauaggaaggggcuuuugauggggcagaguucucuuugucccuagucagggacccaccuaucaucaucuacucacaggaguggaagaaaagcuucaaaacuagcccggggccuccagauuucuuccucuuucaucaggugcauuguccaaaggcuuucauaagaaggaagagaucuggagggucagaaaggccaaaccgaggaagaaaagagacaauguggcaagcucagccugcagcggcagcuagggccucauccccacccauuaggaaauccuaccacuccaucugauggccaccugguccaggcucagagaaguaaccgagccuccuccagaugacucuuucccagcuaauguggucagccagaauccuucagcugucauugccucaagcaaccagggcacaagcaucuccucgcuccacauccagacugcaacgucaggacacauaggaaguggaaaugccccuccuccucucccgagagaaagccuggguggcuaaaguuucuucccagagggggacaugaacgacaucuacuccuccuaaggucccaaccacaaaccaaggugagaguccagcaaagcuuucuuacagagcaauggcuguggggcccugggcagggacacaggagaccugaaagcagccacacuggaagguggcugcagggugguggcuucccuguggcuguguacaugaagcccugcuguaugcucuaauucuucccagagaucccccccgccccaagaccaugugcaauuagagcagaauucauacaacugguugggaguggugauguagcuggauauugaggugagggcuucaugauacucccuacccuuccaucuaagaaggauggccaaugguuguggucucgaguucugccucuccucugguggugucuggaugcugcuguccauacacacuggcucagggaggacaaagcaaagcaggaugaggagucaccaguccaccuuucccuuugggguaucagagcgccauugcacaccagaccagaagggggaagcagagcccaagacugacaggauccccgucccauugggagccaguguggagugcauaggggagaaggccuuccccggggccaucuuuaaugaagcagcucucugaggccuucuuuucuuuucuuuuuuuuuuuuuuuuuuuuuuuuaaagauuuauuuauuauauguaaguacacuguagcugucuucagacacuccagaagagggcgucagaucuuguuacagaugguugugagccaccaugugguugcugggauuugaacuccugaccuuuggaagagcagucgggugcucuuacccacugagccaucucaccagccccuucuuuucuuauucauauuucauuauugggaguggauuuggauguauaccuuuuguuuggggugaaccagggauuauauauuuuuggggaagggugugaggauacucaggaagggaaggucauuggcugaaggcuggggcuauugagacgccucauuagccugggaaggcgucucaggugcugggcuacagaagugagugccuguggucaccucuguugggggucaugguuccaaagcagacauuaaaggcagggaggaaauagccccacuccugccaucucagaucuuugagauuuuggggguuugagcaaaccccacuucacagguucuuaugccuaucugguagcauguccacauacccuacaaacagucaacaagcccagaugggagggucuuugguaagcaagcucagcuggauuccugaagaugguggcauuuugccucagaggacaguccuguacaacagccagccuucacccaaggucaucaacacugaaagcacgcaggcaacccugacuuuguuccuggaguaugagcaucccagugaggaagagucacccucucugagggcugagggaaacccaaggcuacauagacuccaguguucaccaucucuguuucugaggagauggauguuacaauucuuauugacacagagugacuuuucaacccuggccauuucugguuuaucuaguucccagcucuccucacagauacugauggcaaacccuaaccaaccuuacuuacacccaucuuaacugguaggacagucuuucuguucauuccuuucuggucuaacuucuccguucucuuccuagguagggcaucuuaucuaaauaucaaguccagauaaagcuuuuugauagucuggaggcucuccugacauuuuuugaguccccaguccuguaauggccuggagccaucaaggacucaaguaccuuccccacagaccucuacuucaccgggcaaguuuccuuugacuucugaaauaccuccauuccuggaugcucaccaaggggcucuuaaggacaaauuucuugaaaguccccaauguccuugucucucucugcagguuccugguuaguggguuucuauauccuguaacacuccaugacacaccuguaccucaucaguaaggaagucagguggaccuacaggaccagaugguacaggacccgaggaccauaaaugaggcuuuccauuugcaguuuaugucccaacucuuauacccucuuggggcagaugccugccaacaccuccuaggguauggugucagaucuaaagagaggcuuucuuucauauuccugccaggcccaauucuagguuccuauuuuccuguuauggugggaccucucuccccaacauugcuccuggagaccaucauuccucgggguuuuuagccccugccuuuauggacagacccuagcaagggaagugucacacacccaaauuucaccuuggggauagccuccuccauacauccaucauuuagacuucauccuaacucuauagaagcaggccuuuuauagauaaaaggguucucucuuucagaggcucaaaucucuucacaaaggguccaggucuuggggccaugagucacacagaaaggaucucauuuuaaccauggggaccccauccagaagacaauaagcagaggcccuugugggcacaauaggugaauuuggacucuauguaguucagcuaaacccuucuaugaggccuucagggaaccaacaagcgagagaggaacucuuagguggaccccugagaugaccugagauggcauagccucagaccugauuaaaaauucacccaggcauuggaucuccugaucauauuaaacccuuucuacuaggcuuaugacagacaaagcacacagugcuaggaguuuuaacccaaauucuggggcccucacgcucugcgguaguuuggcacaguaaguugagaaucccaaugguaugggagcuggaucucuugccagcuccaaaggcauuagaucacucacagggaagauugagaaauacaguguaucuccuucagcccuccacuguggacccuggggacugaugaggcgggagggagccagugugaaacauuguugccggagcaccccaccguacuuggucuuaccuagccuccucacccugccucaccuugcuucaccuagcaaggcaggcagcauggagacuccaggacugaugcuccugcacuggcagcugugggaggugaggaggaaugccggccccucuccagaucuuaccucagccuuucuuaucuuguucuaaacuucguccaacucuuagcagccuagggccucccucaaaacugaguggauuuuuuagcgucucacuuuuugcuaagacauguccacaggcugagaaacaagaaaucuuagaagcacauggagacuugagcggagagcgaguggagaccaaguguuccucccuacauccugcugagaagguuagcaugccaacuacacagcacguauggugucugugauguccacaggacacaugcauuauugcagggcugaugcaaaaguccagugggugccccugagccaguauggggccacaggcuuccugccugugcuugcucuaagcauucccaugaugcuccucucaagccugggggauggguuaguuacaauagucaaccaugggaacaugugauuuuuauuauauuacaaaaacaaaaauucccaccgaaacacagcuaaaaaaaauaacacauuuuucuaaaaugacaucacccaaaacaguuaauagagucacuagacuguauccaucaauacugcuuggagaagcauuucaucacauugaaacauggacaauuuaguuuugguuuuugucucccaucugaaaugcaacuaaguggcaacuuuugacccuugcaggauucuugcguaggggugcugguucugcgaacucacaagcucaaagcagcccaagguagagcugucaggcacgguaagcaaggccaggaagggacaugggagcugcuguuaauuggaugcacaaagcuggaugggaccauacagacugaggcuggaguggccugcuuuuacagcccugcucaaccugcccuugcucaacagaugucuuccagggcacccccaaacuuguuuccaaacuaguacuccagugcuccugggaaaguugguggcuggaagauuugcuuucucuugcuuucuguguuuuguagaacaaaguuugguucagacccaaaggcugguuccuggagagcuucucaggcacugcaagcauugccucugugacguuuauuuccuggcagauggcccuuugcaguucccuccaggccugucaggauccuggaagcucacgagacagcuuuggcacuugaggcagggucuagggagacacaagcccuggguccuugcuggaggggggcucuucccuccucagaugccuggugacaaccacuccuccuaaccacuccuccuucccaggagcaugugguggggcgcuuaggauggucccuccuggacaaugccugagacauacuuaugugagaucccagaacgcaagcgcaucucagugggguucacaggccuaggagugagaaugugcugccuaguuucugagguagcauggggcagcauguaccucaggagugaacacccacuucugcaaugagcugaugcccgaggcagggcacucagucugucuagccucagcuuccucaucugagcagcaacaagaaguguguagucaaccucaggcuuugugaaguguguuaccacucacugggagggccacaaccuacacccaagaagcaagccugaugcugcagcuguuaacggcccaucugggugcaggaaccccccacccccccagagccuaagcugucaacaucugucaaguuggaaaggccuguauggucagcacuggucucugacaaugugaugccugcaccuacccuaagugcacccaaauccugccccucagagauucaugaagcauagcaugggugguaaccaccuaaguuugcagagcuugcuaagauugcuaagauuggcaacauugucccugggcuucgaggaggcagcccugauaugacgccagcccugguagugcugacucugaggcuaucccacggacgucacugccucuguugggccuugcuaaugaaagccaagccuaaagaggauggcuccaaagugacucggcagauguugggcuuuacuguuggcaggggcuccucugugcuucuccacuccuggcagggacugcugggggcucucauugcagaaguucacaaagcuucuggcagguacagggccccauuggcugaaugcaugcaggagcuguuucucuagccacugacucuuuggggaugaaucaugaagaccagggcccccagcagccacuccaguuccaggccacgaggaugggcuagcacucaggcacagagcccagacucugagcacuuagugagaacagauguuccucacagcuggggucugucugaccugcacucccacggcuaugcucucucugagucucuuucccuuccaaccauccugguaacagguaaggacccuuccuggauugaugcucggcguuuuagacuuguugagaaguacguguggacacacuaggcugaucucagaaaggaaugcugagagagucagagaggggggaaaaagcaagcugaccccaccaaguagaaagaguaaccuuuuaucaaauauugacaauucaauuuucgguagucugagacucauucugucccuuugucugaccagagaggucccuagaggcugcuacagccagcauguucagggugcuggcuagaggcggagggccagcggcuuccccugcucugccacagucuucccugaccccagcaaucaagacucgggagacaagggguaacggcagaaugaccuacauuagggacagaucuguccacacauccugcagaagaugucucuggcccugaauucacuuucaagacacaguggaaucgaccuguacguaagcgcugaugacacagaggcugggcugugcaugguuagcaggaacagaagauguuggaauacuuuguggcagagggugagcaagugaaggaugcugcucuguccuggagguggcagaguccucaauagagaacgggagaagcaaaugggugcugcauacccacccacaaagggacagcucccugucucagcacuuggcucaccaccugcccuuguguauauguagcuaagggcaguuccagaaguuuccaagagggaguuaguucaugagcgacuucccuucaggaauggcauccggcagaagguccuugcugguuucugugggcacagccaacaggucccacuuccaagagcaguuucucacagaggaaggacaggagaagaagguacguuccucaguggcucucugucucugugaacuccucuuugaugggcugcuuacgggacuugcagucaggcaggucaaagccaaaguccgcccacucgucgggaccugucaccgcaccugcgccuccacgguuggggaucgugaugguguggcgcacacggaaaugcacggcuuccaugacccgcugccgcugcagcucgccagagccgccgauggagaugguggccgcguugcugcuggagcguagcaguugcuggccgcagucauggcucugcuucagguccuguaggccccuccagauggucauacgguacuggucagggaccuucagagccccaagguccugcaagagcgaugggcaccuuuggguuacaagagggaagcuacagaguugugugucccucacaccugcaaggguguccuaccugcuaggaagccucugucugagggggcagcugacuuaucagaccuugacugugugggugacaggguagggacagcaucagggucaccugcacagaaugucuagucacauaauugucuaggacagcuagaugacauguguaggugacagaggggacagugacgagggccugcucaucagccugaggccuggacacagcgagaacagcaauggagaccuaggagaccacccaugcaucucuuggccacaggugucccuuggaagccauuaauuggcagcuaacuccaggcacauccuuuagcuucaagcucuggugagacaaggguuaauguaugacucaaggaugggaaagguaguggucaguggucccauaaaugcagguguuagacucuagccccacaaccucuuauaaauauuuguguccagccugaguuccuggguaggugacaaauauggccucuuagccugggugagagucuagaaaacaguuuugggaggcauggcaggaggggcugagcuguugcacucugggcccuggggcaggaggggcugagcuguugcacccugggcccuggggcaggaggggcugagcuguugcacccugggcccuggggcaggaggggcugagcugaugcacacugggcccuggggcaggaggggcugagcuguugcacacugggcccuggggcaggaggggcugagcuguugcacacuggacccaugucucauggauacaucaaggcagucuguguggcuaggcuguaacaggaugcagggccuuccagaagauuucuaucccacuuucaacccagaauguucugugucucacguguaggcuggauguggagacccauucauucuuucuaggucuguuccccccuuagcuucuacacuucucacacauuggguccuggaaacaacccugccuaagaaaucaaagguagccuggcugggccaccaggaggcucuaacaagagagaaagcucuccagguaacugccggggaccgggacaugugauugucuacccagucuccuucacauuaccgaauccugcugacuucagaacagaaucugauugcuggugggagucucugggaguuuccccacuagucacccuagucagugcacugugccuccagacagguccuccgucccuuuggaaagaccugggacauuuaccucgaugguaagguucugcaggugguagaugcucugcaacccuugggaagugaagcacucgaugcaguuuggacaccccaacccugucaaaaaacugcagagagaguuugagaaaguagcaucaacuggcugugcacucgggucucacaggaguggcccugacguggagggaacugccuguuacagugggcaaaacugcuggucccucccucagggcagguuuucuuuuuuauuucuuuauuuuauuauuuauuuuauuuuaauuuuuguuacauauauauguacauauauguguguauauauauauguacacauauauauguauauauguacauguguguauauguguauguguguauauacacauacacauacacauacacauacacauacacauacacauacacauauauacguguguguguauguuacuuuuauauuuuuacaguccaaucauuacccaccucuccuggucugaccucccacagcugcucaucucauuccucaucccccugucuccaagaggaugccccccaaaccccuccaaaccccacccccacccucagugccuaaccaucuagugccuuucucagcaucugcugacgagcccugauaggccugucuucccucaggccagccaagcaauuaaaacagggucagacagagccacaugcaaggcugcucccuccagcaggaaccgcacaguuagugggaggcauggggugagggguggagggugaaccacaaacccagauccagccgcgacccacacaccugacgaggcuggggucugcaugauagggggguggcggggugcagugggaucccgaaaccauggucugggagcuguggccuccauucaucucaccauuggccggcaugcuguggccguggcuguugagcaucccggagccugggcaaaagaguggucagggaaccugagagcaagccccacacauagugggguaugucccaggcuguggucuagccuggcagugugguacagcauuguaaggguucccuacagcugccucucaaugaggucucauguccuguaaccccugagaagaggggauuugguguugccauuuuacugauggggaaacugaggcuagggaucuucuucaagauccuguggcaggcaugaguucuuaacucuaccaccuuugcaaccucccaggcauagaacuccugggauuggaaugaacgccuccauagccauugcccuccugcaggcuggagcugcaggaagagguggccaucaaaggucccccgccauccuguuugugaucucgguaaauccacccaggcccucccuugggucucuaugacccacaugaggccuccaaugcuccagggacucacccaugggccccagguugggcccagcugcugagcugugcgggggaggcuggcccaccagcugguugacggagggcaguuuguugacaccaccguguaccuuguucauuggggagagcacgggcccauaggauggaggcugcaggugacuccugcuuggaaagcaacagugcgcauucgcaagagguaaaagcaacuccucccccacgugguaccucuguggacacccugggaugcagguagauguagacccugccucucagagaguuaggaagaaagcuaacaccucaccagcuucagcaaauacagcccuuccagucccuuccccauccacauuuccaaggcccuugugugggaggcaggggugugcugaacacagggacccaggaucucagggcaggcuaagucccagaaggcuuccuggaggagaaggugccagcugagcugugcugaucuuacaguccaguccaguccaggguaccauaccuccugugcuccuggcccucucccugcugggucagaauaucccuacuuccccauacagauggugggguucacucacggccucuguaggagcugcugcugcugcugcugucgauaggagucaaccaaaggcuggggcacaagcuccaucaguucuaggcucuccuugacuuucaucaagaucucaaaguucucccggccucgcaccugggcacagaaaaacagagucucggcccagguaccugggagauuccacuggccccaaaccccuggugggacggggauggccguagccucaggaggacuccaggcuauggcaaaguguugaucugcucuuggaguuuccccguaccccaacgcucaggauacucuggcuuuccucuucccaggggcagguuuagaagugggucccucgggguucagagaccauguuuauucuucccugcuaagaggcucuaaguuauaacagcucuaagucuuaaaggaggacucacaggcaaggaaauagcacucuuucggagugcaccaugaucuuaccacugggauugguaccacagucacaucgagccauguaggcugauacccuauagaacuauugauuuaaacacaggcuauacccuauacaaccauggauuuaaacacaggcuauacccuauaggaccauggauuuaaacacaagcuauacccuauagguccauggaguuaaacacaagcuauacccuauaggaccauggauuuaaacauaggcuauaccccauagguccauggauuuaaacauaggcuauaccuuauaggaccauggauuuaaacacaggcuguacccuauaggaccauggauuuaaacacaggcuauacccuauaggaccauggauuuaaacacaagcuauacccuauaggaccauggauuuaaacacaagcuauacccuauagguccauggauuuaaacacaagcuauacccuauaggaccauggauuuaaacauaggcuauaccccauagguccauggauuuaaacauaggcuauaccuuauaggaccauggauuuaaacacaggcuguacccuauaggaccauggauuuaaacauaggcuauacccuauaggaccauggauuuaaacacaggcugaacccuauaggaccauggauuuaaacacaggcugaacccuauaggaucauggguuccuacugaaacuccacccugggggucuccauuauaaagggugcccuuaggucuccuugaugcacagcugacuuggcuggcauguucacacucagugaguucagggucugacucuaaacagagccuccuuugaaccccaccuccuucagggccacaguuucaauccucaggugucagcaugccacccuugcccaucucuggugacaucuguacuuccccagccugggaucuugggugaugggaacacacagaccugcccucccagcccacucacgugcauguagaacauguccucguccccguggcgucucuucuucacguugguacccagggcagggauggcaggggggcucugcuugaaugcuagaaggcaggucgggaaagauaaaugagccagagagcaaagacugagaugcccaggugaacaccugccauggguguggugugcacacagggcaaaccuaggcuggaaggagcuggaccagggucccacaugcuccuagccucagagcauagacaagugagaugucuugggccacauucgcccugucccgccuggagaggcuucccagccucagccauucagacccagauccaucuuuggaugaagcuaugcuuggcaccuuuggagcagguacuccccacacucaggugcauccaacuccacccuccgcccauacccugacccagagccccacucaccacguuugcuggcagcuccauuuuuggugguacuuucauucagagccuguugcucccgguaauggucuucaucagcuuugcggucacggccaggacaggcacagaugcgacccucgaaagaccggcggcccaggaccuguccacuguugggucggcacagcguggcugugagcucaagagaccacucuugacccugcccaacucccgcagaccccucgugacuggccuugaagcugaaugcccaccgaggagagcaagcccucccuguguccaugacaugcccccccacggccccaccucuaccauccuuccacggcagacucacucccgggucuccagggugaugaugacaaggaugggccuccgauucaugccccccacacagcugcuguuacacaugaaguuguacaggauggugguaaauucuguucccaccuguccacaggggagacaggggaagggcuuaguaucagucagcaugcagggcccaccuucuaagaaaaggacuuguagcugccaccucuggcccugguucugaggaggcauagggacgcugcaguaugguucacggucaucuacccaucuaucuacccaaccaccccaucuuugcacuuauccauccaucucgccacuuauccaccuaccauccaccaaaccauccauccgcucacacgccugucuacacauccauccaucugcucacacgccugucuacacacccacguauccaccuaccccacucacuugccggucaaccucucauccauugacacauacauccacacaccugcucacuugccuacccauacacccacuuacacuccugcucaccugcucuccugcccacccccaguggugccugacuaucacccaccuaccuacccacccauccacucacucacccauccauucagccaucuacacucacgugagauugcccgcccucccaccgauccaucugugccgucacagcccugugcuggcucugggcugagagcucagucuugguuucagcucuuaggggagguacagaguuuguggugugcuugcugcagucaucuuccuuaacacaggcagaggucaaaugucagggcuguaugugagugggugugugugagccuuugugucaagugugugaugaguacuguggacucaucugggcagaggaaugaaagggacuccauccccagaaaggaguuucaaagguuaggguacaaacgccauaaaccccaguccuucacagaacuuacaccugccaaccacuagagggcaagagaaaccuacguugugucucaugccugagcuggugaggcuuuuucugaugagaggggaggaugcuuguggggugugugugucugugugucugugugucugugugugugugugugucuguguguauguguguguguguguuucuguguucugugugucucugccuguuucugugugugugguguggguggguggggucucuguguuuguccauguguuucucaguuugugucuguguguguguguguuugucugugugugugugucuguguguguguagguguguaugucucugugugucucuguguaugucugugugugugaaucugugucuauguguaugucugucugugugugucuguguguauauggggcccugucccacugacauucaaagcugccucacaggaccccagggcuugguagaggaugggucagagaugagaccuaaccccaguccuccugagucuccgcccugauaccucccacaucaguacugaagucccuucaccuugccuuuggccccaacuggggcucauaucagaucuagaaggugaccacacacucuucuggugucaaaguggacagcugccuccuccagucuuccuucacuugucuacuuuuggcaaccaccaccuccagccugguucccucccuuagagcccucaccuguggucugagcccuucgccuccagccugaaccuccguauccacccugcaccucagugugcagcaugucuggucaccuccacuguacccuccauccagcuggcaccacucucccgaggcucugcacacaggcccucuuaaggcugaccgaucaucucugucuucccuacucuccugagccuguguuccacggcuccaaucuccuguaggcguccucugugauucccccagccuggucuaggaggccuuucaugaucacuacccccccacacauggaauugcccacccucuacccaccaccccaugcuugcuggcuugcuuuugucccugcaaauggagccugagaugucugggaacucuuucuuccaugucuagaagacuguacuugagagaaacaagcaagaagauugaagauuagacccuccagggagggcaggguugaaagguuggaggucauauaacuauaccucgcuauauagcugaggcgagagagagacagagacagagagagacagagacagacagacagacagacagacagacagacgagagacagacagagacagagacagacagacgagagacagacagagagacagagagcuaaaguuggcuugagcacaggcccaagcucgcugcccacagugaaaugaacugucaggaaaaggccugagaggcaggcugaggucagagcagaggcccagggaaccccacccuguaagguuggcuuuguaucccagccuggaccccgccuaccuguggggguucauacggcacaaccacacucugccuuccggugacagggucauccacguacugggcgagguuguugccuucuacacggaugagguggcuagccggggcagacuguccugccaggaggggacacagcuuuagagaggggcccaucuuccaucccauaccccuguaccaggcguguggcagaacugaggccacagggcuuguccccgugagagucccaggcaaggcucagagcugugcaacccucauuuagguggccuugagcgggacagaagcuguccccagauaaucugacccugggggugucacaggcuucaccagggacacugcagggaugcuucacaagauucuccaaggucagcuggucccucagacuacacccuugcuggaccaucagccucuuggacuguagucagagcugaggaaauggaaagagggcuaggguguggguuccugugaggggagaguugagagcagcuuaccgcugugcucacuggccuacaucucucagcuaugccucuggucagugucccacagcugggagggggagggggggcucaccuucauugaagucccuuccaagcucgugguuggggcagcgcuuaacaaugucggucacaugcucugccuucuuguagacaggcauggcccggauggccgugcccggggguggugguguggacacuuugaucuggauggggcaugucuuagcaaucugacaguacaacuucuucaagaguggggaguacuggaggagagaagggggccagguugagauggcagcucaguuccggaugcuuccacaagaccccuuucccaagcgcuccgaugaggccugcuuccagaugcuucaggcaugcuucagauuguagagaugggcgugccuggugccugcucaucaccugccuggcuaugugucucaccugcaucucaaaggcugcgagcgguggaccguugcauaaggaugacaaaggguaagacaguguugggggugugggucagaggucagugggaaucaguccuaguuuugcuuucccagccuggaucaggccacuggcugcagggguaggauuugcagcauugaggugguuugacgagcucagaauugcauccuucuaccuugcauagaagaaucacucaguagguggguggcuugccccuucugccuuugccuuuauccuccaauggagaacucucugaaccagcaagaccuugcaugcuguugaccagucaccagcacugugccaccaaguaaagucaccaaguccaggcagccaagcuguuguggggggcaagacccgcuuuccccauccuggaaacugacuggaccugaggucaugccaggaugucucucagggacaaugggacgucaucaugccucccccgcccccuccgugucccaggucacucuucuaaggauuguacuggcccugccaagaccaagucaguuucagaaucagagugagacuauucuaugcaaggcagaggaugcaauucugagcuugucaaacgggcucaaugcugcaaauccuaccuaugcagccagcggccugaucuaggcuggaaaagcaagauacccauuuauucaccugcuagcugacucucacuauggcuccugaaaccccuggugacucacuccucuugucuuccuucccaagugauuuuguuuuaaaagaucuaucuaucuaucuaucuaucuaucuaucuaucuaucuaucuauuauguauauaguguucugucugaauguacuccugcaggccagaagagagggcaccagaucucauuauagaugguuaugagacaccaugugguugccgggaauugaacucaggaccucuugaccucugagccaucucucuagcucuucccaaggguuuuuuuuuuuuguuuguuuguuuuguuuuguuuugguuugguuugguuuuugguuuucgagacaggguuucucuauguagcccuggcuguccuggaacucacuuuguagaccaggcuggccucaaacucagaaaucugccugccucugccucccaagugcugguauuaaaggggugugccaccaccgccuggcucccaagggauuuuuaugaagcuccacuucacucuaaagucuccaccacacaugaauuauauacaccaugcucccuugugacaguuaaugaagcugaggccagagaugguaagcuguuaacaaaacaggaaugggcagguggugcucacacaccaaaucuuuccuuugcaagggacagugggggauucugaccacccuaacccuauauagcuuaugguucuccacaauggaguaugcagaaauagcauauaccauaggcaaaugcaaugaagggagggcagggagaggcgccaugacauagucccuucccuccuguuuaaaaagcaagagauacucacuauagggaccccacagaaggcuucagggacuguuuugaaaagcugagagagccuaagagggggagcagcugagggagagcuaauggccacaccagcagguuggugugacuuucgggagggggggugaccacugucugcuggugugugggauccucauccuaacauucuggaggaaggagccacagccucauccccaggauacaugggggacucugagacuuggacaggguacaccugaccucugcacauccaaaucugggcuuugguuuuuugcaacggccucuccucaaguuaguacacugcagccuggucuccaucugugcaggcuggggacagaguagcaggaguagcugguucccuggggaaaggccaauaaacagcuacacacacacaccuguccuucagcagcagcagcagccugcagguguugggggucuacagccugcacuugguaaaaagcacacuagcucuguaauuacuguggcucccuaggaaggacacgggguggcaugaaguucacagugcgaggugccccucccgacauuaaguaaauucauauacagugacagugaagugcccugggcucuugcuuauccacaaaugaagguuucccagcaagccccaggcucagacaauugcaaaggccuaacggugaagggaacccagcucauccugagcucagagagacucaaccugaggccaaucaggcaacuuccugguaaaggugacagucccaagcauuaccaaacaucucccgagugcccauuguuugugaggccuagcuaccuaaagaaaauagacugagggguggagguggccaacacccccaugaaacaggccuugcccacaguggguuggggagacacugagaccaaagucaccaggggcggaaaaaggagauuagccuuugaaggcuggcccuuggcucccuguucuggcucaggaauucaggcuggauuccccuaaauuggaccaccugccagguuugucuaccacugacuuaccacucaacccccagaugccagcugugugguagagagccagcaaggucagaggccccuuauucuagcaugguugcucauuaccagguaagguaauuuguggguuggcacagcugcuggggcucauggaccuggagucuccuacagaguuaaccuuucccuccagugcucuagcucaugaacaaugaccuaagagggggucauagacccaccaaggcaggagccaagaugggcugggagcaagucagguguaauggugccuaaggccacauuccugggaagcccaaacaugccuggagggagaaagggugcaucagcuucaccuccguguucuuaucaggauggagccaggcucagggcacagcucagccacagggaggggcaucagagcuccccucacccacccacuccugagcaaugaggcuucaaaccucgccugaccacagugcccaucccuggagcccugcugugacccugaaggcaauuguccuuuccaucccuguccucugaggaccuaggauaauugguuacaaccccaaaccaugcacuaacacuaccaagguguggucagagguagcugaggccugacccuccuccccagaagguggcacuguuuuccauggccuggagugggacccuaggaggucuagggaaagcuaaggauaguugcagaguagccgggcugguaaggaugagccacugaaugccccacccuggggaggagcuuaaagcgccuggagcugucccugguaccaacucagcagcugcggaaaggcugucuccucucagagaaagaaucagaguugagagagucaucucuggugggacacgucucccacccggucaggguggaaggaaaauccaagcccaugaagauacauggcuccuucacuucugcacccuugaaugccgucuugaauccaaugaucguggggcuuugggcgcacacaccuaccagccccaccccggccacagguuaaguuugugguaguccauuuuagccagagguggggaauuucagcgagagauaccaaagcuuucccacaccuccgaagaucaggugguaaaaacaacacuccaggauaucgagucuccgggagacuaggaaguugccagcgcuccccuuccuacacagggucagacucuguuuccagaaugucauguggggaugcuuccucccugcugcccuccuccugccucuccuucccuagaaccgcuagauggauguguuucaacagauuccgagcugauaaaaucuuauuuaucuucggcuguugacacagcgccguccagacuugccugcgcggaugcguguguuccgcggggcuugcaggaaauacuuugcccaacaucggagcggagcagacgucccuccugccacggcugcuauccugaccccuccuccuccuucucucccucccucccccccccgcgcccccccucgccaccccccccgccaccccccacccccccccccccgccacaguccaagaugggccgggccuggcuggaagccccuagccuggcaggaccggugcaggguggugggugagagggcgggcgggggcgggcgcggcacagggcuguuaauuuccucgcacccgcucccggcagcugggugcccggcacaggcagguuugggcaggaggacagugggaaggugauaauaacuugucugucauuuucccgggacauguaguaucuugcaaaccgcaaauaccguuaaccagcuugggugaaucuguuaggacagauucagaacgaaaggcuguggugggggcuuuuuaaaaauacuuuuuuuuguagcccacuuuguguguguguguguguguguguguguguguguguguguguguguguguauacgugugugugagaguuucugaucucugaggccguagaccccuuugagaaucaucucugggaucacaggcuuuuacucuuccuagggcagauccacagagcagggcacaggucugguagacucagucugaucucucaaaucuggaggaacccagguccacagccccugaauaugacuccccaccauguuuucguuucucuuggagaaaugccacugcgagaggagcaaccuauggauccuaucauccaagaagagguccuggggcagccccuuuguggguacaucuuggccuugacucgcacaauuuacauuguucaauuauucggucauucagggagcaccugagagcaggggugagcucuugcacagcuuagggagccccgauagaaccuuagggagggaaugaugcucggguaaccgucaccggacuggcaccaucaagccaggaugcaggcugagggcaaggaggcuccauguucuauaaacacaucauuggaggccccagugccugccccugccaagugugcaggaaagaggcuguaguuguuccuaaagaacagcggucugaaagaagauaaaggacacuccgggaggcagaugugaagucugacugauugcucugugaguggaaggccauagucuguuccccuacagagagguuggccaggagcuagcuggggcaccccucaggagcugaguaaccugcuccccacccccgacccuugagcaagaucucaaacaggcaagcaagagccauaugggcaccuugguggccugggagacagagugcuuuucuuucuuucuuucuuucuuucuuucuuucuuucuuucuuucuuucuuucucucucucucucucucucucucucucucuuucuuucucucucucuuuuuuaaagaguuauuuauuuauuauauguaaguacacuguagcugucuucagacaccccagaagagggucucagaucucauuacagaugguugugagccaccaugugguugcugggauuugaacucgggaccugcggaagagcagucaaugcucuuaacugcugagccaucucuccagccccuccccccuccuucuuucuuucuuucuuucuuucuuucuuucuuucuuucuuuuuuuuuuuuuuugcacuaagacugggaagucagagggucccaggucaugggguuuggagcccauuuauccuuggcaggagcagagaaccuuccaguaguuucugccccaggcggaggagcugaugugugagggccugguagucucaucucagagagggagaagguagugguugggaauuugggaggcugcucuacauagcucugcagcugauggcuuuacauagagaccaaaggaauaacaugggcccggucugugcugcuuucucuguaaggugccuacucugacccuucaccuggacauuuuaggaacuagaauuuuguuucuaaaaguugccagcugagcuggggguagagcaguaaucagagguugcauugcauuggcuguagaccucggguuucugguaaaaugcucauaaaaucuagaggacugccaagcaacaguugcucuuuuacaugcuaaugacuggaugagggcugggggcuaagggcugggggcuggggacugggggcugagggcugagggcugggggcugggggcugggggcugagggcuggggacuggggccuggaggcugaaggcugagggcugggggaugggggcugggggcugagggcuggggccugggggcugggggcugggggcugagggcugggggcugcuuuccugagcaccccugaugaaaagauccaguuaguaugugugaccccucagccccagccuuugggacggagcacagaggaugaaggucaaucaggucccgaaugucaggagacuaaucauggcuacauaaugaagugucuguacaaaucccaaaggacagggcuuggucagcuccuggacagcuaggagugaggagguacuuggagauggugcccagagagagcagagccagagaggacugggagacucacauccuuucuccaucuugucucuuacuuccuuccccaccucaccuuaccccaugcaaaauuauaguuacaaaauagcaauaaagguaauuuuaugguugggggccaccacagcaugaggaacuguguuaaaggaagguugagaaccaccuuuggggaugagggggucauagaagucuuagaagugaguuccaguuugguuuugucuucucaagacccgacaccuccaucuuuggucuuucauuuccaucagacuuaccaggucagagaccagagaucaggauccagauaggcugguuaagaggacagucaggugaccaaguagaacaccaaaggcaggaaagacaggcagcucugggcugggguuguguuccuggggggugaggaagcugccaggcaggggcggggugggggugggggaaccuggccugcccuggucuuacugggaagugucuccccugacaucaagucaugggggggauggaggcuccagguggcugguuggcugggugcggcugaccuccuuugcuguaugaugcuccagcuccagaaggccacugucagggguuucagagauauuccuaggaggcccugucaccuccgucacuccagcccuaacuuggacaucuaaucuuuuuccaggacccaggacccaucuggggacuucaggaagaaaagaguguagucugagaacagucugugaccagauccaaagaaccauaggcucaccuucccugugaguucaaaggggccccugcugcccuucuuccugacccagccagcaggagagcugugccuuggccacuccuucaggcaguccugaguagccucuccucuggccaccagccaucagccucucccaccugugauuagggcuggggugcaggucacaggaccguccaguacaggaacccacagcgaggcugguagccagccugcucugugcacaguauggauccccuguuggcugucaguggugaagucccuaccccauccccagcuguagcuuccacagucgggaucaaccucaucagcuugagauugcaaggguaucucagggcagucacacauuccgcuccagcugugacccuucuaaacacucaucuuagccagcuccuucucuaaggaccugugacuuuccauacagucucaggggcuagugauagccaggagccagggaggcaaggugcgugcgugcgugagugcgcguguguguguguguguguguguguguguguguguguaugugugugcaugagugugugugugccauguguguguguaugugugugcaugagugugugugaauguguguguauauaccugaguguguguguguguguaugugugugugugcaugagugugugugugugaaugugugugugcauguaccugaguguguguguguauguguguaugugugugcaugagugugugugugccaugaguguguguaugugugugcaugaguguguguguuaaugugugugugcauguaccugaguguguguaugugcauauaugcgugugcauguuugaaagagccagucuucagugcuguaggcaauagcuccuuaaaauauaaguugucauugaacuuuaaacaucuuuauuggaacuauaggacagggacacucuggggucuaaaucucugaucuuguacugagcaaagcuagugagagccucccuggaaccaggcccaggugcagagcgcggcacagcccaucucacccuccccagguucagcaccaugagagcugaccuaucacagacagaggugagaggcagacacaggcgugggauuugggucacugaaugguuucugccuuaccuaccacaccaacaauuuuuccaaagagcaucucuaccuucagguguaccgcacagccggaccuagaacccgguuauccgaucucagagcgccagucuuagcccaccuuggcuucuugcacugauaaguggugguugcaggacccugacuuacagcucucaaagccuagaauauucuaacucauauaagagcaagagguccuggauguggcugugaccuuuuccuaagaggaggugacagggccugagccuucagggcacaggauggagucuaauacauuucaggugguuucccuagagccuaccaccagccuggagggcccagguaagcaacauucaacucaccuggaucucaccuggcaguguuagccaacuccugaccagcuuuaaccuaccauggacacucccacacuggccucuauccccugugguuuggggggggggugcugucaauggaggauugagugcuaauucacacauuacaaagaacuguccauuuuucagggcuggcuguguguacugggaguguguuccugguucacuccccgguccuccccucaggagaacuggugugacucuggaaggccuagagcugacccuuccucagacugucucacaucugcucaugccacacuggggagaacuuuacaggagaggggauagagacccgacccgaaugggcaucucgggaccccaggugccaucccucggccugcaguaggcauguauaccuccuuucccacuuuacagaagaggaucucggagggccggucaagggcaggucacccaucagcaaagggcagaaacaaaauggugaacccaacagcauaucccaagaguuugaggaacucucuuucucucugcccugcccacugcuccaaguucccuaggagugguucugggauccuaggagcucugugagcaggagcaaggaggcucugaugcccagaggcccgccugcuugccucaaaaaggggggccuggcuuguuccuuagcacugugcuggccgagagacacacuaucugcccaccauccucccuggguagauucauaaaugguuucugauuagaacguucuagaagugaccaaccuccaagaugaggaggccagucagaccuauggaacaccccuccuucauuuccuauuguugauucaugguacauuuccccugcuggacugagcccugcccugcaucucagcaucacaggauagaguccuguccuccaaggugcccugucuccuguccccugcuagaacccugagguaugugaugugaccacucagcuggggagggagcacccuuagacacagggaccagccugccagugucgagcugcaguuggauucaggaguucagagucuccaggcuagauucugugccuccuggggaccaaaguccuuuagaccacuaguggauggagagagcagacauacaucuccggugcagguacccugcucagaccaagccggagccagccuacuggcagcccauucucuccggcaaagcuagacacaauaugagcaauugcugcgauuucuccauaagugcucuuguuuccccuaauaauucacguuucaucuccacaauaaacauuguuagaacucuucucugggcuuuaaauauacauaauugcuccccgugccaguaaaagguauuaauuccauuuaugcauuccauaaacuuuuaggauaacgcaauugauaccacaaucaugucgggacaccuccucuauucuugugcuuugcaaaccuccgaggggcuggaaaguuugcuccaaauccauuaguguugacucagcccuguccucccuaagaaucccucacagaggcuuugugcuucccuccaggggcugcugccuggcuggguggguggguggguggguggguagguaggggcucucucucucaggacagauaagcauagacagacauaaagacagacagacagacauacacacacacacacacacacacacacacacacacagguugaaggcagcuucaccugaaggucacuuaagacuauguccaggcugucugucugucugucuaucuguaaugcucucaggcagucaagccauucaugagcgcgcccucacucuugggcuccucugcagcugccucuguaguaggcuggcggugucacagccugcccuugguguucuacagacaucauaccaggccaggguuaccauccauccacacggguccucuugccuaaccacagaacucugucucucaaugucuccaauacugaaaagagccgucucucucagcaaggcaaagccagggugaaggggcugagcuggcgcuagacagcagcagggaacccaucuugcuguuuggauauguaaaggaccuugucccacuuccuccuccacugagggacuccugagaccagcugucccccaggcagcaaccagggagauuagcaugcauguucacaugcucaucuguuggcauguguaugugugugcauauguacacacaugccggcauguuuacagguauaugugagugcaucuguguauccauauauauaggccccugagcacauauauauuuacacccaugugugcucauagguauauacauguaugcauaacacacaccuguguaccuagguguccgggcauaugggaccuugugcauguauauauacacguauguguucauacaugcagggucacacucuaaggucccagaccucuuauugcaccagcagauuuucaggcuaagggaaguuggucaggacaaguaaguagauccuuuggggucagagagucccacaguggcuucagcaauggcaagaccaaaggccccauuaacagcuguggucacuuagaggccagugagcauguuuuugccaaucugagaggaaugggggcagcagucaauauggaauaguacuugagaaaaauaugaauuaucuaucaguuaccagccgguggcguggcaggggccucgguggcaagucugggcagcacccacacaguuggacccccagagcugagagcagcugcugccagucccuucucucagcaucgagaaaaacccuugggugucugcucccagaucgccgaggugccaaaaaucucauuaucaauguuggucccaccucugccccugugugacagggccgggagggggcuggcaguagcauccuccugccugacagcucagcucugcugcccugguccuggguggaaguuggguugggaggccaagccuucccugaucuuugguaugucuggccagucugagcagacuaaccccuggggacaguuagagcagagcagcaggaacacaggccaucaugggacgcuugauguccagugccucagaggggacugcacaggacccaaaugggaggaagaauucaguagagugggcacugucaccccugucaaagaccagcccugaccaucagaggcaccugagcccauaggcacggcaaagagcgaccucaucaacacucucuggcaaggaagaggaagggaggcaaucccacauacagcaucaccagaucuuuaugacagacaggaccccgccucacucuaagauggagcuagggaaugcauuggaaguagaagagcagcguagagagcccgcugugacugagguagguacccaugugucuccugggcuuccugaccugacccuaggucacucagcuuggguggaggaagagccuagguccccuucaacccccaaaacuacagacagugcagaagaggaggccuuuagcagguaguucuacacaaagaccaacuucaggaggccauguuagaugguuuccuccacugucccaggacaggaguaacagcuguguacucuaccauuccugucucauucagaccuccugaccucagugccuuccaauaauuuguggucacggagaguggagcacacuggcccacagugacucgggauggagcaccacagguacccagacccucucggcccacugaagccccucagagcuccagcagcugggcugagcauucaauuggugauggucuagugacuggggagcccaccagaacaguagguaaaagaaacucuaggaggucaaagccugaaaccagagccagucaggcacagcugaucaccgguggccaccuacaaggucuggcucuguccagcucuucagucuccaaagagaaugugagagccacacugugggaguuaguuuuuaaagagccgcuggaggagagugagauagagcuugcacugcguggauggcugcaucuccagcugcucccuggagagaguggguggaugacuuaacaucccucagugcaccuccuacugucccaggcucaggguucccucuacucagacuuagcuggguauggagaccuggauggcucuagggcugcccuuccuacccaauguccugugugcccagaccagcguucugaagucccagucugcucuuccugcagccccaucucccacagagagccugggugcucaguggguaagaacacucacggccauguguccccaguccagcaucuacucacuuucugcauaacuugagcaaacugcuuucccuuuucauaccucagcuucccugacugugaaaugggcacagacuccaccuugggcaagucaaaguacuuagcugucugcccaacucucagcaaguguacaggugggacuuugucaacaucugcuaaucccagccacaugccagguuguuccuggaggcaccagggaaaggaccagagcccccagcaccuggagagccagucccaagccaaugcacagagagauaugagggcaaaacacaaacccacaacuagcaaacgggugggccccugugggcucccaacacuuucagcagaaguucaggaccagaccaauuucaaggcacugaguauagaaaacccggccacucuuccugccccauggaccucacuggcaacaacacucugaccuuuccggacucagugggaggcuggcugacucuggccacaaguccaagggguggccacacccacacugcccagccccagggcccgccuccugcucgaugcuccuccuggcucuggccaggugggaaccccauguggacagccugugugcucauucaguccucaguaccaggaccguggcacucaaccccgcugcccucccuucacgcauccacuggcaacacggcuacucacuguccagguggccgacuuggcagugcucgacugcuggaaggugaccucgaaguggugggggccgggguagucgguauuggaagggaugacaggcgccggagacauggugucgaagguggagcugggcugcgcguagggcgagugggugggcgcgcuggcggcgugcuccgggguguaggggcucgccggggccgcacggcugcccaucugguccauggcacugcugagcaaauugaacugggccuggcaaggaagggggaggugggaggggagaaacaagggcuaagguggaagccccagcuaccgcuucugucccgucggggaggugucuuguuacaggagccuuaaagggccagcgggcuccaagucaucccaaauauuuccuggggcccccaccccaccccaacaggccacuacuuguguugggauaaacgcacauucaccucuccugccugccccucuccguccgccucccgggugccagggcuucuugggauccacccagcugccagcaagguggauuggggcuuugcacaccuaccuggaagggagcuguuugguugggaaaguucccagccggagaccccuguggguaccaccaugcucccaggucagcccagaggcuggagugcucacauagaccugagagccuggaugcuggcugcaagggugggguggggguacagcaggauuuagagcaugggugcccuggaaggcaggauucuuagauacagcccucuaagugauggacuccgccaaggcugcucagccaccagagaucuaagugacagccuccagaggaauuuauuuaaacugacuuuaucuccauuacaaagccuuccccaggccuccaggguugguagcuccucccagcaucccugcugguucucaggcuagcccaggcagcccaguccuuccccuaaaucacauauucaaggaaccugagcucugggaacccucuuucucuguccuugggaccccaggacaagucagccuucccuaggagcuuuaaggaagucucaccuuccuuccuuggguguuucaacaaauuaucaaugggaggacuacccaguccacguccagagauggcaagcaggauuuggggaagacuacccaauggcugugcagaaugggucccuaaguguagaugcuuaaucgauccugucugugcugacgaaccuucccucaagcucagauggauucccgcaggccugaggugggcacuguccuuguccccacaucacagaagaggggcccaaaggugugaggcaggaaugagcagguccaauugaccagcaaucuacgggagacuagaucacgcggaagugugaucucagagcaaagugcccccuuuuaccccauugcccucuucagagaggccuuggaaccucugcacauauaucuccugccaccagccugccuccucuaagccucagaacaagaaguguuugcagacaacaagggaggcuaagacccaaggccuggacuggacacugccccaugccacgggucucucucugcuggggaccuugugcucagccccuccugugccucaguccaggauggaggaugguugcaggagguggccagagaagacaaggccucagugguccacugugaacccuugacaggaguuuuugggguuaggucagagucaaggaagcugauacagaaggaaggguccuacuaaggaccgcccagcaggagggagagcagcucaggagacaguagaaaaagcugagcgugcaaagggcaaguaacagucuaguuuguugguuuauuugcuuguuuguucuaaaaagauuuauuaauuuauuauguauacaguguucugccugcauguaugccuacaggccagaagagggcaccagaucacauuauagaugguugugagccaccaugugguugcugggaauugaacucaggaccucuggaagagagcaucuagugcucuuaaccucuaagccaucucuccagcccugguuguuuguuuuguuuuguuuuaagauuuuuuuaaauuuacauguaugaguauuugccuggaugcguguaugugcagcacacuuguguccugugcagaagcaggccagaaagguguaagaggauugguagaaaugaagguaaucuaaacuugugucugaguaugggaguuuaaaacaacggaccccaaagaaaugggaguuucccuccaagaaucuccuacuuggagaagggaaaggccccaaaagggaagauugucucucagaaagagacuucacagaguucuaaugccuugcccccacugaaacuaaacugcagugaugggucaccagugggcugccccacaccuugacccaguguuagaugagcaacuucuugguccucagcuuaaguuucacucucacuuuggaccccgaagccaaacuugaguggcucucuuugucccacuuccuaguguggcauuuggcuuacuaaguauggguggucaagccuggcugcggacacagagugugauccccagaucaauuacggagagggcaucagaccccccagaacuggaguuaugggugguugugagcugccgugugagugcuaggaaccgaacuuguguccucuguaaaggaaguaaaugcucuuagccacugagccaucucucgaaccccgagugcuggcucuugccacuacugugaccucuguacccugagccucugagaauccagcagagauuuccuuggcggccccagcucugggacacuggggcaucucggacucgccuucccaccaauaugcaaggcccuacuuuacuuggguggaagccuugucaaggggaccaaaguuuccauaggauaaaacuaucccucuacagaggggcuggguuuguaggacauaguccaacccaugaauccucccccauaguccuuccuaugccuucccaaauuguugugucacaggacaccugcccugucucccuaccucuaccccagggaaguggacaaacaaguuagaauugccacuggccacaggggugugauaacauagcaacaguguggaugaaauucagaaccuuguuuugagcagacacacagugugacuucaacuagguaaacacucagaaccggcaaagacagagaggcagaagccagacagagaggaggcacaaacaaggcugcuaggcuuuacaucgagaguggagggacucgggauuucucucugguggggguggaauguucuagaagcaaugcuuacauacaacuguucagacaaaagcuucugagcaguacauuucauuauuuacuuucuugcuuuauuauuuuuaguuucugagacauggucucaugucagccaggcuagccuggagcucauuauauaggaagcugaccuugaacucuuuccugauccuccugccgaugccucucgagugcugggauuacaggcaggcaccaggguacccacugugugcaguguugggaauugaacccauggccucauacacucuaggcaagaagcacucugccaugcgaguuacaaccccuaccaaacuguacauuuuaagugagaagauuguaugcucugugaauuauaccuuaauaacccugucuaaaacaggaaagcacccaaccuuuaccucucccagcaccaaggccauucaaagggaacaagggauacgacagcugcccccuucagaaagaggcaggccguaaaccucccacucugugggguuucuaggcugaggagaccccaccccacuccaaggucugccaacagacuccagguaggaauucauggucccacuucugcugagguaggaauuugagcaacaucaagucagaacuccgguuggcccagcacagccccccauucaagcacccccauucucccacgggccucugacaacagcccaaccgcccaguggaagccucuaccuuggucuugccacagucucugcugagcucagaggggcuagcccuggcuacagcagcuagagcgccugcaugcuguuggccuugaccagucauaaugcucuccucuggaaggcagcuccuaugccucaauugagccgugagucugugaggaaccacacagaacugaagguuggaccaauggcuacaaaggguuugagugugggaagaaaaguaccccaauggacucucugcacaccgcuaugaccuacaguggcaggaguaaguuauugauuacauucaccaguuucuuucuugguuugcuuuccagaacuggggaucgaacccacaauucacacacaccaggcaaacacuccucuacugagccacagcucugacccucuuuucaccaugugaaaccagcuacugaccuucagaauuccauacgugguucccauucuacccgugacccucagcguucaugagagaucaggcccaggaaccccacagacacccuuaaauaaagcccuuuauagacaguggcguaguauuuauacagagccugcacacauccccgagcuggcucacaaaaccuaacccacugcagaugccguguagccauuagaacacacugcuuaagggaugaagggaaucaugucuguacauguucaguauaaaugcauuuuuuccaaauguuucuggauuccuacucauuagaauuugaagaugcagaaccuacagagacggguccccacagacacagggauccugaagauacaaaggauuuaacagacucaggcaaucccacagacagauggcucuauagacacaggaucccacccacuguguucccugaguggugcugaucuggaccacaugaucccgauuuggaaugguugcucaaggcguuuucugucaggacaaaguggcagaggaaugaaugagugaaugaaugaguaagugaaugaaugaaugaauggauggauggaugaaugaaagaguuaacaaaugagugaaugaaugagugaauguacaacaaugugauaagucugaagacagcuucacacaucuaugugauagucaggaaggucacucucucuggugcggcugucuaggaaugagcagagaugcacuauggcucuaccuccugguuccugcuuccagggaucccagaaccugguuacauuguuucagauccaggaugaagcugcagcgccaccuccuuccugcaaccaaguucacucucuucccagcaaagggcuuuggaagaagucaugacaucugcagaaggcagcagcagccccuccgugcccgauccccaucauccuugaugggcagggagcccugucucagaagcagggugcaggcccacggcagcgagguucauauuuuaacuugucugcauucuucaaugauuggaggugggugccaaggacuuagucauugaaccaaaaggaacagcgauagcaucugugggagcuuaugcaggagggaccaggcgcuucgggaaggcaggcccucagcacuggggugcaaaaccuggcugguguggcaagcccggggcccucagagaggcaggccucugcagacuucuauaggggcacuaggcugcccaguagagucuguucccuugucuagugaaugcuggaucuccugugccugcucguuucuuacagucccaaggucaucuuccacucccucacuggucuuagugucuaccgugucucccaaagaugguaaagaccccagugacuggagaguguaagagacguuccuucuacacaggguucccuccuccugaggcucaugggaaggaaaccauuuccucauugccaggcagugaggcucaaccuggccccccacuuuugccucccgucaugcuguugaaaugagaagccucgucagagaggccuaagcaggucuacacagaagcccaggggucccccagacccagaggccccccggaagcccagacgagacccacuuggccucagggaagaaccugggcaaacccaaacuuuuuugguuuguuuugcuuucaaugagaacuccaagauagugggcuaauuagggcaugcccggccugcggcggcacacaugugccuauacuugcaaguggagugucugggcgugaccugaagaggcccugaggaaugagggcgucauggagccaaagggugucccuuccuacaguguccaggccacugguggaccagccuucaugggaaaggccaacaucagaauugggggacaauaguuccgauggggaugaggguuugagaacacggccccauugccaggucugugucgcucacuggacugugaccacagggucugggaucauccagaaaaccccagggcaauugaggguaagaccuauuuugggcucagacagaugggggucucagugagccccaccucuacagagaaggccaggaucucuuauucccuuagucccggggucucuuccugguccuugcagauagugcugcugggggcuuacccggcaccucugcuggaaacagccacuggugcuucuacucucuuuccuuaggcucagacuucaguauucacaccuugucucccuuggccucuucagggccuggggugacagcaggcuggugaccucgcucuacuagcagagggucaucagcauagaacacucacaacgggucccuuagguccccaagcuccugcuacaaggcagcugaguuucuuaucucccuugagcaucgggagacguagaugacgcugguucacuccucuagcacucucucuuggcugagcuagguugacagaugagcccagggugagcacuauaccuuggcagguagguagguaguaggagcaggagaggaaugggguauuauuccacaucccugggccuccauuuuuaucuucugcauagugagaaugaaauccacacauagcuugucgcaugguugugggggcgaggucugggagcaagaaaaccuauggcuguucuuucagaaggaacaacccugcuucagccaccaggacgccagaauccaggagcucugacacuuugcaacugauccaucaucagcaccagcccacuaacacaaggcccagugaggaagggacagagccugucugcccacaaggagcaaggcugucuccaaaggcugagcuccagaggcagcugagcagcgucauaaagcaggggacauggggaacagcagccggggucucacucuuggacguguacugguuguaccaacacguggcauugaaguggauacccaaccauaguuagacaagcucuuugaugccugauugagggcagggccucccccucuauccucuccuuucuccaccacucucuuguccuaaccagacaaggaggcucuuaccguccugcuaucaggcuccugcccucacaugcacacauuggauacuaugauuuuaccccgaagacucccaucucacaucuuaacuguuucuaaccuacaaacaaucucaucgaucuguucuuauauauguagacagaaaaugaacgaccucuuaaagguugggagcaggugccuuccacaccgacuccucucugacuucaguacccacggcagccuuugcuauagcacagaacaccaagacggaccucagagguggacuggcugcauccagugcuuagcaacaaagggcauauuacacccaauucccccgagaaguuuauuucucaaauaaaaacagugacagaaaagccugccugucgguugucacauuuaaaugcggaguuccaggagaauaggcugaccugcaucuccucggcaggagaucagccugcggagccauccuaccuccugaagccgccccagcgcucugggcuucccuuccaguuuaucuguguuaucuccggucuccccuaacccugcuucacacagaaacccuuuccgugacuccucugccucaguuuacaucgaggugauucggugugaugcugaugagggacucggagucaguacacacaaagaaaugagaacaggucacgguagcacacagggccucaagugugcuggguccugacccggcgcugcccucucagagaggcacaggcacuugacucugucacuguugugcuucugagaagccacacacaggccuccagaucucgccacagugacccaccagucccugauucacagccaccagccagaggcucaucugccuggccggcagggggcacccaccaucuccauacccuguauugagcaugcccuuucagaaggagaacuuccugugugcuggccucaugcugagcccacagcagcucugacagucuuccuggucccaccaauucuaauccucagccaggcucucaggaaugauaccaggauccccagcacacagcagggggaacucagccuuaaggucagaguucccaccgugguccccaaaguguacagagggaacaugggcucuuguuuguuuguuuguuguuuuuuugcuuuguuuuucgagacaggguuucgagguguagcccuggcuguccuggaacucacucuguagaccagguugaccucgaacucagaaauccaccugccucugccucccaagugcugggauuacaagcgugcgccaccaugcccggcugggaacauggucucauagaccaccggacaacuggagaguauggagcacagcccuacccaaauccagugaccucaguaggagaggauuuugccuaggcuucuacuuccucccuucccccacacuuucuccaucuuuuccugcauuuucuccaucacuuccucuucuuccuuucugucuucucuccuuccucccucucuccuucucucccuucuucccuuucuccuuucccucccuccucccucucccucccuccuucucucccucuaccccucucccuuuucuucuucccucucuccuucccuuccucucucccucccucaccucuccucucccuucccuuccucccucucuuucuucccucccucuccuucucucacucucuccccuucccucuucuuccucccuuucucccuucuuugccuuucucccuuccuccauuuucuuuccucccuucuuucuagaauuugcccuggccucugcacacccccuuccuauggauuucagguuaguuguggcccacccuagcuuccucacagaagcaacugggguaggaacuggagacaggagcuagcuuacagagcauagugugcuguggcuucucagguuccacugcgcagccuccauuccuuuaucccaacaucacuuccucgauucaaggcccagccucugggcacgugauuugcugccccauggccuucaccgcucccuuacuaggaaguaauucuggguaggggucaagaggcauucacccauccagcacagguaugagugacaugaccuugugaccacaucuguuuccagggaaucuugguguucugcaggaauggcucaccccagggcccccuggugacaaaugucacucauucugcucugagcccagcacugagggauggggaguuaggguccuccugcuuccaaaacaccagccaacacuguggauucuucuaaagggaagaaagcgucugaaaccggggucuuccccugcaggcaggucagagccuggguuccgcuugccugggguuagugacugacagcccccuggcucuguggagacagccaucucucccgccucugugcuagcuggagaccuccauccugaugguguuucccacagucuccccgagccuaugauuaaacgaauggaaaugucaacaagacaggacuugugcauggggggacggcugccucccuagagguaugugcauugcacccuccuuuugcccgccgaggcagggccuugcccggucccaugccagggccauguggaacuuuccacaccucaaacccgggaaacgugcccccagaagcucuacugggcugccaggcaugugucugcaagacccacccaggccaccccuccaccaacauagccugaaccaggguaucacagagcagagccuuccagggguucucuaggcagcucccccaucucuuuggcacugccuacaagcugcagugauucacaggaauuuuuaaaucaccgaguguaccccaacagcaaaggcgaguugucugucugagagaacagaagaggggacacagcucugccagcaccucucccuggcacauucuuguagucucaaauccagcauugguguucgugcauuccccccgcccccuacugccuuucugcccaucugucccauucaugggacaguccccacugggacuguccccauucaugggacagucaguggggaccucccgggcucuuccuaaaucuuaggucagggagaaacaaagaaugagcagcuaagcugagaaauuagauagugacacaugagauguucacuaagcgugaugugggcccaugugugucgcccugucaccugcagcgacccauagcgaggcugugacguugucuugggaccccccccccauggagaaggcaucccaauauaagcugggggaugggcugugaaaggugaggacaaaggcugcccacauauccagggcaucgacuggcucaguuaggcuccugacaucucuugguagaggcuucugagcucuccccucguaguacaguaacaagccauccagcuaaccagcauucaagcuuagggccuccgggacguaagggagaaaauacugaccaccaaagaggcagaagccgguguccuggaaggguggggcucugggaaaggcaagagcugccaugguuuuuaaucuguaggucuugugggauucggcaagguucugugugggguggcagggaaaggacccuggccagagcaagugcaugggugaugaacacagcagaagaggugagagagcauaacuucuggguucagcagagaggguuauaggcuagccgugcacaguccccuugcuuggugguggaggacaucugacaguggauccgugcacgucugagcacuggguggccagcucugaggcccuuggacacacagacggcauagaugagguguugugccggggaucgaggauaguuccaggguuuggguuugggccaguggagaagacuucccaccagcugaggugauguuuccuaggagcucagauuggcuccaugggcugacaccccaucagcuggcuuucaggggagcgggacggagcauggaaagcagaugcguuccaacacagcgaggggacugagaagggacauggguccaggaugaccuacuuggauccgacucugguggguaugccuuggccucagaccugauccuacuuaguucuacccuccccggggucaccagcucccucaaugcagcugauucuggucccuuuucuaaccuuguaaugggguccuuugucccgggucaccaugaagcccucuucuggcuuccaggcugcuccucaguguggcucucuuucccaaaauugucucccacuccucuuaacacagcccccuuccccgacuuaaauaacacucauguccacuuuacaccacccugcccuccugccucccacaccugaauguccaccuguccucucccacccauguaucuguccaucacaccacccugcccaccuaccucccacaccugcaugucugcuuggccacucccacccaugcaucuguccaucacaccacccugcccaccugccucccacaacugcaugucugcuuggccacucccacccaugcaucuguccaucacaccacccugcccaccugccucccacaccugcaaguccaccuggccacucccacccacaugcucaggcucuuugucuaccucccacacagaagaacccuacaguguuucuaaucaucacuacaggccuucuaagguaauuguggccuuguccucuagccuggucuuggucucacaucugaccaccuccacagauguccugucccggccacccucucuaccucaucugcucaacugcugaagcccccccccccccaaacacugcacagaaaugcccaaucucacuucucagccccugcagcaauuccccaucacagucgaaagccuuugaggccacucuaacacacuccuuccccgacaucuagccagucagcaaguccagugcagaaucuccagaauuuccucuacucugacuucccuaggugcugguggcccccaccuggaccaaaucccuucucccagucucggcccugcccccguguggucaguuaccagcacugcaccagcuccacucgucuguccuacagcucuuuccuguuacucggcuaccuucucucaccuggggcugcccccucgggcuccuccgguccagaagccaugcuuucugcaggagcacagggaagccugcuccagacagggugaacuccagcccugggcugugcaugcacgucuaugcugccuuacacaagaguaugagguauucaugcaccacuguauauugauaugugcugugcuauguguuugugugugcgugugugguguguuuguguucauauguguguguuugugugcaugugugguguguuuguguucauauguguguguuuguguguguaugugugguguguuuguguucauauguguguguuugugugugcaugugugguguguuuguguucauauguguguguucauauguguguguuugugugugcauguaugguguguuuguguucauauguauguguggugccuauaagagcauguguguguguguguguguguguguguguguguguguuggucuggggguuaagggauuggaggauaaccagguucaccaguccugcaaccaugaugcugguucugcagaaagaaagcugagccccacuucacacagaagacacugaagaaccagagcacacuugccuuacuauauccugggagcugcucucucucucucucucucucucucucugugugugugugugugugugugugugagagagagagagagagagagagagagagacguguacaugcaggagaacuggaagcugaugaagaagcuaagaguuuggggcaucaggagauaguggcaguugcagccucuccccgcucaucucaucccaucuaucaggcccagcuccaguggccucagcucuuuccagcucuguaaaugggcucaccgugugcaggaggaccgagccaaccucgccuuacauacagggcugcacucagcuguaggucaucacucggucaaagucucuaguccucagagagagaagggaaggugggaggcaggcucacaggaggaagaacaugugcccaguucucuaggccagcuucucuguaccuccacugacuuauaaaaggcuggcacagucauggccagaggccaugguaccucauagcucauaucugcggccugagcaggcaugagaguuaguugcuacuacccugcuuacagagaaggaaacugucucagcccauggccucacaugucucaucccaaaaccauagcuaguggucaccagagauaaagccugaacuuguauacugagcccccaaaccaagaugggauacacuuaugagaaacccauccagggauaagguggcauccugaaaaucaguccggucuccaaggacaggucuugccugugagcucccaagggacugcugcaaguuguaaggacaacaaaggcagauggugggggagugacacacgggcgaaggcuccauccacauuggauuuaacauucucugggcaaaaggcuaugcucuccuacacgauccucucacaaagaaaugaggaaacuaagucacccacgcagguagaaugauggcucagcccagccuuggagccccagcaaaucccaagcuacacugcuacgcuggucagaaugcagaggaagcgcauggugcugugaugaagcaaugaaggggagagaaagccacagagccugcguuuuaagaagaaacaacggggcccagggagguggcucuguugguagugugcaugccacaaaaaaaauaaggaccugcauuugauccaaaggacccauguaacagaccagacauggcagugugugcuuguaauucuaguguugggaggcagagacagacagauagaccagucuagccuacucagcacacagcauaccccaggugcaagugagagacucagaguacagggacagcaccugaggagugauacccaagguucaccucuagccuucguuugcauacacauaaacacacacacaccacacaugguuuguggguacaaacacacacauaugugaauacacaccacacaccacaccaugcacauaccacaugcgcgcgcgcacacacacaccauaugcacacacauauauacacaucacaugcauacauaccacaugcacacacacuacaccaccuguacuacacacacacacacaccacagcacacugcuccacagcacacacaaaaugagaaauaucaugacaugguagccaccacugguucugagaccuagggcagcggcaccaggaccagagucagcggcugucuugggggcaggucucugugugguccuggauagugacucugccuccuacuggccucaggaagggcaccugugcaaaaccgugauucaacccacacucagucuuuucccugaucauaagaggaugcauacacgccacaugcacacccccacgccacaugcacacccuuaccagcacaccccuacacccacacacacaccucugccaucccaggauuccuguacaauuccuuacucucucugcucuccuaaaagggaaauagccuuguggggcagcuguacccagguguuguggguuguccugcugcugguuguauucugauguuaauucugcuucuaagcugcccuuuguauucugauguuaauucugcuucaucaagaagggcuggcccccaaugacgaucaugcagugggucacuuacucaggugaucucaugugauaucucccccauuuuaacuggucaauaaaggcugcucaauuagcagccuggugucugccugaccccagggaccuggcaagucuggaaaugagcccaagucccuugggcucaggccaagcacaggcuguggcuccuuccauccuucuguccuucugcucucugccaggcuggcuguaccugcuugagaggagcaacagggagccuuggguccagcccgcugccugucucugccuuggaguucacacccacacggaggagagcccauggcuaugagaaacgccccaucugcgcugucaagugaacaaacucccaggugaggaugcucuuggcaggguggggcagcuucacgccaaagcccaaacaaagaugaccucuuugcagcgcuccuagggcagacuaucuuggggacccugagcauggccagagccaccagccucaacagucaucucagaaguauccaacccaggggcuugggcagcagcucuaccacccugaccagacgccagccaagccucccaucccacaucccacuuccugcccagcccggagcugcugauccucgagagcugccccaaggaugaacagaagcagaaccuguccacucuccagccuaccccucugccaucaggcagucaagagaacgucucucugaaccccaaccauggcagacucugccaagcccccuagguggauggcaucaggccucuaagcagacccuauaccaggcacguuacaccuaccguggcgaggugucucauggggucaccgacguaaagcaugguaggcucgugggggucugcacacgcugaggagcuggugugccgcgggacgaggcaugggucuggguggcuaggugggguagggguagacugguggcugcccggugggguggacugagggguugaggcucuguggcuaggaaggcaggagcggaggaugcucagaggcgugcggacugagaguuggcauucucacccugcccaucucccucauuucugucaacuggcugcauccaacaacaaaccggggcccgccccuuuauuccuuaugacuauucaucaacucagggcaggccucagcuugcccggagauguguuggaccgcaccaagcaggcugagcagggggagcagguggggaugcagggucaguggcuggcuuggagaucauacacucccacucggacccuucuaagcugccacucagggaaggcuccggagggcuguggcagucaccuacaaacagccuacacucuaaagcaugagcagucagcccugguccuggagaccuuugcagucuggguugggucacccugaaggaagagauggugccgccagccuuggcgacccaggggagagaaccugccuccuuccagggaaucguggaccuacagggaccaccccaaggacugaguagaggaaagacacaccaguaugcuugggcuaggggagagucgagaacacggccaacuaccgucaaaggcccaaaguggcgguuggagccaaagaacccauaacagaguuuuacagacagcauuuuuguccuggcucuagcuaaguccaggaagcagagacagggccacuccaccaaagagaauuuuugaaggaccacccgagaaggcaccacaggcaugguagaguuuguagagccaggggcucuauaucagcaucugccuaguggggaccauacaguggauaccacugccccuugucugggggcauuugaguuucaggucugguucacgcaugaagucaccauagugguccacaacagaugcguguccugugaaaagggucaucggcccugaaucucuaggccuccuagaaggacagcuugagcccccuccgccacacacacacacacacacacacacacacacacacacacacacauuuagagucuaaggauguucaagaagacgcagagauggugugaagacagaguccucuguuuaacccuuucucgccaaguuccaaaccagcuuccuucucccuccagagagcuugcaguaucugggcuuggucagagggcuguggcaguggcuguagccccuguucaaagcucuggaauucacagaagcaguaaagauggacuacuucauacugaucccuacgcuggucugagaggcauguucauggcuggggcugcacaggugugcacugcucauaagucagcuaugaacaauaaagucaguuucuagucuaauuuuggggagcaaucuuuggagaaacacugcucagggaucuauuuauaauagauagaccaggggucaacugcagccucccuccauggggacuaagggcugaguuuacagacucccaccccguagguguggccaggcugcuccagagagcccugaagagauggccuucaaguuucuagauugggguuuaaggaauugugucccucagccacucuggguccucaucaaucaauugucguguuggcuucacaaacaccccaaggagaaaauaaagggaaggauuaaggccggaaaggagaaugggacuguccgugagaacucacaccugacucccagaggaagcaccuggccugagagucugugagcccugaggaacggucuggccagggaaagggacgcccaccacugagcucuccucucugccacagccccagccuggcuccugcuuccuccuaggugguuugccugucugccuccacugccggugccccuagguagugccaggguccucagcaccugcuucucuggggguaacacacuggaggcucugccuugcugacugcuccuguagcucucacagcugagguggaagugaaguucugcaggcuccccuggcguucucuccacaacacaugcucaagacuacagugcccaaguaugguguguugauucaggagcaaacacaccacauacugucccugcugguggcuuugucccucuuccucuggacccuggaguuggggagaggaaugggcucucagugagacucuggaacuggggagggggcucagcuaaguucaguacuauacaccuucgacccucuugcuaccaaagccugccaaggaagaguggucagaaaccacuggaaguggugggggagcuggggguccccaagaggaucacauaaaacucagucuccaucuccguuugcccugcccuucccuugauauaaauucucccugccaaggucuauccuuccugaccuaccugccccaaggauucauacacagggcccauacacaugcuucucuugggcaggagagagacgaucccuuucucaaagccagcaagguuuccuugggugucccuuggggucucagggcaucuacucccuggcucaguccccugcaggccacagggagaucagcagagcaccuucugcccagccagcugcagcaccuccccaacccucugcggcccaucuguuccuaacagcuguugcuagagaaaggcgccagaaacagcgggaaaggggcaucugaggggaggugcaggccuggaggaggacaugaagaggcgggaaagggcagugauccugcagccgcgcccagggcaccugccucucuccccuuuccucugcugaccaucagcacucuguccuuuuucuguauuugaagagcuggaccggccucuggcucuugguguccaccuucuugugguccauggagaaccagggaagcagagagaaaggucugcucaaacacugggcauggagggugagaacugggauuucugcccucagggucaagcccuccacugccucuuggcacacggugcucacaaugugaacuuugcccuccacucaaucucccaagacccugugguagggccuuauugaucugggaccugucccccgacaugugacaacacccauugauucucaaccuugcugagcacccugugacuagcccuagccuuuggcaugggccccucagcucacccuacacagcacccgggagaggcaucucugaguucucuucuagcugggcagggggaucauuucacuuuugagauaggguuucucuguguaggucaggcuggcuucaaacuuuagauccaccuccacuggccacccaggggcugugauuuaagcacgugccaccgcaccuagucuccaggccauuuuuaaaguggaguuucugugaagcacccggaaucuaaaaggacagcuagaacugaaggccauuugcaggagcaaggagcuccauaugcagaagccaaaauggccaaggggcaaagccagcucuagaguccggugccccugcauggcaaacugugcagagucuccaacaguguggaaaacauaggccuucgcccuugagcuaacugucacucccugugggagaaacagcacuuaugggcuucugaucuguccacuuccccaucuuagagauggggccacucagauccaggagacuaaaggauccugagaaccucccaacuaggaagaccaggaugggcuacaaacccaggacaucgagccccagagaccuucaguucccucuuuaccuaucacaacugucuaggcucugcuaugccaucuacauggccacaggaagcuaaggccacaagggcgucccucaccaugccuaggguucuccucagacccacuagggguucauccgcuccugcccaucccauuugcuuuaaucuuacaacacacucuacuccaaugagacucgggaaugguuagaugucgaggccuggcccaccccucugcacaaggccaggcagacaagcugguacccaggaggcugcaccgaucucccaggguccucuccauucuagcccuuuccaucaccucaacuucacaagcaaggauguggagacucgggagcaugugagaacuugaacucacugacugcaccgguuucugacagccauuaaguugggggagaagagcaucauggaguucugaggguucaccacagcugguagaccugcucaggacauuccaugugacagaaagcaaucucccguuugaggucccuuagacacagaaggaaccauugaagagaauacauaucccaucuacucaagggccaugcuggcuuaagccaugacaccuuugcuggacuauccugguauuugggugggauuguccagcacacaggaacaacuggacaccagucaucacugaguagggcucuguggggguggaggggguaccugagaacacaggagguggaguugcuggaaguccuuagaaccucaaaugccagaacugccuauugaccugagaacaugccuggguaguguuucuuguccuggacccagcuagggauggggcuagaguucucagggauggggauagcauuugggagcuuccaccucaucacagcgcugagcuggcccugguaucccagcccucuuagggcccuuuccucucugugccucccauagccccuggaacucuaaaccacacacacucaggcacucucuuaaaaccucccagcacuuuagaagccgcugcaaacaacacgugaauccauggcaugcacacccuccucccuaugagagugcucaccaacuccucccucugagagugcuccacaaccccucccucugaugcccaucagacuuuggagcccccccccccagggugagucagcaggcucagcuccuggacuucagacacuggacauagcagagcaccuguggagcugaaugugggccugggcaggcuacccugucugcagcauucacagaccagucuguacucuguagucuauacccagaccauugcuuccuccgggcugcacccugaaacgaugauggauucuguagguccccaaaccacucucacacaucuguaccccaaacugucauuuccauagcugccuccaucccuggacucaaagaugcucccuguggugccuggaugccccuuuccucugccauccuaauaagcuguaaucgaccauguaauuuaugagaucaaacuucaucuaccucauuucauggcaugcaaugucuagugcucucugcauccccccacccacccccaacuuccugcagcaccugcaagaccucaccccacccccaguucccugcaguccagaugagcucuggagcauugcugccacauggcccuaucugucacucaucucugagucuugauuuuugcugucaggacugcuggaaguucugagcauacaggaagcuguuggaccaguagcugucucuugaaagaacugugcaugagggucagcugagcccugcagaagggaggccaggaaguccuguuuccagggaauucccacuucuaggagcugagcugugcgcccaggaauuucguccauggcuuuacugcaaggcguguugcuaccugagaaagcggccccuuguuuguggagguguugagccccgcccguguuaccccugcugggagcagcaugccccagcaggugagcacccaggagcacccgccaacacguuuacguugggcaucuuuggggccgggguggguaccacaucccuagccuccggggccccagggcuguucccugcuucuuccuucagucacaguggggucucugagcacucugcccucucaggcauaagcuggguagcuuagacugugggaggcagcuuccagaacuccuaaagcaggcaucuuuagagucuuuguguaaggcccucccucccuggagccuaguagccaccuccuaucccucuauacuggagaacacauauauccuagaugaugggugucagaaucaugucucuacggaguaacaggcaggaugggggacuauccucaccaugaugcaggaccauucucuuccccaagccccaggcucuccuuccacagcaucugccucaguucccuugccuguaaaauggacacuuacaggugaacugcuauucugaaacaggcuccugagcuggcagagaucagggcuggacaggcagagcucagagaagugggcaucaccaggaugauacccuuacccccuggggcugccacuauagagagucucacccaguuccaugggagaucagugggcucugaccaaccuuccaccucuacagagagaggggagaguaagggcauagugccuccugucucuucaacccuuguucacuaaugccuaaaguggccaggcuucucccuccaaguagggguuagccucacacuuugcuuggcuucuagagucccugggccucuagcauauggcucaucaggugcuagugggaggaaggcuacacuggagacaugcucagcugucuggugccucugcagccgacaugugccaacucggcuugggcuuugcucuuccuuaaugugcuugcaggguuccuccaacaaguccccgccugacgcuuucccaacccucucgccuuugggauccuagcacuuuggugguccaguaggggaggaugcugaggacagaaggccucgagggacuuccucgggaacagaggccuucacuugcccuuugcaugcuucagucaccuuccuccaguuccuggcaccaccagggcacggcagugguagccagagagugaggcaggaacagaaucccacagcuacugugucuucuugccaagaggagcucccaauaggaggcaaauuccaaaggcuggcugcuugguaccccucuuggucccaggaaagagcgcacaagaugaggaauaaaaccacugucuccacuggccacaucuuccucuccuaauauaaggagccugccuuaguacccuucauccugaccaguccagagauagcuauagaaacaugggccaaucagaaagauagggacagcucagaggcacauagcaaacaaguaugcucagaccaacaugaagaagcaguguuucugggcaaaggaaaaagagggguggccucuccacggggccucaaaauguuggacaaucucugagggccgaggcuuccaaagaacaaagguaccccaggaaaaaccagagaaagagagaugcaagugaaagaggaaguggucccagggaaccaccuggguccagccaugcccgaagcucuuccuaccgcuggguccaaucaugcuugaauccauucuuaccuaggaaucgacaguaccaugagcucauugcauauuuuucuuccgacccaaggugggcuacccaaagcccugcuuccucguuccaccggagaaaagccaacccgcauuuaucaccaacauccagucuuuagcgcagccccgcucaccaugccuugcagguggaagacauccauguuggacuccucgcugccugaugccucgcuagucccuuggcugggcugggggaggucaaaguaggugcugucuggcucucuguggggguggaggggaaggacacuggauguuagcaucugcuccagaauccgcugugcuccccugguucaggauaucaggcuaccccauguguguguguccaucccaggagauaagccauauguccuuggacuuccggaguuuuccagcucccacaaucccugccagcccucggcuugcccuucaggacuauuagaaaaugcuucauacacaugaucucugugcccacagcccucuagagaacuggccagaggacagaccaugacugugggucacaugcacacaggacauggcccaaggcagcugcuaccucagcagaccccucucccaaccuauuuauuccaagccagcuaagccaaccaaacccagugaggcggaguucuccauacucacagagaacuccacaggugcucgaagguggaggaggaggaagaagaggucugggccaucuccccaacgcugccgcucauucuggaagaagagggaggacacugagaauuggggaauccugccuuccucaguaccaggcgagccaaguggacggcggggcugccuaugauggugcaaggagaccccagagcugugcuaaguccuuccacucacguugcuuucuccccccccccuugccucccuuuucccugucuagcuccccuucucuuccucccuaccaucaccacucccaagcagcucauucucugguccaggaggugagacugaggcaagcuugguuuuagagacgccauucccggauucugcugccagaaaacggguaagaagggcaugugcccucacauuggguagaugcuguuggagaagggaauuuagucuuuguggucuugggucaguuuuuugagagaaugggccaugacugccgucaccguguccuaaaccuacaaugacggccaggguuaggucaagccaggucuugguuuguguauguuggagggggaaggcugugacuugucgccaggucuucgagacagcucaaacuucauccguuccucuuaguaagagcguguguagggcgcccccugcuggaaccaugccuguaaugcacaguuaugcagguuaccgugggacucaagacccucuaugguccucacccuccaaggucuaaggcuaaaguccuaggacugcccuggaguugucaccuguggauggucuccucaaaggagauaaaggggagcagggucacucuagccccagcuaguacccacaaccgcuuuccccacgauuuccucagcacagccucccacgcggaggcuccgcccacucacagucacccuggaggcggggcagcguaagggcgcucaggcacaguaaauugugggaggguggggcagggaaaccccagcccaccugcccgcugcccauuaaggagcagccucccuggggcagccuucuaagcccgcaaaccagcuuggcccagcucugcacugccaagcagacagguccagacuugcccagggcuggcagggcagaucugucgcuuuugucugaccccaggcaggaggcugcucauagugguuuguggcacgcaucuagagauggcacgcgccaggccauggguccucagagaaguggcacaagcugagagggccaguaaaaggggaccagcugagcacagguagagaguggggugggggcucagucagcaagggaggaugacacaggacaaguacccuguacauaucgcaguccugcccuacucagaagacaggcucagaggccuuacaugccuugcccaaggucacacaacuauaauaagcacaggaauuaacauaauuuaugcucuucuccaguaauaaggauuaauuuuucccaccucccauuuaucacagucaugaagguuuugacaagccauuggccaaccagcauggaagguggacagagcugccuucaccagcuccgggggaaugguacuuucuggugaggagccauuggucagggagguaucucuucgcagucagagugggcuggucagcugggccaggcugguggacacccugagacccaagaggacaugcuuagaaguccuaccccagggaccacuugguccucuucucccuuuuacaaggacuacgccaagcucagaaagggaaaggacauggcucaugucacacagugaauggacuccaggccccuucgcagugacauuauucacuuuagccagacagggugagagacugggaacacaucagaagaggaacugccagauacaauaugacccggacauguuaggugacauuugacugugaccaggaacgaacugcugauucaaaacagcacaguguagacggacugugaagaccgugcugaaccaccuaguguccgagcaacauguacugaacaggaaauccgaacagggaggcaaaggcagguugggggugccagccugaggugcuacggcagcgagcaagggcucauggggccaggguuucuccuggggauuuaagacgcuggaagucgcugagcuucaagcuucaaaauguuguuuggaagacagcaguggugcacacgugcagucccugcugugacaaggcugaggcaagcucaucagaucaaggucagucaaaaacaacaacaauaauacuuuuagaauaaaaugcuaguuauauguuaggagaauuucagggcauuccuuaaauuuuuacuuaauuacauuggucgauugauugauugauugauugauugauugugaggaguggauucuuucuuuccaguacaugggguucagggauugaacucaggucaucaggcuuggcagcaaucacccuuacccacugagccauuucacuggcccacauuuuuuuuuaauuaaaaaaaaaaaaagggaaagacauuuguggcaggcagcaccuggaaugaaugucaguccugcugugaccacacugucugagauggucucccaaauuccuuugccacacccacugauguucucaggauaggaaugagcacuuugagacccccuguuaggcugaggacuccaaguguauguuccuggaagauucccaucauagauguagccuuggaaguugucagcaagagccuuggauuggaugggaucuggguaucacaguacagauuguaccaggaguacucugcugguaacucuaccugccacaccuuaccccaccuguugacacccaugcuggcuugccuucccaauuccagaaacggcauaucugaagguggacagccuacugagaaagcaagggaggauuugggucccucuucaccccuuguguccacauggccagcucaagcagagggaagaaaaaaauggcaggugcccagugccuggaaauagagcgggaggugggaaaggggcuaccugcaggcagcagacuuccaggagcuuggcagaguuugcagcucugccccaagaccccuugccaaguccucugcuuuccacaccuccugccuaccagguccuccugcacccacacaaggaaggagcauccaaccaaaccucucaugcugaagaucaaauucugaccugcuugccagggacacaggccccugcucacccuccuaucuugccccucacugguugcuagaguccuaacagucuuaaugggaggcacaugggccaccugcuaguguuuggcucuguacuucuaguccuucagcugggacaugccuccuugcccacguccuuaaaugguccuuacuagcaucuagcucugaacucauggagcaccacagccucacggaagccaccacuaucacccagcccugucacccuccccccauuuucuacaaaauuccugcagcugguaacccaaccuuacuauauuauaaacuuauagucucucucuucagagagacagaaagggaaagagggagggaggaagggagggaggggcacagagagacagagagauaauugaagagucagagccagagucaggggcagggauaggauaguuggauggauggauggauagauagauagauagauagauagauagauagauagauagauagauagauagauagauuauagagagacagacauaugacagucagaggcaggggcagaggcaagauaaaugaauggauagauagacugauagaugguagauagauagaugauagauugauagauuauugcuagaugguagauagaugauagguacauacauauauacauagaugauagauacauagauagauacauggaugauagauacauagaugauagacugauagacgauagauugauagauuauagauagauagaugauagauacauacaaacauagaugauagauagauauauagauguagauagauagguagauagaugauagauugauagaugcauggcaagcucuuuacugagcccuuucuauaggucccacacacuccucuagcuaagagauguguccaccagaggagcgauccccagacaccgcaggaacagauuacauaagcacggaaagugauuuaaaacaucaagucaugauggcaaagaggccaguuuugagaaacuacuuguccucuggaaaguacaaaaaaaaaucaguguugggaagcacagauauagaaaauaaucacguugugcgugugugcaugccugugagugcagaugcucaacucagaggucagaggacagcuuccgggagucaguuuucuccuccuacucuguaagucccagggaucaaacucgaguuuucagaacugguagcaagcaccuucacccacugagccaucucacuggcucugagauuguaguuuuuacugaagacuugaguuuuccuagagagaacacgcaucccguggugugaggagaggcauagaaggcccagaaucggcagagggagacuuuagggagaagcaccaaccaaggagggcuggccccgccuggcccgccgugucagaagcucugucagcagccaggucacaggcugugggcauggcagggaucugggcugucucuggcccugcccuagccuugccuccagcuccgucaaagccucagaugagccuccuccuuugcugagcuggaucuccuccaggccuggcagugccugcaucaugaaacaggaccacagcaagcugacaaagauggucugugccaaacucagaccucagcaccugcuacccgccccccccccccaaggagucccaacaagcaugagagucagggguacagcagccagaccuguggugccaggauaugcggaggagaauaaggcuguaaacggaaagccacacacacggauagcacaugcucacugagccaacggcacggcuccuccacugagccaacaccgagccaaugacaggccuccucacuggaggacacagcuccucacugagccaacggcgggcgcggcuccuccacggagcuccggcagcucugacuggacuugagcccauggauauuuacaucugcugggaacaauuccauccucaaaacugggugguggaaggccccgugggccuccacggagagagagagcccagggaugcuaaccagacuccuggcaggacuucugggcccacgcagcagccuagaugggcucccccaacuaguucagagaugaguaaacuguguuugagacccaaggggcuugcccaaguaauucagcuagggcuugcaccagagcagguuugccggggauguccucuauccucuggccccuaaggaagucuccgacucucccauuaccucacccugcacguggccgcgagucucaacuucccagcaagagcuaccaaccuucgaaccuccugccuggcccccacauacucccaacucagccgaguccuucucccaagcauucccccaucaugcccugucaccacggcuuuggauacaugugacuucaaauguuuggcucuccaagccccccucucccuuaaaagccagagguggcuggcuccucaagaaaaccucugucuugaccagcucugagucugagccuuccuuccccaucccugccaccugacuggaggaggagacacagaugucacuuggccacauagaacacuucaaucacacaggauggggaccuccuuccuuguuauuccccaucuccucucaccccugcucagccccagccucacugccaccugugauauaccagaugcccauaauuaucccgaaccugcucuggaagggguaccccauccauggggauguaccccccaccuucuaggagccugaauacccaccuucccuaguggaaacuaaagcaagucuguccacauauagcccagacacaggagaggcaggaucuucagcaugaugacacuggguccccuggcuauggcaagggccuuuuucgggucagcaaggaaauccccagagaaacuuacccggccugggaaaucucuguuaugguaugucuacaugacgugaucaauacugugguuugucuccacugucaucccuucuaauaauuuguuccaguggacaggggaauugaaaucagaaguaacuaguauauuaguggugaugacaggaggggcccucuggacccaugucagccacugugugaauuucccuccagcggacaugaaggcucuagcaccaugagauccuugugugggcagagggcgugccaggcucaggaacauggccagggagugucucuccugaaaugacgguaucucugggcaguggcaaagacacagaacucagaguaucaagaaccuggccacaucggggccuuggugccggaagccuguuucccucaagcuaccuccagaaaaggaggcuacacagaggcugaggucccacccgaugcaggcagaaguaccuccuucuucagggccaguguggcaaccaucuugguccugccccaucuggaaacuggcuggaucccuccccuucucucacaagacaaccucauccuucagcaggacauucuguucccuagccagguguggcccuagauguccagauggcagcgguggccuucuccccaagcugggggagccaaguacuggugaaggaagacaaauuuagcugccccauguggggcagggugugcuaugugaagcauuaaccuucucucgccugggcucaggccauccgccagggaaugggaacagggcuggaggaagacuagccugcaucccucaggccacccaacauucccugugcuucuugaaagagacaguaguugaccaaacuucccauccaugcuaagucaccuggcaccacguggaaacucagacaagaccaaaggaagugaacauuguagcaugcugaccuccaugcaucuacccaagacagcaggaaccccucgauauacagagaguaagugugucuugcaucuuauuugcucacucagggcacacagugccuagcuauugaccccugcacucuacucuccccucccuggagaugauaguacuucgaguacacacucuuaccuuccuggggaagcccacacccucauuuccaaagcccugcccauguucagacaaccaaagacgacccuacucucugcugaccugcucaggccugccuucugcuuccauuucuucaccccaugguggggccaugugggacauauggccucuagcuccaccauucccuaaccugaaauucagcccugcuaggcacuuaagcuggggcucuuccugugcuggccacauggcccucugccauucuccagcugugcgaaccagggcaggugacaugcccacaugagugucaguguccuccucuguaaagaggacacucacagaguguccucugugauaacugcggauugucacacccaccccuguggaaugauguaauaggaugagcgugaagcaucgggcaggugacaauccugcauagagcaggggacaaaccacagcaaagucacagccccuuuaguauagggcucagaguggaagagaacaaguccgguccucuugucaggggaaggccuggugagaaacuacgucuguggacagagacagacauacgugugucauacauacguugaucuggucucugccccaucacggcaacuguggucucaccacucuuugaaaguguucucaagccugcugagcacugucccuagcacugggugucucaaaaaccaaauugauuccuauuguauagaagaggggauccuggguaaccugguuacuaggaggcagaauggaugaucauccugugcugauguccaaggcuggguacuagggagaaggaccaggaagcccagggagucuggacuccuacccuaugccuccaaguuaucguggcugaaaauaaggggaccggugaauuuggagggcgggggucagagguacaccaggccugauagaggggcaauucaagggagcagcccccuccuggcaauguggcgagagcuuccaagggagaccaggcaggguggggggagugaguggcaagacugguuugggccagcaaggauggagaggaaagaggaccagguccaucgacaucgagggcagaguggagcucaugcugaagucaggagagacaggagacuguagucagggugggugucugucuagacuguguguacagguagccagaacaggucucagcagggcaagcauccucuucacaggaguugucgcagcccuagcucuuccacacucagcccaacucccugacagagcuguggggugcagagacugcaagucacagagacaagcccgauccaggacacgaaagaaaaagaaauaaagacuaacccgcucuggugucccuguucgaaggcgccaacugccauagacccucugggccccuuuguuuguguggaacgggucucuagucgcggguggacaaagcguaggaugaauugacagacagacacacacaggagaggucguguggaaucugaauguaaugucaaauugagcaucagacuuuuuaugcaaaagacaauaaggaaguugggugacacacuagcaagguacaaagagguuacuggauucuuacauaaaacagaggaauguaaacacagaaggucuaacaggaaccaccugggauaaaauucauuguuaacaacugggaucaaaaagggcucuaucuaagauuugcuuaaucuuaaaagccagggucaagggcuucgugcccuugccauagcuccuauuuuagucuauugaauagucuaccuuccccuuaagccauuguaaauacguguguaugggugugacucagcuauagucuuagaagccaggugugaggucuuuacucuccuagggcaagggcuuucacacccaagucaugguucuaacuagggaguucuguucuacuuaaccaucucauaaauaaugcaauacucuaaaaccacagcccgaucuacuuccuaaaccauuguaaauuccuguauaugggaacgacuuggcuuuuauugauaguguaauaccagaggcuauucugaaugucacugucuagcucaaagacguucuaggacuguuggaacacuggcgaaaggcuuuagcuaugucagaauucaaucuuaaaaggcacuuauaauaaagagagcauguggauccauccacuagacuaacgcgggaauggaaaauuuagagagcacgccagacuccaggagugaguuucugugaaacucuuuuugccucaugagcagcuuuuaggcaucccugccuggcaagcugacuugaccggagugccgugguagggacagguagaacaagugaggacacagacagaaacggagucuagaguguccauccugacccucagaccucuggacugaccaacaucagaacccucaacaagccacaauucagggcccuccaucucuuccuguguguggagucuguagccucuugucccucaaguaggcuaucacaccuuccuugcaugaauggucuacacaaggcuuucaggagauugcuggacaagguuaccaagggcccaacaguucuaugucuguaauuuagccaccuguggggccucauggcccagcuuccauuugguuuugaauuuggaaaguggcuucucgcaggcacuaccagucccacuuaccccuccaaggggcuaccuuggagaagguuccagguggccuuuaaccugguagaauucgaugucaaacacaucagaaucccuugugcucagcccuggggccaugaggaaaggcucugugcugccugauagacucuuacuagucaucucagaaugggaacagcuacagagccuugccccucgggguuucuggacagccccuagccccccaaguaucauggcaucugcugcagggguaaaacccuauguguguucagauguaaugccgaggauggacaggcuuagccauguagcucagcaagugcacagcacaaguuuggugcucagugaauagacauuggaggcagaauuaaccgguuaguaugaugaucucaaggccuugcaggucagggaaaguugggcagacccaggagugagcaguuagaggucaaaacucaccauucacaccccaggggcuaggugagauggcucagcaacuaaauguacagcugccaagcucaaagacgugaguucagucucaggauaugcucacaugccuucauacauauagacacaaugaauaaauacauauaaaauuaaaacaauaagaaaaagcaaauauauccucauuugggcuuugggcccuuaggaguucagauuuugggacccaaggaaauagcacuggcuuugugugacacauagcagggcccugugucuucuugcuggucuugucagcauccacuguaggcacaagacccucgaggcauagggucucaggcuauggguaucucagguuaugggugucucaggcuaugggggucucaggcuaugaggaucucaggcuauggguguuucaggcuaugagggucucaggcuaugggucucaggcuaugauggucuugugcauacaguguaugcuaacagggccagcaguggaaguaaccaaucaaauuagagaaaacccaagacaacuagccaugguaaaacaugucuguaauuucaaccauggggagacugaggcaggaggaucaggauccaagaccagccugggguucacagugaauucuaguuugggcuacaaaaugagaucuugacuuuaaaacugggggcagauaucucucuuucaggcaauacuccagccauuugggcuccagggccaccgcuagguccugcugagaacacggugguaaaaccacaaagaguguauggcccauacacuccugauacucugcuucuccacccacgugugcacacuggcucacaaugcaccacacaaccgagguguucacguguaugcgcacacacacacacacacacacacacacacucacucacucacucuggccucauugcaauaauuucuauacaggauuuucucuaucucauccugauaugacgcuguauaguuugccaguccuaggacauccagcccuguucacaggacagcagcacaaguggacaacaucaggaacagggccuaccgaggccccaucucucaacacuuaggccugcauguagacauguugagcaccagccaugugaggggcgggaagcccagcacaggcuaaggaugaaagagacucugagacuaaguagcggagggagaguuaggaagaggcacuggguaggggcaacaucuuauagcacuaaccauggccuuggaagauccagguagcuguuuggugucucuuggacauggaauaaagagaaauucagguggcuuaaaggaaugaaggcuguggagauaccagaaccacuuuugggagaucucagaaucccuugucuccauccugaccugucacaguacaggggcacagagagacccuggagacuacucaguacaugugacuuuccaaagugccauaccauguugccuugugccaccagagccacagauggugucucuucagacugucucggccaccagccugcccguguggcaggccugcuuacauggagccuuacuucugggcuaccaggugaguugauggggagggguuuccuuauccugauggaaccuugaggcuguugcccuguggggaagggggacagcaagcgaacccugacuugagagcugagagucaagcagagccccugccuaccuuggcugagccugggcccuggguggguccauagacuuggguagaggugcuggaggccccgugguggcuugcaguggcagggcaguggcggcagcguccaguugccuaggugaugacauugaaguuacggaagcugggaggccuguguggccagcuccaagccaguggguggagccuggcagggagcccugggucuggggacuggcuaccaggcuuacggguauuguguuugauccuacuccuggcgaccaacaugggggcaggcucccacuaccugggaaagugaacugggggggugaaaucucagagggcaacccuacaaugucugcucccccuguugauggucucaagcacauaagcuaaauccaaggaugguacaauggaccccuuaacaccuugggcucaucucucucccuguuuuuugcccuccccugcaauucacaauacguccuguauaccgucaucucaacaacacaggucuccauaggcuggcggcagauaagaacuccucucuuaaaugucagaaaucuacuuugccuguucauaccacaccagacuccaguugcuguggacccaggauaaugaacagccagaaugcugaauucagaauuucuaucccauauucuuaaccacuaguguacggguuuugagggcacccuacuauauuccuguuguaauacacauuauauugguaaacucucaugugccaguuaggcucugcagaagcagacucuggggguggggagguucccuugucuccucaaaacccuaugucuugguacaggcuggccccagucucuguaacaaggagaacaguccacagcaagagcauaaaaaauauagcccuugcugguagugugguggugcacaccguuaaccccagcacuugggagguagaggcggcagaucucugugaguuugaggccagccugcguuccgagguauggagugaguucagggacggccaagguuguauaguaagacccugucucuagaagguaaaccauuuccagcagacauuucuauugcucaaauucaugaggucaucaaaucagaugcuuacaacauccgguagagccaucuggaguagccuggcugguagagcaaagguuaacagcaucaaauuugggguuuacaaacauccagcagagauuggcuggggaagcagagccagcuuccuuucuaugaaugaaucuccaggccuaaacuucccagcuucucaucccacugcagccauuuuuaagguuaaaaaguaacauuugugacuguaugugcaugugggugcaaauccucuuggaggcuggagugucgggucccucggaacuggagcugagagugguuuuugagcugcccaauguggguaccaaacucaggucccuuuagagaacaguaugcacucuuaauggcuaguuggucucuccaacgcccacugcagacauuuuuauaucauaggauuucccccugaugcucaugagggaaucuucccuguucacaccuagucauuucagggacaguggccucauacagcuggcuuuuagaggcagggagaugguagaccgucaguauaaagaacauaaguaaaaagggggaaugcugaggguggaaaggcuuggguaaagagggagggaaaggaucgagaggacuaacuggauaaagggaauacaaauuaaaaaaaaauguuuggaaaguaagauaugcccaacugugcggugggcaacaguagcuuaacuguuaaggugacaggacagcaccgggcagggaauccuguggggaauucaacaaguguuucugcacaucucucucgaaugaggccaagguugaagaucugcugucacuguacaccgggcccaagauggugucuaggugcugacuuuaaagauauccucugugcauucccauggacagcagagagagcuugugaacgaacacacacgcgagugcucaugaauacaaagcugagguggugcuugguggcuucaaaccacgugugccucuucucacacgggacuggggguggcgauggcagggggggggacagcuaaauugguucaacugaacauaugagaccaugggucucccccauuccacagaggcugcuggaaggacuggcuuccauuccucuuagcuauucuaagcaaccaguucuuccaucuuagaaauaccugcguaaugacugcuuguggcggcacuggguugccugccugauuaauugugcaggaugaucagggucguccuagcccugaagcaggaggaagaacuccagggagugggggggcugguuagaacgugguugccuuagggagcagguuugcccagcuagcucaguccucagccacucugagcuuccaauagagacauccacaucaugcuuaaguggcaacggucagggcccccaaagccccagcgucaauauuuacucacguccgagacugaagggcugccuuugugggcccaacuccugcucagaaaaacagaggacacgcccuucagaggucagaggcugcccuggcugacagccaaggccagggagguuggcagauggaggcccaguuaagacucccugcccucccaaccugcuugacauugccagagcaccuguucuuugucucaucugacucuuccauccgggccgucggcgcucucauccucaacucagugaguucugagagcacauaggagucacacagagaaugugacaaacaccucaugcccuagcugaugcugcucacuaagcaugaauuucagcgucuacaccuauccauagcacaaccauuacacugguaccgugagaagaguuucuaccucuguuccccgaugaggaaacagaggggucgauuuauauaacauacaguucaugacuggaacagugcccacuucgucugccuugacagagcauccauccgagcuccccugcagugucuacuuucacucuuugcagagauccauggacgccuggccuggauccuaagcaaaucugccuucaguacauuuggcuguguccucuccugucuuccagaaguuaaagggagugaccucggagagcaggugccuagggcaucacuggaagcuacccugcuugcuagaugauggucccuugaggcgcauauccaacauggccccucuugucucacugccagacccauccccacccacaccugaacaacaggagcaaaggguguccuuggcacacuggcuucugugcuccacacgaagugucuuauacuguggugugccccggggaccuccaagaggccugcgcucugcagaauuaaacccucagcuucaaguugaugucacagaauggugaagacugagugaguguauaaaguuugaauugucuggucccagaucaggaccuaguaugcagcagguacucaguaaugaaugagagauggauguuuuuauagugguuuugugggugggugggugggugggcgggugaguggauauacaggcggguagauggauagacuggaugauggauggguggguggguggauggacauauggauggaaggauagauggguggaugaauggauggauguauggauggauagauagauggauggguggauggauagauggaugaacaaacaauggauggguagauaugaugggcuuuauggacauaugggaugaagagauggauagauggauggauggauagaugguuaaacaaacaauggauggguagauaugaugggcuuuauggacauaugggaugaagagauggauagauggauggauggauagauggaugggagaauguguuggauggguagauagaugggauggauaaauggacaggauggguaaguaaagucuuaagugaaauacuauuucuucccagcuccacauucccuuucugaauuuagaaauucaggaagcugacugggggugugucuaggagccccucgguggaaugauaacauaugguucgaguauugccuguguuuauguugaaccaauagacuuggagacaggugcaaaaauaauucucuucugcagccaggacuuacuguucagugugauccauggaagaaccaugagaacugaaauggugcacaguugugauuauaugauaaggcucacccuaagaauaaagacuugaugcuuuuaaaaacguacacggcucaaauacuaugcuacuuaucuaaauaauaugaauaagcuauuagcucucccacagccuaggugucagccaagacugggagugaggccaguagcccagaguuaauccagacuauaaagcaucacuguggccaggggaaguggucagggcacauuuggucuaugaggcgauucaaaugcccuacagaaaccugaugccucgcugagauaccaggagaagcagccacggacagacagugcucacugggacacagggagaugcuuccccuuaucuugaaaaguucagcucaccucugccuguucagaagugggauguucccaucauaauuuuuaucaccuucugacauaaugguuuuuuuuuuaaauucaauuacauuagauagcccacgcauaaguguggcucaagauucaaagaaugcaaaaacacuaaacagcaccaagagaaaucagaaugagggccuggagagauggcucagcggucaagaacaugcacauaggcccauguacuugggagcuuagcucccagcacccauaccaggcagcugccugggacugcagcuacaaggagauucuggcuuucaugggcacucccacucaugugcacauacccuuacauacacacguacauauaauuuaaaaaccuuaaaacaaauagagagggcuuuauuacaacagaggaaagaaaggcgguugucauaugaaaguucuggucucuccaaaaaugacucaagggucagauagugccagggcuuaagaaacggccaugcauccugggugguuggugugccugagugacucagauguguuuugcacacacagcagcauauuuuacuuucuguagcucucggacuuugaggcucacaucuaucacaggaagcccgggcaacgcuccuggaauuauucugaccucaaucugccuguggucuuccucucuguucuuaucccaaucuaucacuuuugaauuaauccaauuagcgcccuguuuacggaugccucguauuuuaauuugcagcuucucucuauaagcucagggacgcuuucgcaaccucaucucuccucccucauuacugacaaauaauuagucgaagaggugucccugaucaaaaauuaagggcccagaagcaagccggagcaugccuuacuccaaaagaaaaagugccaggaggccuuuguaauuaggcuuguugauggcgguugaccacggggagacagaggacagugguggcgagaaggaggggggccacauugucuaauccaagucuugcagaucagggaccugcugucucuaacuuacaugacuaucaccagcagagccuccuucuauagcgagcaggagcugaaucuagucuguacugugugguaaggagucccagggaccccagagaauggaggcuugguaaaugaaugauaagauaugccgcuuacuguucaugaucugggcggcacagauaccaggacguacccacuguggagcucgacuccccuuugcggcgcuacagcauuuagcaagggccgcuguguggucucugcaaaaguuagacccccucucuacuaugaggccccccucugcugcugguggaaacacccuaaagauccuacaugcucucuucccaaccugggaugcucuccucaguccccacaaggaccaaggcuucccauaggucagcugagcugagagucaccaggucugugcuugagcagggcaguguccaucuggaagguggacaucaaugaggcaacagcuaggacgucaucccuaagguccgggauguagaucagaaugggagacuggagcuccuuuacuugcugugaaggacgcaccgaaagguugacacuaugccuauugccccuacaaggauggaccgugugccuaauuagcacagcuuccccagacacaccuccagggcuggcagagacucugagcagcaggugagcaauuagagucccugcuguccccauggaagggaucuggcagcugccacugggcagggacacuggaacagcccuucguagauacaguagcccugagcaggcugacaaagcccgcucucaugggucuccuucccacgcccugccuacuccaggaccugacccugguugacaagaagaugcccaaggcaucuaugcuggaguugguugguagggaggcugugaugauguuccuggguaccugguaucccuguaagguucucccccgggggucucaggugugguuuguggugucucaggaaagaucacaggagggauguaggagagccugcaguggaggcagguaggugacucacaacucccaggauggggcucagaacacucuagcucagcacguggcaccauggcacuccagagagcaguaggcaggccgugcuuucugucccuagccucuuccuccggcagaagaccguugauaaaugaggcuuugagaaauucaaaaggcuuuguacagagaugaaaacaacuauuugggugaagaacagcucagggaggguaggggagucauugcuggcugucagucuggcagaggauugacaucuggaguuuacaaaaagcgacuggagagcagcaguucagcuguuaacauuggcugcucuuccagcggagcuagauucaaccuguagcacccacacggcggcucacaaccaucuguaacuguuccaggaccuaacacucucuuuucugguucuggccuucaugggcaccaggcacacacaugguguacauaagacauacauacaggcaaaaacauuccuugccauaaaauaauagaauauacaaagaacucaaaaaacuaaacacagggugacagaggugguucagcagucaaaagacuuagugcuguugcauaagacggaguucaauucccagaaccugugucagcugacuuacaccugcccguaucuccaguuccaggggauucgacaccuucugguauguuuggguuccugcaaacacauguugcacagauggacacucaggcucacacacacacacguaaaccuaaagcaaauauuuaaaaaacuaaacacacacacaagcaaccuggugcuuaaaacggaauugagcagacaauucucaaaagaggaaguacaaggagcuaauacaugcauuuaaaaggugcaaucugagaaaugcaaaucaaaaccauacugagaauccaucucagccaccggcugaaaacagaaguggccaaugcugguggggacguggacagaaggacgcccucccagaccaacagaggcaaggcaaaccauucccaccacuauggaagucaguauggagggucuuuagaaauagaucuaccaugugaccauaccacccacggacaccuaccccaaagucaacgcacauuguagaacauaguauaucaaggagcgcucaguguagcacuagucccaagagcagaggagcagacaagaaaaguaugacaacuauacauggucauacauuuauccagccauaaagaaggacaaaguuacauccuuuucaugaaaauggaggcaaucggacaugauuguaguaugugaauuaagccagucucagcaaagcgagcaucacauguuuucucucauauuuuguuccuggguuuuugcauauguaucuaaaaaucacauauguauacgugacaggaaagcagaagugacuugucuaaagggauaaauggaccaagggggaagaagcauguacacuugcuguauaauagaugccugcaggaagauguccuuacgcaacacaguaugacauacaaggaauacauaccacgaaaccuugaagagcaaauucucagccugacccugaauagcaugagaccuuguguguccuguucuuggggacaggaucccacagggaugcagacccucccuacuaugggauugacucauuccuguucuaacccuuguccucuaacaaugguucaguugggcaggcucccucuagcaugcaugcacacauguuugcgcacacacacacacacacacacacacacacacaaacuugggagaaaguuagucaggucuuuggaucuucaucgcugaaguccuuaguguccaauaaaacuauuguugaggggcuggagagauggcucagcaguuaagagagcucucucucuuucucucucucauucuuccucucucucucucucucuccucucuccuucuuccucucucucccacccucccucccucucucccucccucccucucuccgucccucccucucucccucccucucucucucuuucucucucucuuucucucucucccucucccucucucucucccucccuaucucucucuuucuccccccccccacagaguacaagcauauggccauacaacagacauaaaauguaaaaucuuucuuaaaaauugaaagcuagugcuggauccauugugaacuuuccuguugcgaaucuguucuuucucguugcucucaccgcagcucugaggucaaacccaggacacuguauugccaaaaugcaccccagacucuuuugacuuucccuuuugaaacagggucucacuaagucaaccaggaccggcuugaaggucacuuuaagcuuuggauccuccugcuucagccuccccaguaguuaggaucauggcccaggccugaauuuuauuacggugacuuugucguacuuugugcugagcccucuacuccucuugugacuauaaugaccucccagcccuccaccucccuaucuguaaacugaggaaacaaagccuaccucugccaagagagcaaagcacgggccuuugugugcagcuacggugaaggaagcaccaugcaaaugucaugauuguuagucauccuuguacccauagcauacugggaaaacacaagugcuuccuuugcagaagaggggguuuuccugggaacccacauaacggucuaaaacaccaggugucaccacccaagggccccuugcaccuuucagucugcccuaggccagugccagccagcuccauccugcacuagcucuuugggcaaacugagucuggcaccacauccccuuucuucagccacaguucuaaggucuauauugagauucagaacauauaacugcaugacacaugucugcaggacacugggacacaugauugcagaacaaccuguugggcacccugagugaguccaggugacccugaggcugcagaugcacugaacauggagaagcugcccuguguaggagcagaugguacagcucugaaggacacauacaucaggaaaggggucccagcugggcaaccaucaaaccaaagucacgucuggggcugggucaguacacacuuguaggcaugaggaccugagugugauccccagaagguguguuucaaagguggggugugaggagucauugaguuggcucagcaggcauugguagccaagccuggaauguugaguuugaaacccagaccccacauggcaggagagacccaacucugaaaaacuguacuuugaccaccaugggcaugcuguggcaugugaguacccgcacaugugaaaaauaauaaaugcacuaaaauuuaaggagauauuggcgccuuuaaaaacaaaaacaggcgugauaguauguucuuguuaucacagugcuuugaagguagagaugggaaauggagaccugauggagagauucagggagaggcucaugcucaaaaaaaaaaaaaaaaaaaaaaaaguggaugccuccugaggaacaacacacacaugcacucacacgcacauguacauacauguauguaaacacacaugcauacaugcauacacucauaugcacacacaugcacacacacaguuaugucugcauauuccuugcccacauguacacacacacacaaauaugcacauccacauccacaagcacacacacaauguuauaucugcauauuccuugcucacaugcacacacacgcacacacauauguagacacaggcacacaugcacgugcacacacacaauguuauaucugcauauuccuugcucacauacacacacacacacauacacacaugcacacacauauguacacacaugcacacaugcacguguacacacacauguuauaucugcauauuccuugcucacauacacacacaugcacacacauauguacacacaugcacacaugcaugugcacacacaauguuauaucugcauauuccuugcucacacacacacacacaugcacacacauauguacacacaugcacacacacaaugcuauaucugcauauuccuugcccacuuccccucacaucccuacauuagccucugugccacccagagcuacuuuucucucugggacucagaagagccaccuuccccuguacggcacccgugcauauggauaggcacaacuuacuguacccuaucugauguaaucuuuuuucccuuauacuuuagugacugggaagggaccucaguggcugaagccugccuucucugggaugaucauagcagcuguaggauuuggaacccuagcaggaggccagcaaagguaccagguuugacugagggacacuccuuccuggaccuggugggaauaagaacagaaacugucuuuaccuuuucagacucugcucaguagaaggaauccaguggaacgcaguucucauuuagaaggaaugcaguggaacacaguucucauucggagaccuugcuggcuuucuaggcagcaggagauggagcccggagccuccaggcacaccagacacguuccuacuacugagcccugggcucuauugguaugagcaugcucauuucuggcuucuuccccucugucuuugcaggaagaauagcaucuuggucaggacaagaaccccagccuggaaggcugcugcccacuggcuucccagguuagcggcucuggguucugguaggcugacaucugcauagagcaguuuuguuaugagucaaacuagaugauauccucccuuuaguuuguccugaguccugaccacucugcucuaugauugguagacauucuucucccucucucagcuguggguauagcacaaugcuggccugagucaggcagaguucaauggcucaccauggccccagcucucaaaagauccuauauaaacaagaggcccaggucuauuaggggcucuccguccuccuucauccuucaugccuggucagugcugguaggguaccuucccacaggaacuucccuacauccaucauagaauagcaaguggagacuggagagcccauguagucuuuacccaccugucuaaaagugaacuugggggucacaggggcugcaggcugcccgccccuguuugaacaugacuauuuuauauucaugguugucauaaaagucuugcugguuuggguguugaauuuccaauacaaguaagagagaaggagaaagggagggagggagggagggagggagggagggagggagggaaggagagagagagagagagagagagagagagagagagagagagagagagagagagagagagagagacccuaguacuuucagaaacacuuaaguauuuggcuggcuaaaaccugauaauaaaauacuugaaaggauuuuuuucacaacucuauuaucagaaguuggccucaccuccagagacugaauuuggcagagcuguuugcugugagaugaagcaagaguggaaaaguuucuuaaaguuccaaaucaaggcauggcucacuccagaagacaaggcagaagaaucaugaccaccuagccugccugggcugcuagcuuacguuuacuggauuaacuaacauacacauaucuuccaagccauccaaacacaaggcagacauacaacugcugcucuuccuguguuuccuggccaugucuguucgaacccugggacagcuaaccuugcaguaacccaggaacuaacaggcacacagcagugucugcaggucaucucaacaauaaaugagcagaacuaaguauaccucucucaggcuuugccuuucugacucuuccugauacaaacgugcugaaaaauauuuagcaggagguacgguuguuggguaauagcuagccuuguuuaaaaacaggaaacucuggggauggagagguaccuccagcuccaaaggacugugacacccucucuggcuuggaaguaccugcauucacaugcacaccccacaagcacacacauacacacauacccguaaauaauaauaauaaaaccuaaacuuuuaaaauaaacauuuuaaaacaggaugcuuucauaaaauuucuccugguguuuucauaauuaaggcacaguuguuagaaacuauaaaauuaaaugaaucucaaaaaauaaaaguauaagaagcaaagauuucuaugacaaugaggaaucauaauaugccugcuuuaaaaauagcugcccacaucuuugaaaaugcuuuuagauuuacuuuuuuguuaucuuauguguaugauuggguuuuccuacauauauguauguguaccauguguguuccugguguccaaggaggaucagaagagaaugucagauucccugggacagaaguuacuggugauggugagccacugugugcauagcaagaccagaccccagcccuuggcaagagcagcuagcaaaaccgcucuguggcacucgggugggcguucccacacuugccccguccguccguacucaccuuucguuuucuucugggaguuggaauuacagagaguuaaaauucuuuugucuguguguggaagcuauaagagaacccacucuacaugagaagaugcagggacauuuugugguaaagaaagucugagguucaagggaaagaauguguuuaguuugaagguuaauuaaaaaacagcuucagaaaaaagaaaagaggagggagaaggagggaagaaggggaaagaaaaagagaggagaggagaggggaggggaggggagggaagggaagggaagggaagggaaaggaaaggaaaggaaaggaaaggaaaggaaaggaaaggaaaggaaaggaaaggaaaggaaaggaaaggaaaaaaggggggcuuagaauggggcugggagagaaaggacaagaagguagacugggagaggggaggaaggacaggaagggaggcugggauggaagggagaaagaaggguaggaagacagacugugggggaagaggaaggauaaaaaaaacucaacugauacagaaaguuggaaagagauaaggggcuggagagauggcucagcaguugagaacacugucugacccuccagaggguccuaaguucaauuuccagcaaccacacgguggcuuacaaccaucuguaaugggaucugacgcccuuuucuggugugccugaagacagugacaguguacucauauuaauaaaauaaauaaaucuuuaagagggagagggagggggagggagagaaagaaccauaacagagacaaaggacugugucaguggucauguugaccauugucagaggccaugaagaaagcugcuuacugacuugcuuccugugguuuuguuuucuuggucugcuuucuuacaccauggaaccaccugcccaugaguggcccuccucccagugagcuagacccuuucacauucaaucaucaaucaagacaauguaccacaaguaaauucaguagagucauuuuuuuaaaaauuaagguucccucuucccaaaugacucuagccugugucaaguuggcauaaacuauuuuauauauuuggauauuuauauauauuuggacugugugacccaggcuggccucaagcuccaaaucuuucucuuccgucucagcuucuccuuugcuuuagcauccuagguacugggaucacaggaaugcccuacaucucugagcacaaauugucuaaaauuggauucauuguagauauuuuuugagacagaguuucacuauguaucccugacugaccuguaacuuuuuauguaucuaccacuacagcuucaaacucacaagagauccucugccucuguuuugugagugcggggaugccuggcugauaacuuccuuucauaaaaaaaauguuuuaaagcuuaauuuuauuauuuuuuauguauguguauugcaugugugugcaggcuccugcagagacuggaagagggugucaggucuccuggagcuggaguuacauacaggcaguugugggccacugggaacagaacucugguucucuggaagaacagcgagugcucuucagcacaaaggcaucuuuccagcucuaguuccagaacuuuccaaugcuaaguucuguaucaccuuucuuaacuucugauuucugcugaacuuuugcagauuggccccacaaaacucuccaugaauccuuacuccagaggcugagaugcaacccuggacgauuaaaaaaaaaaaugguucccuuauaauaaaguacaaaaucaauccugucacacuugugugaguauuuauuuaauuauaugauaccccaagaaauccuacuucucuauaguaguucuaguuacuuuuaaaaaaaagauucauuuuauuuuauguguauaaaugcguugucagcguguagugugaguaccaugugcccauggaugucagaauaauuggagucacaguguuugugggcugccuuguagguacugggaauugaacucagguccucugcaagagcagucggugcucuuaaccacugagccuucuaaacuuuucuuaaaacagauuguuuuuuucucuaauacagaaauaucuagauuuucacguccaguugccuuaagacacaccccccaccggaugaugagucccacaaauucaggccauuucuccagccacuggcaguuagccgcugucuacccauguucucacggccucugccaguagcuucgaucaaggagauuugagaaaggacucugcccagcacacauuucaaaggcaggccccuugaacuggguacaaaugucuagaaacuuaaagaagcuauauauagguuauagaaaccuggucaauuaaccuuuguaaacugaauuggaacugccugacccuggcugaaggggaaaaugagugagaugcuuguuuccauagaggucgaguuauuuguauaagaaagaaacugaaucagggccuguaagauggcucuguguauaugcaugcuuacuaccaauagugauuauuugagugucauccauggaauucauaugguggaaggagauaacauugucuucugaccaucacacaugcacuguggcaugcucaugugcacauacacacagacagacagacagacagacagacagacagauaaaaugcuuuguuuggucccuggcuuacaagggcucuauggucucacagacaaggacuguaacugacagagggaccaccagccuuaaaguucuuugggcaucucuagcgggagaagcucugcagauggauuuugaugcugggacccugaccuggcuccgcugccagcacaggcuucugagaucugcucugacgcuccuuauuugacuagcacagccacuuaguaauuucaccagaccuaugcaaauacgcagggcacauucaggaagacuaggcaugcuucugaaaauaaaaaucaguuuacugugaucaccuuugguagaaauggguuuacuagcaagauaacuaacucagucaggaaagugugaagaccuguguucagaugccagaacccacauuuaaaaaaaagcaauaccaauaaacaauccacauuaaacaacaacagcaaaggggcuggaggggugucucagugguuaagagcacuugcugcucuugcagaggaccuggguuuaguccgcagcacccacaugcugguucacaaauaucuguaacuccaguuccaagggaucagaugcccucuucugaccuccacaggcaugccaagcuuguggugcacagacauacaugcaggcaaaaugcaaauaaaaaugaaaugaauaaauauaaauuuaaaacaaaacagacuguaggcaacaaaugccugcaagcguggcucuggggagcagaagucagaggaaauccagaguucccuggcugguuaguccagcccaaucacugaguccagagucaaugagacagacccugucucaaaacaauaaggugggcaggaagcaaagaugacacuggacaugaccucugaccuguacaugcacccuggcacaccuacacacaugaacaaauagacaccuaaauguuuuuuuuuuuuuuuuuuuuuuuuagauuuauuuauuuauuauauguaaguacacuguaggugcccucagacacuccagaagagggagucagaucucguuauggaugguugugagccaccaugugguugcugggauuugaacuccugaccuucagaagagcagucgggugcucuuacccacugagccaucucaccagcccccaccuaaauguuuuuuaagaagaaaugauauagagaaaaaucauauuuucauagaaaacuacguuugucccuagcaucuacuaucuucugccuuucuggacuacuaaacaucuacaaaaugggcaggauccugaaucagcuaguuagcucccgugcauggcugucacugcccaaauccaugguucuaauuuccucucaggcuucugcuuuggagcguagauccugcccuucucccgaaaguccuucaggcugaggcugcacaucauaaaccccgcuccggugcuucugcugugggcagguuucaaagggggugacaguggcuacucacacauuccugggaccucaacugugcaagaacuggaaggcccagcccgcagaccucuccaucccuacccgugccugcccugcccugcccucgcaguucauacugcuuugcagccucuuccaaugguucaugucuguuuugcccuuggucuguauaaagcccucuuuaguggacugugauaagaaauacacucaccaaggucugcacugugagccugcuuuggagaguguuagguggacaacugcugggauucauggugucaccucagaccggggcuguaggaaaccagaacccgccacuuugacguuaccugauacuagaagccaaaaucgauggagaacuagcaacacauacaaagccuaaccccacccaacugccuaaagcaaaaugagaaaccgcuacuugugcaggaaaucaguacuacauagaaaaugucagagagagagagagagagagagagagagagagagagcauucccugacagaagauaucugcauagcaaggagacugcuaaugaccuuccauuccuccucaggcuccugagaccugccuuucuccugcagaagccccacacccucauccccucgagauuccaagcaaugcacgccuuugaucccagcacucaggaggcagagaauaguagguagagcucugaaaguuucaggccagccuggucuacauaaagaguuccaggcuagccagagcuacauaguaaaaauuuaccaauuaaaaaacuuuaaccccugucaauggacaaagagacaccuuauuggugaugccauucuuacaucagucagggguagagcagaugauaguccuauguucauccuggcccgaugccuggcuuggugaccaaagcuguuuuaugucuaggacucaucaaaucaaaucaaaucaaaucaaaucaaaucaaaucaaaucaaaucaaaucaaaucaaaucuagguagcauggcacgggaagaggaagauagacagagaucuguguuccaccaugccacaauguuugggcagggaaagauagccauagaucugcccucuacccuguaugagcaggccauagacacacauagccaccugcagugcagcacaugaggagggaaaaaggcagacagaaaccugccacagcauccacagaucugccucuggagcacagcacaggcaggcuguggacaaccacuugccaaaaugccaugcagcucacccacaccccacacccaccagggucauguccacugugcugccugggugaggugcagggccugcucacggccgugcagcuuggaccaaaggaugucaccccagggccccccagcaacauggccagccugcagugggagccaccacaaugugcgagcaugugguggucagaugggagagagagaaguggaacagcuuaaggauuaugaagagagcuggaucuggagacuggaggauggagaggagcagccuguugugaguggccagccaccuggggccauagugagguggcagccugagcuggguucauggcuaugcagagguggguguugauguccacggcucacauuaccauuaaagaacaugggauaucccuugucagagcagauguccaagaacugggcagagcuggccccucccuucacugguugccgcccucuggagagcuugccccaucacucaccagcagcacuagggagagcaggcccugcacccucacccaggcagcacaguggacaugacccucguggguguggagugugggugagcagacccucagagcaugaguguggaauagcugacucugccacuugucugucaugagguggcacggguguagagaugaugccccuccucuccacacuuccaguaguuggaaagcuguccacaaggucauaaguucaggagagcuaucccugccccucacuggcugcaacauuugggagagugggcccugcacccugcuuggacagcacaacagagcugacccugggggugggggcuuggauucuugaugccuuuaccccagccucuccaguguugccauuguagguguuugguccuacccaugguucuaaaaaauuuuuuuuuucucccaucaaucugggcaauguccaucaaagucacgcaccaagcaaagagucugggcagguggaagaagacugcuuuccucccucauaggccacucucuggggaaccugacuccaucugcaagggccaucaaguguuacauccacuggcccucugauguccacaugucuccuccauugccuagaccugucuucagagcucuuguuccuucacagacaggguuguuucuuugguccggcgcuccagccucaguggagauguccuaggauaacaccuccccuucucuuucuacuucuucaggaugccucuccuaucccgaaagccauguugaugucuugugaagcaccccagcagccucuguuuaaacagacagcuggggcaagcagaaccugccugacccugacacuguagaaccuuaugcagggaggaguguuguaaauacauaaaauuaaauacaaggaauucuccccagaaccucagacgagccacacaucugacuacaaucaaagaggguagacucagagaaagcaaagagaaggccaugcugcacagagucagagacuauaggacagaggcagaccugcagggcaaggagcugccagaauugccagaucuuggaggaacauagaggggauuccuaucugaggggaacuagucuugcccacacacugacauguagccucuggccaucagaauauauaguggcaaauuagacuacugguuugugcucuugaccuucagcauaauaaggacagcacaacagagcugacccugggggugggggcuuggauucuugaugccuuuaccccagccucuccagugcugccauuguagguguuuggucccacccaugguucuaaugaaguggccacaguguucaagugacauuaaucuaugacaaucauaccucuggguuaggacaaggucaagucaagcagcagcugucauaacucagaauuucagguuggcgaugagaacaaaaauuugagcuuucugccaagcugggacauccagugaaaagaucaguaacugcaaugagugagaagagcaccacggacuguauaaaguaccauggacuguauaaaguaccacggacuguaaacuuguuuguuuauacacucaugacugaagaugagaaauuucacuucgguacugaugaaauuacgaugcgucuuuucucccuacaugaguucacaucacgccuaauucuagucaccuagccucaaacaguccucucaacagaaugcccugugcaaggguucuaggguccuguggcucuguuuaauagguuauauuuauacauccagcacuagcuacacuggcgagaacgacccagaagcccauacccuggacuguuugucagaucugagaucucaaaucccacacugugauggcacaacuccaggccccuugaaucacaugcuaaagccuccaugaccucaucugaaaaugggcauaauuacagaaccuacaucaaggggauguuggagaauuacaagcaaagguaaaauccuaaauuauuaagccuaauaccagcacacagccaguaugugcacugggugcuaauuccugcagauacuucauaagcaauaguuuugccaagcaaucccuucucuuugauccuccccuguggagcaacaaguucagggaaaacaaacugguuuaaagauaaaguggagagagagagagagagagagagagagagagagagagagagagacagagacagagagagagacagagagagagacagagagagagagacagagagagagagacagagagagagacagagagagagacagagagagucagagucuacaaaggcagauggaccacggguuguucugcaggcugggucccauagagaggaccuugccuguuuguaagguggcuguagcuguacuaaauguauccguuacacucuuugcugcacauucaaaccgaaacaagauugaaugaucuggguuccaggagucucugccacacuguuacucauaaguagaguuguugucagcaacauuuaaaaguauccucugcgaaaacuaaaggcugccucaaaguuccuucuuagaaggaacacagaagaguguuuugaggauuucucuccgcccccugccccaacaccauucaccaagugcaauuuuuuuugugugugugugugugcuugcuucugggagguaaaucacccuugaauuuggugacagaaauaguuucucacugagauguacaugggacuuuuuaaaaaugcaaugacaaaaaugacaagaacuuuggagugcuaggagccuuggguuggugcaucccuggauaucagcagggugaugaagcucccuuuagcccucaucccugucucccuucuucaucuccacuuuagcuauucuccuucgcaugugucagcacuagaagcccauuccaggaccuggguugggcauacucuauaaauaaacaugaaacaggagcaucuucaucacaggacauacuccugacagaugcugcuagccuccacccaggucgcaggcaaauuccugccuuacugccaugaucucuccaaaaccuaggaacuggccuucuucucugaguucuuucuugguccacccagucccagagccaaaaucuaggacucaaaagaucacuugguaucagcacuuguccaaggacuuuggauauagcauccugguuacuuuucuauuuguauguaugugugcacccgugggccacagugcacaugugauggccagaagacaauguggauccacaauccagcuuguggauuccauggauggaacucagaugaucacccuuggcagcaagcacccuucuacaaggagccaucucacaggucccgagccaguuucuuucuuauacaaauaacucuaccucuaugaacacaagcaucucacucauauccuucuucagccagggucaggcaguuuccauucuguuuacaaaggcauacugaccagguuucuauaagcucuuugagaaaagcagugcuaugacuccauuucgaagauggguaaacugagguucugaggauuuaaguaacuugcucaaggucccagggcacagagaguauuugaacucagcaucugacuucuaauccagaauguugucacacaggguggccaucagaaugggcaagcccugccuguuccacagagccaucgcuagaaggacaacauugcucagcauccugucguuaguuaccugugcuugauaggcaggcucccauaggcccgccaguagcucaagacuaguuaguggguaugcaacaccuuugaaaccgauuaccugauuuucaaaacugcauacacaaucuauacagucauggaugagaaaauguuaaauacuuaucuuuuguucacaaaguaauguuuuacauuuuuauugaauaaaucaaaggaugggggcggguggggggccgggacagcguuugcaacacaccaaggauucaggauacauuuugucucuguugaguuuuuuuucuagagcuaaacagcaacacaaacaacgaccacgaaaaccaauccgaggcaguggagcucagcagguagaggugcuugcugccuauccuggccacuugaguaaaucuuugagacugauaaaauggaaaaugggaaucgacuccuaaagauguccucugacccgugcacgacucacacagacacaauuuaacuuuuaaaugaagaaaaacaacaacaaccuucccccaaauauuguuacgacccaggucccaagugcccacuuaauuaauuaacagaccucagcacauacagggaaccaagugucuuggggcucagaagucagagcuuuuuuccugacaccaccacccccccgcccccgcccacgcacacauacggguguguauguggauaggugccuacagauguucucaucucucaagagugagaaggugacagcugcccaguggagcaggagagagugugggcugcccggguucucuaccuggaagacuagggaggcuggugaggcaccacaguaaacucaucacagaacagcaguaacccaccaggaccccacaccuugggaccagcauagagguugggcucuaguuggcuuuccucucucuuagucugcuuccauagcgggaccugaaaggccuucugccuuacagagguggggauuugcauuccuugugagguaggauacccacgcaccucccaacuuccccuauuaccagacccgagccccagaaucuccggguauggcgacuccuugccaccuguaguggacagugugggcaggaggcagguccauggguugccgaggugccaacugcuucuacuccuagccucacuccggccggccccuccugccacugacgcggagucccuggggccguucacucggcuagcacccgggcagccgcacacccgaacuccagccucggagccucgugcgaaauaccuggcccuagcucgggucccagagcugccuaccugcuccgggccgggcgucggcgucggcgagggcugggcugcagcguugccuccucgccuggaugcgggacggcggguuauaagggugcggagcagggaggcggcggcgaggggacugccgcaggcuuagcgccuuucuuggcggaccggcgggaaggcagcgcgggcacucagccguggcgggaggagggccggccacccgggccccuggcucccacgcgcgccccgccuccccagcuggcucugcccgagucggggucugggccccgcuccucccgccuccuucccgccgccgcuuggcgcgcgucgcccagcuagccccagcggggucuccuccuccgcggggcccgcaagcugguagccggagucuuggucgaagcgggaccggaccgcgaccuuuggcggggcucagggcgccaggaagggugcgcaggcgccgaggggguggacacagggcgcccgacgcccuguacucccucugacucucuccuccgccuucuccccagaugcccaucuaccccgaucccccucgcugcccuuacuguccuaagccugcaacccaggggcucaggagugcccucagcgggguggcugcgccucuuccagggcucgccccggccugagaaaaccgagaggaccgacugaaacugaacauugaaagccccggaggagaaccguugucguucggccagcaccagcgggguuccgucucugagaacggcucgaagccccccucgauuugccuggcagagaccacagcccgccuggaaagagggucgagcgcagacccucuggguuggacucuucaaaguccagccagaaguugcgccuccugauaccuacacaccccgggggccacggccugcaguccggguuuccuagcccaggguaucagagucuuuccuuggauuggugugcuaggcgaugcccaacggaugcccacaaacugugcacauagagcggcucggaguuagucaggggacucuucucuggcucaagaagucuucuucaccacccgccaucuccccucugggcaagugagcggucuccggugcccucaucuaccacgcagacccguagucuggcgcacagaaggaguuggguccuugugggaccccuuaguggcacugcagagugguccuugcccaagguguucccacaugcccuggaagucgcuuuagugcagcuaguggcguugcaagggagguggguuggagcagaccgaaucucucucgaacucgaaagccugaccugguguuaggccaauagcuacgaggaguaauuauuugcgagcugcagauuagagacaaagaugaauaccaagcaagaguuugggacugguugggaacagaaaaugccaggacgcuggccgcgcacucugcagauccucuccgaauggugcaagcaccgccauucauucauucauucauucauucauucauucauucguggaaauuagaugcagcggugcggaagagacugggagcuaugagcuggaccgagcaauacuagauuccggucuuucagaauucggaacuuagcuccaaaggcaguggcugagccuuaagugauccucugaagcuuugggugcagacaggaacauccaaccucccgaaugacaccggaauggggagccuuguggggcacaggacgcggggugcugcgcgagggagggagcagagcgcuuuggggagcgauccuggucugaaguccaguuggugcuguauucuacgugcccaccgaggcugccgucccggguaccgagccacaccucugaaucaaguccacacucuaacuagaaccuccaaaaaggugaggcgacccacgagauccacaugccuucgaauucguuccgccacagaccugagaagcacuugaacgucacgaggucacgcugcagguggucgcucucaggaaaaccucaaagcaaaccuauauuuauacuuauacguggaaaauacuuugcuuuguucuguuugagaaagggucucacgcagcccugcauagccuccaacucuauagguagcgaaggaugcccugaacaucugcgucucugguuucagguguaggauuuuuuuuuuuuuuuuaaugcaaaccaucgugcgggguuuaugcgaugcugcggaccaaaaccuggguuucauauaugcuaagcaaucauuuugccaauagaaccgcacucucagcuccuguaacaaaaaauuuguuaucuacuaaagagguguaucgaaauacgacuauauacuuacacauaaauacgcauuuacauguaaauaaauguauguucacaaguacagaggucuaguuacaaccugaauuucagauaagggagucuuuuagucuaaguaugccccggguaacuuuugggaacauauuuauuuugugauuuaucugaagucagaauucagccuuccguuucgggauuugcagggagauccgcuauagcgcaaaggcgcucagccccuuuaagacucaaacucggacuucccgccccacaaugccgcgcggccgcuugaggcucccauuggcugcugcucgcuuccgccccuguacuuccggccgcugccuggggcgguugcgggagguacuucggagccgggcuggcccgggcuggccguggccaugaacuucucggagucauucaagcucucgggccugcucugcagguucuccccggacggcaaguaccuggugagcugcggcgcgcugggcggaaccuaagugugggcgcgcgacuugugcacggggccggggcgggccgaaggggggcgggaagggggcccgagccgggcggccgcggggacucaggcuggacuuagggggcggggugggaggugggagagggaggcaggcagagggguuucagcccagaugagggagaaccagaugauuagagagaacgaaccugaagccgaagagggauccaggccagccaggcugggggauccuggcaggugaccaggguggagaaagaggacguggagcagaguggggauggaguugggguugcuauucuggcagguggucaggguuaggaaggaggucuuggagcagguggccagggcugggugggugccaggcucccggcuccaguuucccuucaucaaaguuggauaagaugacucugcuuucacacauuugagggcacaggggauggcagcucauugcuauuuuguauguuuucugugagcgagcugguuaaacggggcccuccuuugugaaacucgucauaagcaaaugguuuaaauaacuagcuuucauugccaggguuggauguuagcugucuauucuuuggguggcagaauaguguucagauggguguuucaagguacgccaacaugaccauugugcauuuguagaaggcugacguuaggaagccaucagggaaaacucaagucuuauuuuaaaaaacugugguuccgugccagucggguagcuuggcuaguaacgguaccugccaccaaaccugaugaccugagucccagcucuaggacccacuuaauggaaggagagaacugucuccugcauguuguccucuggccuccacauaagccguaacuagugccugacccuucucacauacaaaugcaauccuaauuuuuaacaaguuuucuuugauuaaucuaucauucucuuuuuaacugacugauaccauugauugauugauugacugauugacaggguuucucuguagcucugaccagguuggccuugaacucaaagaucugccccuugucuccugagugcugggauuaacggagcaugccaccaugccuggcugucuugauucucaguucacaccccugcuguguuuguccaggcuuuugagacauccuuuacccuccuuauacacaucauccuaacaauguaggaagugucaggguaggaccugcuuagcagggaaagguacugccaugcaagcccgaggacuugagcuccggcucgggaacccacguaaaggugggaggagaccaucagccucgcacacauugauacauuuuaccuuuuuccaagugccuccagagacuaagguugcuuuacgguucugaaagucucagugaacagcaaagaaguugcauuuggguuagcugauauuugugcuugccgcucaucaaaauaucguggagcucuuaauaauuguuucuuucaaguuuuguccuaaauccugagcagagcgaguccauguuuccaguguuggugucuuaagugauuccuaaggaauccauuguaacagguuacugcucaccaaacucuaaugugagaacacaagcccuuugauagguccuccuucugaucugcacuugcccucuugcucucuuuccacagaagacaaauguggcuucauuaaaaaaaaaagagucugugugugugugugugugugugugagugagagagagagagagacagagacagagacagagagacagagauagaaacagagagaugcuacaacacacguguagagggcagaggacaacccccaguguuauuccuuaccuuccaccuuguuugagacaaggucucuugcucuucacugcauaaagcaggcuagcuggcccacauguaccugccucagccuccccucugccuccccucugccuccucauagaaacuaggauuuuaaacaguuuuuaggauuaacacaguuuuauguggcuucugugcauccaaaccuguuucugaggcaagugcaaguuuuuggcuuuuagacaauggcauaauaugcaaagcuggccucagacucagaaaguaguugagcaccucccuaguacagugauuacaagugugcaccaucacucccaaguaguaaaaaaauacacacacacacacacacacacacacacacacaggcuuuuugagacaguuucucuguguagccccagcuguccuggaacucacucaguagagggaggcuggccucaaacucagggaucugcccaccucugacuucugagugcugggauuaaaggagugcaccacccccaucuuuaaauuuacuuguacagauggcucagcggguaagagcacugacugcucacccaaagguccugaguucaaauccccgcaaccacuugguggcucacaaccacccguaaugagaucugaugcccucuucuggugcaucugaagacagcuacaguguacuuacuauauaauaauaaauaaaucuuuaaaaaaauuuacuuguacaaauuuguggguuagaguaugauaauuugguuaauauauacuguguggaacuuuuaaacuuuugaaugcuccaccuuuuaucuuuuucuaacucauuuugcaaugagacccauaaguuuugguccacaugaagcuaagugugucgaacaggaggggaggagcuggccauugaggcaaggcucccugcuguagaagagaugcuaucccgugcugucugccucacuuuuuaggcuuccuguguccaguaccgauuagugauccgggaugugacgacccuucagauccuucaguuguacacaugccuggaccagauccagcacauagaguggucugcagacucccucuucauccugugugccauguacaggcgggggcuugugcagguuuguaccaccauguauuaguagaguguauagaugggugcuacaugucugugggccuugaacaggcaugugccacuuacauauaugauguguguaggcaggcacaugccacauauacauaagacucacauaagugugucucauguguaacuaacuggucuggcgcuguuucuguagcagaguuagaauuaggaaacguuuccaggagugugacuaggaaggaguccagguguuugcacccuucuuucagguuuagggggaaaugcaaugagacucaagguugccuucuuuucuuauguguaauuuauuuauuuuaugugcauugguguuuuaucuguaugcauuucugugugauggugucaggucucagaguuaccgauagcugugagcugcaguacgggggcugggaauugaacggggucaucaggaagagcagucagugcucucggcugcugaggcaucucuccagcccccagauaugcuuucuuuuaaaauguaaugcucucuaauaguuuaauccaaacacuuuugauguggaaaaacaaacaaacaccaccaaaacaguaaauuguucucagucuuugagcaugauuuuucuuuuuuuuuuuuuuuuaaagauuuauuuauugguuauauguaaguacacuguagcugucuucagacacuccagaagagggcgucagaucucguuacagaugguugugagccaccaugugguugcugggauuugaacuccggaccuucagaagaacaguugggugcucuuacccacugagccaucucaccagccccgagcaugauuuuucugagcgggagguauuugcaauggcaguggaacaacuuggacaggguucuaggaaguucuagaagguucuagaaggccguguuccaguauucacuaagccuaacuaaugaggucacagggaugggcacaugagcagacccuucaaaggugcacugcagugaagucaccaggaaguguggcuuguagccacugggccaucugagguagcaugguguauauccucucccucagagaggccuccugcgugguacagcuauuugcacuccucuguguuucuuuuaugaaucaaggucuggucacucgagcagccagaauggcacugcaagaucgacgagggcucugcggggcuggucgcuuccugcuggaguccagauggccgccacauccugaacacaaccgaauuucauguaagcuggccaaacguagcccacucuguucuucgccuaaaauagccugggaaugugaaagucugguucuggagcaguauucaggccagaguucauaaacaguauaauuuuuaaacucuauuuuaaagaaaaauaggacauuaaaaggaguuggcaagauggcucaguggguauggcucuugcuaccaagccuugccacaugguggaggguaagaacgacagaugccccaaaguuagaguaacaagggaaaauguaugucuucuguaaugggcuguuacaggcugcagugcucaugcugacaucuuaaagggacaggugcucauguugacaucuuaaagggacaggugcucauguugacaucuuaaagggacaggugcucauguugacaucuuaaagggacauuuggccugggcuuuuggcugcauauuugaguguuuucuagaccacuuuggccagcaaucuucaugcuuauggaguucugcagaccagaguccagcuuccagaucucauagacuugggcucagucccuccguuaauggcccaaaggaaagguuacccacugcagaauuuauaaacuguuuuuuaauguacuuuuuuauucagcagcuguguuacacucacugaaauggaaaggaacauuuggacagagaguagacuguacagacugccucuguacacuguuaaccuacugcuaggucauagccacugugccugugacauuaaagugaauggcaacauccuguguggaggaauaugucacagcaaggggacccugaaaaauauacccucccuuuuuguuguauugagaugggaucucacuguguagccuugacuggccuggaacgcacuauguagacuaggcuugccucaaacucagagagcugccugccucugcuucuugacuacugggaguaaaguagccaccaguccuaucuuauuccaagccuuuagauuuuagcuucuaaaagucccacagacuucauuuaccaccagcuaugcucaguagucaggaggugacccugugcgcaugacagauucguagaguggacacauaacugagagucauauguucccgcucacaacaguuagaucgcuguguacucuucugggggcaggaaguccacgugagggugcugcaagauggagagaggcccagcucccaugagacaaggggaagacgauugaauuguguggcuggugucugucugguccguggaagacacuccccugcacacgcacacuucccagagcaccuccaggccuugagaggcugccagccuccagagggcaccuuugacugcauugcacaaaagccauuuucaccuuuuuuggagagucuugggguccccgaugcauaugacacugugcgguuuacagcagcucacagguuacauugccuguacaagggcccuccuagccggcauagcugcugcucuuguuccuugugaggaaaggcucucuggggcacacucaccugccgucugcugcugggcaugaguugugaggcaccaguggcuuuggccuuucuuaugcaccucuucuagugucuggauccuuccaggcuagugcaggugggugugugcgcagcuuccaggcuagugcaggugggugugugcgcagcuuccaggcuagugcagguggguaugcgcagcuucccgaggguuugcaucaggauuugaaguggcgagacguugcagcaucguggggcuuuugaaaaucucaguuacucuccacuuuauauuuugaggcaaugucucuuacuugaacccagagcuccccaguucugcaguucagcuagcuuccugucccuggggucauagacaggucaccgcacacccuggggugugcaggagugcugggguuccagacucacuugagcaguaaggcuuccccggagauuuccccagccccacacugugugugugggcucaguugucaccuggcgaauggagacauuugcucucauggcugcucugugugggugcacugaaguaaacugcacaugagugugcgguguggguccauguuuauguauuccagcuuuaagacucuuugugaagaugggaagcauccuaacccuucucuccccuuucccuggcagcugcgaaucacggucuggucccugugcaccaaaucuguaucuuacaucaaguaucccaaggccugccagcagggugagucugucuuuacacaguccuuguaacuguucugagagugugcacuuagagcagauagaggagcuacagcagcaccucuccccccagccuccaucacugugcaccccucccccagccuccaucacugugcaccccucccccagccuccaucacugugcaccccucccccagcuuccaucacugugcacccccuccccccagccucuaucacugugcaccucucccccagccuccaucacugugcaccccucccccagccuccaucacuguguaccccuccccccagccuccaucacugugcaccccucccccagccuccaucacugugcacaccucccccagccuccaucacugugcacaccucccccagccuccaucacugugcacccccuucccccagccucuaucacuguguacccccucucccagccuccaucacugugcacccccucccccagccuccaucacuguguacccccccagccuccaucacugugcacccccuccccccaagccuccaucacugugcacccccucccccaaagccuccaucacugugcacccccucccccaaagccuccaucacugugcacccccucccccagucuccaucacuguguaccccucccccaaagccuccaucacugugcacccccuccccccaagccuccaucacuguguaccccucccccaaagccuccaucacugugccauccucugugcuccuuccugugugucugugagauucccuccaugccauuucuuugacaacaggaugcuguaaaaaguagacaggcauuguccugggaggagaaccuuuaccuucauucacacagggcacucagcuugccuuuggugccuagcugucagcuucacuucacuaacuuuuuuuagucaagauuuauuuuuaggauguguguguguguguguauguguguguguguguauaagagagagagagagguguaucuguguguguaugugcaugcauaugugugucugugugcauguaugugugugagagagagggagagggagaggaagagauguguaucugugugugucuaugugucuguaugcauguguguguguguauagguguagguauagguguguaugucugucugcgugcauguguguguguaugugugugugugugugugcgugugguguauggguaaugugaaugcaaguugaaguuacaggugauagugagcugcuuguucuggguucugggaucaguuuucaggaaaagcagcacuuuuuaaaaaagauuuauuuauauuauacauaaguacacuguagcuguuuucagacaugccagaagagggcgucagaucucauuacaggugguugggagccaccaucugguugcugggauuugaacucaggaccucagugccccuaccugcugagcccucg

SEQ ID NO: 8 - RNA, 101365 nt, Mus musculus
cgagggcucagcagguaggggcacugagguccugaguucaaaucccagcaaccagaugguggcucccaaccaccuguaaugagaucugacgcccucuucuggcaugucugaaaacagcuacaguguacuuauguauaauauaaauaaaucuuuuuuaaaaagugcugcuuuuccugaaaacugaucccagaacccagaacaagcagcucacuaucaccuguaacuucaacuugcauucacauuacccauacaccacacgcacacacacacacacacauacacacacacaugcacgcagacagacauacacaccuauaccuacaccuauacacacacacacaugcauacagacacauagacacacacagauacacaucucuuccucucccucucccucucucucacacacauacaugcacacagacacacauaugcaugcacauacacacacagauacaccucucucucucucuuauacacacacacacacauacacacacacacacacauccuaaaaauaaaucuugacuaaaaaaaguuagugaagugaagcugacagcuaggcaccaaaggcaagcugagugcccugugugaaugaagguaaagguucuccucccaggacaaugccugucuacuuuuuacagcauccuguugucaaagaaauggcauggagggaaucucacagacacacaggaaggagcacagaggauggcacagugauggaggcuuugggggagggguacacagugauggaggcuuggggggagggggugcacagugauggaggcuuugggggagggguacacagugauggagacugggggagggggugcacagugauggaggcuuugggggagggggugcacagugauggaggcuuugggggagggggugcacagugauggaggcuuggggggagggggugcacagugauggaggcuggggggguacacagugauggaggcugggggagggggugcacagugauggaggcugggagaggggguacacagugauagaggcugggggaagggggugcacagugauggaggcugggggaggugugcacagugauggaggcugggggaggugugcacagugauggaggcugggggaggggugcacagugauggaggcuggggggagggguacacagugauggaggcugggggaggggugcacagugauggaggcugggggagaggugcacagugauagaggcuggggggagggggugcacagugauggaagcugggggaggggugcacagugauggaggcugggggaggggugcacagugauggaggcugggggaggggugcacagugauggaggcuggggggagaggugcugcuguagcuccucuaucugcucuaagugcacacucucagaacaguuacaaggacuguguaaagacagacucacccugcuggcaggccuugggauacuugauguaagauacagauuuggugcacagggaccagaccgugauucgcagcugccagggaaaggggagagaaggguuaggaugcuucccaucuucacaaagagucuuaaagcuggaauacauaaacauggacccacaccgcacacucaugugcaguuuacuucagugcacccacacagagcagccaugagagcaaaugucuccauucgccaggugacaacugagcccacacacacaguguggggcuggggaaaucuccggggaagccuuacugcucaagugagucuggaaccccagcacuccugcacaccccagggugugcggugaccugucuaugaccccagggacaggaagcuagcugaacugcagaacuggggagcucuggguucaaguaagagacauugccucaaaauauaaaguggagaguaacugagauuuucaaaagccccacgaugcugcaacgucucgccacuucaaauccugaugcaaacccucgggaagcugcgcauacccaccugcacuagccuggaagcugcgcacacacccaccugcacuagccuggaagcugcgcacacacccaccugcacuagccuggaaggauccagacacuagaagaggugcauaagaaaggccaaagccacuggugccucacaacucaugcccagcagcagacggcaggugagugugccccagagagccuuuccucacaaggaacaagagcagcagcuaugccggcuaggagggcccuuguacaggcaauguaaccugugagcugcuguaaaccgcacagugucauaugcaucggggaccccaagacucuccaaaaaaggugaaaauggcuuuugugcaaugcagucaaaggugcccucuggaggcuggcagccucucaaggccuggaggugcucugggaagugugcgugugcaggggagugucuuccacggaccagacagacaccagccacacaauucaaucgucuuccccuugucucaugggagcugggccucucuccaucuugcagcacccucacguggacuuccugcccccagaagaguacacagcgaucuaacuguugugagcgggaacauaugacucucaguuauguguccacucuacgaaucugucaugcgcacagggucaccuccugacuacugagcauagcuggugguaaaugaagucugugggacuuuuagaagcuaaaaucuaaaggcuuggaauaagauaggacugguggcuacuuuacucccaguagucaagaagcagaggcaggcagcucucugaguuugaggcaagccuagucuacauagugcguuccaggccagucaaggcuacacagugagaucccaucucaauacaacaaaaagggaggguauauuuuucaggguccccuugcugugacauauuccuccacacaggauguugccauucacuuuaaugucacaggcacaguggcuaugaccuagcaguagguuaacaguguacagaggcagucuguacagucuacucucuguccaaauguuccuuuccauuucagugaguguaacacagcugcugaauaaaaaaguacauuaaaaaacaguuuauaaauucugcaguggguaaccuuuccuuugggccauuaacggagggacugagcccaagucuaugagaucuggaagcuggacucuggucugcagaacuccauaagcaugaagauugcuggccaaaguggucuagaaaacacucaaauaugcagccaaaagcccaggccaaaugucccuuuaagaugucaacaugagcaccugucccuuuaagaugucaacaugagcaccugucccuuuaagaugucaacaugagcaccugucccuuuaagaugucagcaugagcacugcagccuguaacagcccauuacagaagacauacauuuucccuuguuacucuaacuuuggggcaucugucguucuuacccuccaccauguggcaaggcuugguagcaagagccauacccacugagccaucuugccaacuccuuuuaauguccuauuuuucuuuaaaauagaguuuaaaaauuauacuguuuaugaacucuggccugaauacugcuccagaaccagacuuucacauucccaggcuauuuuaggcgaagaacagagugggcuacguuuggccagcuuacaugaaauucgguuguguucaggauguggcggccaucuggacuccagcaggaagcgaccagccccgcagagcccucgucgaucuugcagugccauucuggcugcucgagugaccagaccuugauucauaaaagaaacacagaggagugcaaauagcuguaccacgcaggaggccucucugagggagaggauauacaccaugcuaccucagauggcccaguggcuacaagccacacuuccuggugacuucacugcagugcaccuuugaagggucugcucaugugcccaucccugugaccucauuaguuaggcuuagugaauacuggaacacggccuucuagaaccuucuagaacuuccuagaacccuguccaaguuguuccacugccauugcaaauaccucccgcucagaaaaaucaugcucggggcuggugagauggcucaguggguaagagcacccaacuguucuucugaagguccggaguucaaaucccagcaaccacaugguggcucacaaccaucuguaacgagaucugacgcccucuucuggagugucugaagacagcuacaguguacuuacauauaaccaauaaauaaaucuuuaaaaaaaaaaaaaaaagaaaaaucaugcucaaagacugagaacaauuuacuguuuuggugguguuuguuuguuuuuccacaucaaaaguguuuggauuaaacuauuagagagcauuacauuuuaaaagaaagcauaucugggggcuggagagaugccucagcagccgagagcacugacugcucuuccugaugaccccguucaauucccagcccccguacugcagcucacagcuaucgguaacucugagaccugacaccaucacacagaaaugcauacagauaaaacaccaaugcacauaaaauaaauaaauuacacauaagaaaagaaggcaaccuugagucucauugcauuucccccuaaaccugaaagaagggugcaaacaccuggacuccuuccuagucacacuccuggaaacguuuccuaauucuaacucugcuacagaaacagcgccagaccaguuaguuacacaugagacacacuuaugugagucuuauguauauguggcaugugccugccuacacacaucauauauguaaguggcacaugccuguucaaggcccacagacauguagcacccaucuauacacucuacuaauacauggugguacaaaccugcacaagcccccgccuguacauggcacacaggaugaagagggagucugcagaccacucuaugugcuggaucugguccaggcauguguacaacugaaggaucugaagggucgucacaucccggaucacuaaucgguacuggacacaggaagccuaaaaagugaggcagacagcacgggauagcaucucuucuacagcagggagccuugccucaauggccagcuccuccccuccuguucgacacacuuagcuucauguggaccaaaacuuaugggucucauugcaaaaugaguuagaaaaagauaaaagguggagcauucaaaaguuuaaaaguuccacacaguauauauuaaccaaauuaucauacucuaacccacaaauuuguacaaguaaauuuuuuuaaagauuuauuuauuauuauauaguaaguacacuguagcugucuucagaugcaccagaagagggcaucagaucucauuacgggugguugugagccaccaagugguugcggggauuugaacucaggaccuuugggugagcagucagugcucuuacccgcugagccaucuguacaaguaaauuuaaagauggggguggugcacuccuuuaaucccagcacucagaagucagaggugggcagaucccugaguuugaggccagccucccucuacugagugaguuccaggacagcuggggcuacacagagaaacugucucaaaaagccuguguguguguguguguguguguguguguguguauuuuuuuacuacuugggagugauggugcacacuuguaaucacuguacuagggaggugcucaacuacuuucugagucugaggccagcuuugcauauuaugccauugucuaaaagccaaaaacuugcacuugccucagaaacagguuuggaugcacagaagccacauaaaacuguguuaauccuaaaaacuguuuaaaauccuaguuucuaugaggaggcagaggggaggcagaggggaggcugaggcagguacaugugggccagcuagccugcuuuaugcagugaagagcaagagaccuugucucaaacaagguggaagguaaggaauaacacuggggguuguccucugcccucuacacguguguuguagcaucucucuguuucuaucucugucucucugucucugucucugucucucucucucucucacucacacacacacacacacacacacagacucuuuuuuuuuuaaugaagccacauuugucuucuguggaaagagagcaagagggcaagugcagaucagaaggaggaccuaucaaagggcuuguguucucacauuagaguuuggugagcaguaaccuguuacaauggauuccuuaggaaucacuuaagacaccaacacuggaaacauggacucgcucugcucaggauuuaggacaaaacuugaaagaaacaauuauuaagagcuccacgauauuuugaugagcggcaagcacaaauaucagcuaacccaaaugcaacuucuuugcuguucacugagacuuucagaaccguaaagcaaccuuagucucuggaggcacuuggaaaaagguaaaauguaucaaugugugcgaggcugauggucuccucccaccuuuacguggguucccgagccggagcucaaguccucgggcuugcauggcaguaccuuucccugcuaagcagguccuacccugacacuuccuacauuguuaggaugauguguauaaggaggguaaaggaugucucaaaagccuggacaaacacagcaggggugugaacugagaaucaagacagccaggcaugguggcaugcuccguuaaucccagcacucaggagacaaggggcagaucuuugaguucaaggccaaccuggucagagcuacagagaaacccugucaaucagucaaucaaucaaucaaugguaucagucaguuaaaaagagaaugauagauuaaucaaagaaaacuuguuaaaaauuaggauugcauuuguaugugagaagggucaggcacuaguuacggcuuauguggaggccagaggacaacaugcaggagacaguucucuccuuccauuaaguggguccuagagcugggacucaggucaucagguuugguggcagguaccguuacuagccaagcuacccgacuggcacggaaccacaguuuuuuaaaauaagacuugaguuuucccugauggcuuccuaacgucagccuucuacaaaugcacaauggucauguuggcguaccuugaaacacccaucugaacacuauucugccacccaaagaauagacagcuaacauccaacccuggcaaugaaagcuaguuauuuaaaccauuugcuuaugacgaguuucacaaaggagggccccguuuaaccagcucgcucacagaaaacauacaaaauagcaaugagcugccauccccugugcccucaaaugugugaaagcagagucaucuuauccaacuuugaugaagggaaacuggagccgggagccuggcacccacccagcccuggccaccugcuccaagaccuccuuccuaacccugaccaccugccagaauagcaaccccaacuccauccccacucugcuccacguccucuuucuccacccuggucaccugccaggaucccccagccuggcuggccuggaucccucuucggcuucagguucguucucucuaaucaucugguucucccucaucugggcugaaaccccucugccugccucccucucccaccucccaccccgcccccuaaguccagccugaguccccgcggccgcccggcucgggcccccuucccgccccccuucggcccgccccggccccgugcacaagucgcgcgcccacacuuagguuccgcccagcgcgccgcagcucaccagguacuugccguccggggagaaccugcagagcaggcccgagagcuugaaugacuccgagaaguucauggccacggccagcccgggccagcccggcuccgaaguaccucccgcaaccgccccaggcagcggccggaaguacaggggcggaagcgagcagcagccaaugggagccucaagcggccgcgcggcauuguggggcgggaaguccgaguuugagucuuaaaggggcugagcgccuuugcgcuauagcggaucucccugcaaaucccgaaacggaaggcugaauucugacuucagauaaaucacaaaauaaauauguucccaaaaguuacccggggcauacuuagacuaaaagacucccuuaucugaaauucagguuguaacuagaccucuguacuugugaacauacauuuauuuacauguaaaugcguauuuauguguaaguauauagucguauuucgauacaccucuuuaguagauaacaaauuuuuuguuacaggagcugagagugcgguucuauuggcaaaaugauugcuuagcauauaugaaacccagguuuugguccgcagcaucgcauaaaccccgcacgaugguuugcauuaaaaaaaaaaaaaaaauccuacaccugaaaccagagacgcagauguucagggcauccuucgcuaccuauagaguuggaggcuaugcagggcugcgugagacccuuucucaaacagaacaaagcaaaguauuuuccacguauaaguauaaauauagguuugcuuugagguuuuccugagagcgaccaccugcagcgugaccucgugacguucaagugcuucucaggucuguggcggaacgaauucgaaggcauguggaucucgugggucgccucaccuuuuuggagguucuaguuagaguguggacuugauucagagguguggcucgguacccgggacggcagccucggugggcacguagaauacagcaccaacuggacuucagaccaggaucgcuccccaaagcgcucugcucccucccucgcgcagcaccccgcguccugugccccacaaggcuccccauuccggugucauucgggagguuggauguuccugucugcacccaaagcuucagaggaucacuuaaggcucagccacugccuuuggagcuaaguuccgaauucugaaagaccggaaucuaguauugcucgguccagcucauagcucccagucucuuccgcaccgcugcaucuaauuuccacgaaugaaugaaugaaugaaugaaugaaugaaugaauggcggugcuugcaccauucggagaggaucugcagagugcgcggccagcguccuggcauuuucuguucccaaccagucccaaacucuugcuugguauucaucuuugucucuaaucugcagcucgcaaauaauuacuccucguagcuauuggccuaacaccaggucaggcuuucgaguucgagagagauucggucugcuccaacccaccucccuugcaacgccacuagcugcacuaaagcgacuuccagggcaugugggaacaccuugggcaaggaccacucugcagugccacuaaggggucccacaaggacccaacuccuucugugcgccagacuacgggucugcgugguagaugagggcaccggagaccgcucacuugcccagaggggagauggcggguggugaagaagacuucuugagccagagaagaguccccugacuaacuccgagccgcucuaugugcacaguuugugggcauccguugggcaucgccuagcacaccaauccaaggaaagacucugauacccugggcuaggaaacccggacugcaggccguggcccccgggguguguagguaucaggaggcgcaacuucuggcuggacuuugaagaguccaacccagagggucugcgcucgacccucuuuccaggcgggcuguggucucugccaggcaaaucgaggggggcuucgagccguucucagagacggaaccccgcuggugcuggccgaacgacaacgguucuccuccggggcuuucaauguucaguuucagucgguccucucgguuuucucaggccggggcgagcccuggaagaggcgcagccaccccgcugagggcacuccugagccccuggguugcaggcuuaggacaguaagggcagcgagggggaucgggguagaugggcaucuggggagaaggcggaggagagagucagagggaguacagggcgucgggcgcccuguguccacccccucggcgccugcgcacccuuccuggcgcccugagccccgccaaaggucgcgguccggucccgcuucgaccaagacuccggcuaccagcuugcgggccccgcggaggaggagaccccgcuggggcuagcugggcgacgcgcgccaagcggcggcgggaaggaggcgggaggagcggggcccagaccccgacucgggcagagccagcuggggaggcggggcgcgcgugggagccaggggcccggguggccggcccuccucccgccacggcugagugcccgcgcugccuucccgccgguccgccaagaaaggcgcuaagccugcggcaguccccucgccgccgccucccugcuccgcacccuuauaacccgccgucccgcauccaggcgaggaggcaacgcugcagcccagcccucgccgacgccgacgcccggcccggagcagguaggcagcucugggacccgagcuagggccagguauuucgcacgaggcuccgaggcuggaguucgggugugcggcugcccgggugcuagccgagugaacggccccagggacuccgcgucaguggcaggaggggccggccggagugaggcuaggaguagaagcaguuggcaccucggcaacccauggaccugccuccugcccacacuguccacuacagguggcaaggagucgccauacccggagauucuggggcucgggucugguaauaggggaaguugggaggugcguggguauccuaccucacaaggaaugcaaauccccaccucuguaaggcagaaggccuuucaggucccgcuauggaagcagacuaagagagaggaaagccaacuagagcccaaccucuaugcuggucccaaggugugggguccugguggguuacugcuguucugugaugaguuuacuguggugccucaccagccucccuagucuuccagguagagaacccgggcagcccacacucucuccugcuccacugggcagcugucaccuucucacucuugagagaugagaacaucuguaggcaccuauccacauacacacccguaugugugcgugggcgggggcgggggggugguggugucaggaaaaaagcucugacuucugagccccaagacacuugguucccuguaugugcugaggucuguuaauuaauuaagugggcacuugggaccugggucguaacaauauuugggggaagguuguuguuguuuuucuucauuuaaaaguuaaauugugucugugugagucgugcacgggucagaggacaucuuuaggagucgauucccauuuuccauuuuaucagucucaaagauuuacucaaguggccaggauaggcagcaagcaccucuaccugcugagcuccacugccucggauugguuuucguggucguuguuuguguugcuguuuagcucuagaaaaaaaacucaacagagacaaaauguauccugaauccuugguguguugcaaacgcugucccggccccccacccgcccccauccuuugauuuauucaauaaaaauguaaaacauuacuuugugaacaaaagauaaguauuuaacauuuucucauccaugacuguauagauuguguaugcaguuuugaaaaucagguaaucgguuucaaagguguugcauacccacuaacuagucuugagcuacuggcgggccuaugggagccugccuaucaagcacagguaacuaacgacaggaugcugagcaauguuguccuucuagcgauggcucuguggaacaggcagggcuugcccauucugauggccacccugugugacaacauucuggauuagaagucagaugcugaguucaaauacucucugugcccugggaccuugagcaaguuacuuaaauccucagaaccucaguuuacccaucuucgaaauggagucauagcacugcuuuucucaaagagcuuauagaaaccuggucaguaugccuuuguaaacagaauggaaacugccugacccuggcugaagaaggauaugagugagaugcuuguguucauagagguagaguuauuuguauaagaaagaaacuggcucgggaccugugagauggcuccuuguagaagggugcuugcugccaagggugaucaucugaguuccauccauggaauccacaagcuggauuguggauccacauugucuucuggccaucacaugugcacuguggcccacgggugcacacauacauacaaauagaaaaguaaccaggaugcuauauccaaaguccuuggacaagugcugauaccaagugaucuuuugaguccuagauuuuggcucugggacuggguggaccaagaaagaacucagagaagaaggccaguuccuagguuuuggagagaucauggcaguaaggcaggaauuugccugcgaccuggguggaggcuagcagcaucugucaggaguauguccugugaugaagaugcuccuguuucauguuuauuuauagaguaugcccaacccagguccuggaaugggcuucuagugcugacacaugcgaaggagaauagcuaaaguggagaugaagaagggagacagggaugagggcuaaagggagcuucaucacccugcugauauccagggaugcaccaacccaaggcuccuagcacuccaaaguucuugucauuuuugucauugcauuuuuaaaaagucccauguacaucucagugagaaacuauuucugucaccaaauucaagggugauuuaccucccagaagcaagcacacacacacacacaaaaaaaauugcacuuggugaaugguguuggggcagggggcggagagaaauccucaaaacacucuucuguguuccuucuaagaaggaacuuugaggcagccuuuaguuuucgcagaggauacuuuuaaauguugcugacaacaacucuacuuaugaguaacaguguggcagagacuccuggaacccagaucauucaaucuuguuucgguuugaaugugcagcaaagaguguaacggauacauuuaguacagcuacagccaccuuacaaacaggcaagguccucucuaugggacccagccugcagaacaacccgugguccaucugccuuuguagacucugacucucucugucucucucucugucucucucucugucucucucucucugucucucucucucugucucucucucugucucucucucugucucugucucucucucucucucucucucucucucucucucucucucucuccacuuuaucuuuaaaccaguuuguuuucccugaacuuguugcuccacaggggaggaucaaagagaagggauugcuuggcaaaacuauugcuuaugaaguaucugcaggaauuagcacccagugcacauacuggcugugugcugguauuaggcuuaauaauuuaggauuuuaccuuugcuuguaauucuccaacauccccuugauguagguucuguaauuaugcccauuuucagaugaggucauggaggcuuuagcaugugauucaaggggccuggaguugugccaucacagugugggauuugagaucucagaucugacaaacaguccaggguaugggcuucugggucguucucgccaguguagcuagugcuggauguauaaauauaaccuauuaaacagagccacaggacccuagaacccuugcacagggcauucuguugagaggacuguuugaggcuaggugacuagaauuaggcgugaugugaacucauguagggagaaaagacgcaucguaauuucaucaguaccgaagugaaauuucucaucuucagucaugaguguauaaacaaacaaguuuacaguccgugguacuuuauacaguccaugguacuuuauacaguccguggugcucuucucacucauugcaguuacugaucuuuucacuggaugucccagcuuggcagaaagcucaaauuuuuguucucaucgccaaccugaaauucugaguuaugacagcugcugcuugacuugaccuuguccuaacccagagguaugauugucauagauuaaugucacuugaacacuguggccacuucauuagaaccaugggugggaccaaacaccuacaauggcagcacuggagaggcugggguaaaggcaucaagaauccaagcccccacccccagggucagcucuguugugcuguccuuauuaugcugaaggucaagagcacaaaccaguagucuaauuugccacuauauauucugauggccagaggcuacaugucagugugugggcaagacuaguuccccucagauaggaauccccucuauguuccuccaagaucuggcaauucuggcagcuccuugcccugcaggucugccucuguccuauagucucugacucugugcagcauggccuucucuuugcuuucucugagucuacccucuuugauuguagucagauguguggcucgucugagguucuggggagaauuccuuguauuuaauuuuauguauuuacaacacuccucccugcauaagguucuacagugucagggucaggcagguucugcuugccccagcugucuguuuaaacagaggcugcuggggugcuucacaagacaucaacauggcuuucgggauaggagaggcauccugaagaaguagaaagagaaggggagguguuauccuaggacaucuccacugaggcuggagcgccggaccaaagaaacaacccugucugugaaggaacaagagcucugaagacaggucuaggcaauggaggagacauguggacaucagagggccaguggauguaacacuugauggcccuugcagauggagucagguuccccagagaguggccuaugagggaggaaagcagucuucuuccaccugcccagacucuuugcuuggugcgugacuuugauggacauugcccagauugaugggagaaaaaaaaaauuuuuuagaaccauggguaggaccaaacaccuacaauggcaacacuggagaggcugggguaaaggcaucaagaauccaagcccccacccccagggucagcucuguugugcuguccaagcagggugcagggcccacucucccaaauguugcagccagugaggggcagggauagcucuccugaacuuaugaccuuguggacagcuuuccaacuacuggaaguguggagaggaggggcaucaucucuacacccgugccaccucaugacagacaaguggcagagucagcuauuccacacucaugcucugagggucugcucacccacacuccacacccacgagggucauguccacugugcugccugggugagggugcagggccugcucucccuagugcugcuggugagugauggggcaagcucuccagagggcggcaaccagugaagggaggggccagcucugcccaguucuuggacaucugcucugacaagggauaucccauguucuuuaaugguaaugugagccguggacaucaacacccaccucugcauagccaugaacccagcucaggcugccaccucacuauggccccagguggcuggccacucacaacaggcugcuccucuccauccuccagucuccagauccagcucucuucauaauccuuaagcuguuccacuucucucucucccaucugaccaccacaugcucgcacauugugguggcucccacugcaggcuggccauguugcuggggggcccuggggugacauccuuugguccaagcugcacggccgugagcaggcccugcaccucacccaggcagcacaguggacaugacccugguggguguggggugugggugagcugcauggcauuuuggcaagugguuguccacagccugccugugcugugcuccagaggcagaucuguggaugcuguggcagguuucugucugccuuuuucccuccucaugugcugcacugcagguggcuaugugugucuauggccugcucauacaggguagagggcagaucuauggcuaucuuucccugcccaaacauuguggcaugguggaacacagaucucugucuaucuuccucuucccgugccaugcuaccuagauuugauuugauuugauuugauuugauuugauuugauuugauuugauuugauuugauuugaugaguccuagacauaaaacagcuuuggucaccaagccaggcaucgggccaggaugaacauaggacuaucaucugcucuaccccugacugauguaagaauggcaucaccaauaaggugucucuuuguccauugacagggguuaaaguuuuuuaauugguaaauuuuuacuauguagcucuggcuagccuggaacucuuuauguagaccaggcuggccugaaacuuucagagcucuaccuacuauucucugccuccugagugcugggaucaaaggcgugcauugcuuggaaucucgaggggaugaggguguggggcuucugcaggagaaaggcaggucucaggagccugaggaggaauggaaggucauuagcagucuccuugcuaugcagauaucuucugucagggaaugcucucucucucucucucucucucucucucucucucugacauuuucuauguaguacugauuuccugcacaaguagcgguuucucauuuugcuuuaggcaguugggugggguuaggcuuuguauguguugcuaguucuccaucgauuuuggcuucuaguaucagguaacgucaaaguggcggguucugguuuccuacagccccggucugaggugacaccaugaaucccagcaguuguccaccuaacacucuccaaagcaggcucacagugcagaccuuggugaguguauuucuuaucacaguccacuaaagagggcuuuauacagaccaagggcaaaacagacaugaaccauuggaagaggcugcaaagcaguaugaacugcgagggcagggcagggcaggcacggguagggauggagaggucugcgggcugggccuuccaguucuugcacaguugaggucccaggaaugugugaguagccacugucacccccuuugaaaccugcccacagcagaagcaccggagcgggguuuaugaugugcagccucagccugaaggacuuucgggagaagggcaggaucuacgcuccaaagcagaagccugagaggaaauuagaaccauggauuugggcagugacagccaugcacgggagcuaacuagcugauucaggauccugcccauuuuguagauguuuaguaguccagaaaggcagaagauaguagaugcuagggacaaacguaguuuucuaugaaaauaugauuuuucucuauaucauuucuucuuaaaaaacauuuaggugggggcuggugagauggcucaguggguaagagcacccgacugcucuucugaaggucaggaguucaaaucccagcaaccacaugguggcucacaaccauccauaacgagaucugacucccucuucuggagugucugagggcaccuacaguguacuuacauauaauaaauaaauaaaucuaaaaaaaaaaaaaaaaaaaaaaaacauuuaggugucuauuuguucauguguguaggugugccagggugcauguacaggucagaggucauguccagugucaucuuugcuuccugcccaccuuauuguuuugagacagggucugucucauugacucuggacucagugauugggcuggacuaaccagccagggaacucuggauuuccucugacuucugcuccccagagccacgcuugcaggcauuuguugccuacagucuguuuuguuuuaaauuuauauuuauucauuucauuuuuauuugcauuuugccugcauguaugucugugcaccacaagcuuggcaugccuguggaggucagaagagggcaucugaucccuuggaacuggaguuacagauauuugugaaccagcaugugggugcugcggacuaaacccagguccucugcaagagcagcaagugcucuuaaccacugagacaccccuccagccccuuugcuguuguuguuuaauguggauuguuuauugguauugcuuuuuuuuaaauguggguucuggcaucugaacacaggucuucacacuuuccugacugaguuaguuaucuugcuaguaaacccauuucuaccaaaggugaucacaguaaacugauuuuuauuuucagaagcaugccuagucuuccugaaugugcccugcguauuugcauaggucuggugaaauuacuaaguggcugugcuagucaaauaaggagcgucagagcagaucucagaagccugugcuggcagcggagccaggucagggucccagcaucaaaauccaucugcagagcuucucccgcuagagaugcccaaagaacuuuaaggcugguggucccucugucaguuacaguccuugucugugagaccauagagcccuuguaagccagggaccaaacaaagcauuuuaucugucugucugucugucugucugucugucuguguguaugugcacaugagcaugccacagugcaugugugauggucagaagacaauguuaucuccuuccaccauaugaauuccauggaugacacucaaauaaucacuauugguaguaagcaugcauauacacagagccaucuuacaggcccugauucaguuucuuucuuauacaaauaacucgaccucuauggaaacaagcaucucacucauuuuccccuucagccagggucaggcaguuccaauucaguuuacaaagguuaauugaccagguuucuauaaccuauauauagcuucuuuaaguuucuagacauuuguacccaguucaaggggccugccuuugaaaugugugcugggcagaguccuuucucaaaucuccuugaucgaagcuacuggcagaggccgugagaacauggguagacagcggcuaacugccaguggcuggagaaauggccugaauuugugggacucaucauccgguggggggugugucuuaaggcaacuggacgugaaaaucuagauauuucuguauuagagaaaaaaacaaucuguuuuaagaaaaguuuagaaggcucagugguuaagagcaccgacugcucuugcagaggaccugaguucaauucccaguaccuacaaggcagcccacaaacacugugacuccaauuauucugacauccaugggcacaugguacucacacuacacgcugacaacgcauuuauacacauaaaauaaaaugaaucuuuuuuuuaaaaguaacuagaacuacuauagagaaguaggauuucuugggguaucauauaauuaaauaaauacucacacaagugugacaggauugauuuuguacuuuauuauaagggaaccauuuuuuuuuuuaaucguccaggguugcaucucagccucuggaguaaggauucauggagaguuuuguggggccaaucugcaaaaguucagcagaaaucagaaguuaagaaaggugauacagaacuuagcauuggaaaguucuggaacuagagcuggaaagaugccuuugugcugaagagcacucgcuguucuuccagagaaccagaguucuguucccaguggcccacaacugccuguauguaacuccagcuccaggagaccugacacccucuuccagucucugcaggagccugcacacacaugcaauacacauacauaaaaaauaauaaaauuaagcuuuaaaacauuuuuuuuaugaaaggaaguuaucagccaggcauccccgcacucacaaaacagaggcagaggaucucuugugaguuugaagcuguagugguagauacauaaaaaguuacaggucagucagggauacauagugaaacucugucucaaaaaauaucuacaaugaauccaauuuuagacaauuugugcucagagauguagggcauuccugugaucccaguaccuaggaugcuaaagcaaaggagaagcugagacggaagagaaagauuuggagcuugaggccagccugggucacacaguccaaauauauauaaauauccaaauauauaaaauaguuuaugccaacuugacacaggcuagagucauuugggaagagggaaccuuaauuuuuaaaaaaaugacucuacugaauuuacuugugguacauugucuugauugaugauugaaugugaaagggucuagcucacugggaggagggccacucaugggcaggugguuccaugguguaagaaagcagaccaagaaaacaaaaccacaggaagcaagucaguaagcagcuuucuucauggccucugacaauggucaacaugaccacugacacaguccuuugucucuguuaugguucuuucucucccucccccucccucucccucuuaaagauuuauuuauuuuauuaauaugaguacacugucacugucuucaggcacaccagaaaagggcgucagaucccauuacagaugguuguaagccaccgugugguugcuggaaauugaacuuaggacccucuggagggucagacaguguucucaacugcugagccaucucuccagccccuuaucucuuuccaacuuucuguaucaguugaguuuuuuuuauccuuccucuucccccacagucugucuuccuacccuucuuucucccuuccaucccagccucccuuccuguccuuccuccccucucccagucuaccuucuuguccuuucucucccagccccauucuaagccccccuuuuuuccuuuccuuuccuuuccuuuccuuuccuuuccuuuccuuuccuuuccuuuccuuuccuuuccuuuccuuucccuucccuucccuucccuucccuccccuccccuccccucuccucuccucucuuuuucuuuccccuucuucccuccuucucccuccucuuuucuuuuuucugaagcuguuuuuuaauuaaccuucaaacuaaacacauucuuucccuugaaccucagacuuucuuuaccacaaaaugucccugcaucuucucauguagaguggguucucuuauagcuuccacacacagacaaaagaauuuuaacucucuguaauuccaacucccagaagaaaacgaaaggugaguacggacggacggggcaagugugggaacgcccacccgagugccacagagcgguuuugcuagcugcucuugccaagggcuggggucuggucuugcuaugcacacaguggcucaccaucaccaguaacuucugucccagggaaucugacauucucuucugauccuccuuggacaccaggaacacacaugguacacauacauauauguaggaaaacccaaucauacacauaagauaacaaaaaaguaaaucuaaaagcauuuucaaagaugugggcagcuauuuuuaaagcaggcauauuaugauuccucauugucauagaaaucuuugcuucuuauacuuuuauuuuuugagauucauuuaauuuuauaguuucuaacaacugugccuuaauuaugaaaacaccaggagaaauuuuaugaaagcauccuguuuuaaaauguuuauuuuaaaaguuuagguuuuauuauuauuauuuacggguauguguguaugugugugcuuguggggugugcaugugaaugcagguacuuccaagccagagagggugucacaguccuuuggagcuggagguaccucuccauccccagaguuuccuguuuuuaaacaaggcuagcuauuacccaacaaccguaccuccugcuaaauauuuuucagcacguuuguaucaggaagagucagaaaggcaaagccugagagagguauacuuaguucugcucauuuauuguugagaugaccugcagacacugcugugugccuguuaguuccuggguuacugcaagguuagcugucccaggguucgaacagacauggccaggaaacacaggaagagcagcaguuguaugucugccuuguguuuggauggcuuggaagauauguguauguuaguuaauccaguaaacguaagcuagcagcccaggcaggcuagguggucaugauucuucugccuugucuucuggagugagccaugccuugauuuggaacuuuaagaaacuuuuccacucuugcuucaucucacagcaaacagcucugccaaauucagucucuggaggugaggccaacuucugauaauagaguugugaaaaaaauccuuucaaguauuuuauuaucagguuuuagccagccaaauacuuaaguguuucugaaaguacuagggucucucucucucucucucucucucucucucucucucucucucucucucucucucucucucucuccuucccucccucccucccucccucccucccucccucccucccuuucuccuucucucuuacuuguauuggaaauucaacacccaaaccagcaagacuuuuaugacaaccaugaauauaaaauagucauguucaaacaggggcgggcagccugcagccccugugacccccaaguucacuuuuagacagguggguaaagacuacaugggcucuccagucuccacuugcuauucuaugauggauguagggaaguuccugugggaagguacccuaccagcacugaccaggcaugaaggaugaaggaggacggagagccccuaauagaccugggccucuuguuuauauaggaucuuuugagagcuggggccauggugagccauugaacucugccugacucaggccagcauugugcuauacccacagcugagagagggagaagaaugucuaccaaucauagagcagaguggucaggacucaggacaaacuaaagggaggauaucaucuaguuugacucauaacaaaacugcucuaugcagaugucagccuaccagaacccagagccgcuaaccugggaagccagugggcagcagccuuccaggcugggguucuuguccugaccaagaugcuauucuuccugcaaagacagaggggaagaagccagaaaugagcaugcucauaccaauagagcccagggcucaguaguaggaacgugucuggugugccuggaggcuccgggcuccaucuccugcugccuagaaagccagcaaggucuccgaaugagaacuguguuccacugcauuccuucuaaaugagaacugcguuccacuggauuccuucuacugagcagagucugaaaagguaaagacaguuucuguucuuauucccaccagguccaggaaggagugucccucagucaaaccugguaccuuugcuggccuccugcuaggguuccaaauccuacagcugcuaugaucaucccagagaaggcaggcuucagccacugaggucccuucccagucacuaaaguauaagggaaaaaagauuacaucagauaggguacaguaaguugugccuauccauaugcacgggugccguacaggggaagguggcucuucugagucccagagagaaaaguagcucuggguggcacagaggcuaauguagggaugugaggggaagugggcaaggaauaugcagauauagcauugugugugugcauguguguacauaugugugugcaugugugugugugugugagcaaggaauaugcagauauaacauugugugugcacaugcaugugugcauguguguacauaugugugugcauguguguguaugugagcaaggaauaugcagauauaacauguguguguacacgugcaugugugcauguguguacauaugugugugcauguguguauguguguguguguguaugugagcaaggaauaugcagauauaacauugugugugugcacgugcaugugugccugugucuacauaugugugugcgugugugugcaugugagcaaggaauaugcagauauaacauugugugugugcuuguggauguggaugugcauauuuguguguguguguacaugugggcaaggaauaugcagacauaacugugugugugcaugugugugcauaugaguguaugcauguaugcauguguguuuacauacauguauguacaugugcgugugagugcauguguguguuguuccucaggaggcauccacuuuuuuuuuuuuuuuuuuuuuuuugagcaugagccucucccugaaucucuccaucaggucuccauuucccaucucuaccuucaaagcacugugauaacaagaacauacuaucacgccuguuuuuguuuuuaaaggcgccaauaucuccuuaaauuuuagugcauuuauuauuuuucacaugugcggguacucacaugccacagcaugcccaugguggucaaaguacaguuuuucagaguugggucucuccugccauguggggucuggguuucaaacucaacauuccaggcuuggcuaccaaugccugcugagccaacucaaugacuccucacaccccaccuuugaaacacaccuucuggggaucacacucagguccucaugccuacaaguguguacugacccagccccagacgugacuuugguuugaugguugcccagcugggaccccuuuccugauguauguguccuucagagcuguaccaucugcuccuacacagggcagcuucuccauguucagugcaucugcagccucagggucaccuggacucacucagggugcccaacagguuguucugcaaucaugugucccaguguccugcagacaugugucaugcaguuauauguucugaaucucaauauagaccuuagaacuguggcugaagaaaggggauguggugccagacucaguuugcccaaagagcuagugcaggauggagcuggcuggcacuggccuagggcagacugaaaggugcaaggggcccuuggguggugacaccugguguuuuagaccguuauguggguucccaggaaaacccccucuucugcaaaggaagcacuuguguuuucccaguaugcuauggguacaaggaugacuaacaaucaugacauuugcauggugcuuccuucaccguagcugcacacaaaggcccgugcuuugcucucuuggcagagguaggcuuuguuuccucaguuuacagauagggagguggagggcugggaggucauuauagucacaagaggaguagagggcucagcacaaaguacgacaaagucaccguaauaaaauucaggccugggccaugauccuaacuacuggggaggcugaagcaggaggauccaaagcuuaaagugaccuucaagccgguccugguugacuuagugagacccuguuucaaaagggaaagucaaaagagucuggggugcauuuuggcaauacaguguccuggguuugaccucagagcugcggugagagcaacgagaaagaacagauucgcaacaggaaaguucacaauggauccagcacuagcuuucaauuuuuaagaaagauuuuacauuuuaugucuguuguauggccauaugcuuguacucuguggggggggggagaaagagagagauagggagggagagagagagggagagggagagagagaaagagagagagaaagagagagagagggagggagagagggagggacggagagagggagggagggagagagggagggagggugggagagagaggaagaaggagagaggagagagagagagagagaggaagaaugagagagagaaagagagagagcucucuuaacugcugagccaucucuccagccccucaacaauaguuuuauuggacacuaaggacuucagcgaugaagauccaaagaccugacuaacuuucucccaaguuugugugugugugugugugugugugugugugugcgcaaacaugugugcaugcaugcuagagggagccugcccaacugaaccauuguuagaggacaaggguuagaacaggaaugagucaaucccauaguagggagggucugcaucccugugggauccuguccccaagaacaggacacacaaggucucaugcuauucagggucaggcugagaauuugcucuucaagguuucgugguauguauuccuuguaugucauacuguguugcguaaggacaucuuccugcaggcaucuauuauacagcaaguguacaugcuucuucccccuugguccauuuaucccuuuagacaagucacuucugcuuuccugucacguauacauaugugauuuuuagauacauaugcaaaaacccaggaacaaaauaugagagaaaacaugugaugcucgcuuugcugagacuggcuuaauucacauacuacaaucauguccgauugccuccauuuucaugaaaaggauguaacuuuguccuucuuuauggcuggauaaauguaugaccauguauaguugucauacuuuucuugucugcuccucugcucuugggacuagugcuacacugagcgcuccuugauauacuauguucuacaaugugcguugacuuugggguagguguccgugggugguauggucacaugguagaucuauuucuaaagacccuccauacugacuuccauaguggugggaaugguuugccuugccucuguuggucugggagggcguccuucuguccacguccccaccagcauuggccacuucuguuuucagccgguggcugagauggauucucaguaugguuuugauuugcauuucucagauugcaccuuuuaaaugcauguauuagcuccuuguacuuccucuuuugagaauugucugcucaauuccguuuuaagcaccagguugcuuguguguguguuuaguuuuuuaaauauuugcuuuagguuuacgugugugugugugagccugaguguccaucugugcaacauguguuugcaggaacccaaacauaccagaaggugucgaauccccuggaacuggagauacgggcagguguaagucagcugacacagguucugggaauugaacuccgucuuaugcaacagcacuaagucuuuugacugcugaaccaccucugucacccuguguuuaguuuuuugaguucuuuguauauucuauuauuuuauggcaaggaauguuuuugccuguauguaugucuuauguacaccaugugugugccuggugcccaugaaggccagaaccagaaaagagaguguuagguccuggaacaguuacagaugguugugagccgccgugugggugcuacagguugaaucuagcuccgcuggaagagcagccaauguuaacagcugaacugcugcucuccagucgcuuuuuguaaacuccagaugucaauccucugccagacugacagccagcaaugacuccccuacccucccugagcuguucuucacccaaauaguuguuuucaucucuguacaaagccuuuugaauuucucaaagccucauuuaucaacggucuucugccggaggaagaggcuagggacagaaagcacggccugccuacugcucucuggagugccauggugccacgugcugagcuagaguguucugagccccauccugggaguugugagucaccuaccugccuccacugcaggcucuccuacaucccuccugugaucuuuccugagacaccacaaaccacaccugagacccccgggggagaaccuuacagggauaccagguacccaggaacaucaucacagccucccuaccaaccaacuccagcauagaugccuugggcaucuucuugucaaccagggucagguccuggaguaggcagggcgugggaaggagacccaugagagcgggcuuugucagccugcucagggcuacuguaucuacgaagggcuguuccagugucccugcccaguggcagcugccagaucccuuccauggggacagcagggacucuaauugcucaccugcugcucagagucucugccagcccuggaggugugucuggggaagcugugcuaauuaggcacacgguccauccuuguaggggcaauaggcauagugucaaccuuucggugcguccuucacagcaaguaaaggagcuccagucucccauucugaucuacaucccggaccuuagggaugacguccuagcuguugccucauugauguccaccuuccagauggacacugcccugcucaagcacagaccuggugacucucagcucagcugaccuaugggaagccuugguccuuguggggacugaggagagcaucccagguugggaagagagcauguaggaucuuuaggguguuuccaccagcagcagaggggggccucauaguagagagggggucuaacuuuugcagagaccacacagcggcccuugcuaaaugcuguagcgccgcaaaggggagucgagcuccacaguggguacguccugguaucugugccgcccagaucaugaacaguaagcggcauaucuuaucauucauuuaccaagccuccauucucuggggucccugggacuccuuaccacacaguacagacuagauucagcuccugcucgcuauagaaggaggcucugcuggugauagucauguaaguuagagacagcaggucccugaucugcaagacuuggauuagacaauguggccccccuccuucucgccaccacuguccucugucuccccguggucaaccgccaucaacaagccuaauuacaaaggccuccuggcacuuuuucuuuuggaguaaggcaugcuccggcuugcuucugggcccuuaauuuuugaucagggacaccucuucgacuaauuauuugucaguaaugagggaggagagaugagguugcgaaagcgucccugagcuuauagagagaagcugcaaauuaaaauacgaggcauccguaaacagggcgcuaauuggauuaauucaaaagugauagauugggauaagaacagagaggaagaccacaggcagauugaggucagaauaauuccaggagcguugcccgggcuuccugugauagaugugagccucaaaguccgagagcuacagaaaguaaaauaugcugcugugugugcaaaacacaucugagucacucaggcacaccaaccacccaggaugcauggccguuucuuaagcccuggcacuaucugacccuugagucauuuuuggagagaccagaacuuucauaugacaaccgccuuucuuuccucuguuguaauaaagcccucucuauuuguuuuaagguuuuuaaauuauauguacguguguauguaaggguaugugcacaugagugggagugcccaugaaagccagaaucuccuuguagcugcagucccaggcagcugccugguaugggugcugggagcuaagcucccaaguacaugggccuaugugcauguucuugaccgcugagccaucucuccaggcccucauucugauuucucuuggugcuguuuaguguuuuugcauucuuugaaucuugagccacacuuaugcgugggcuaucuaauguaauugaauuuaaaaaaaaaaccauuaugucagaaggugauaaaaauuaugaugggaacaucccacuucugaacaggcagaggugagcugaacuuuucaagauaaggggaagcaucucccugugucccagugagcacugucuguccguggcugcuucuccugguaucucagcgaggcaucagguuucuguagggcauuugaaucgccucauagaccaaaugugcccugaccacuuccccuggccacagugaugcuuuauagucuggauuaacucugggcuacuggccucacucccagucuuggcugacaccuaggcugugggagagcuaauagcuuauucauauuauuuagauaaguagcauaguauuugagccguguacguuuuuaaaagcaucaagucuuuauucuuagggugagccuuaucauauaaucacaacugugcaccauuucaguucucaugguucuuccauggaucacacugaacaguaaguccuggcugcagaagagaauuauuuuugcaccugucuccaagucuauugguucaacauaaacacaggcaauacucgaaccauauguuaucauuccaccgaggggcuccuagacacacccccagucagcuuccugaauuucuaaauucagaaagggaauguggagcugggaagaaauaguauuucacuuaagacuuuacuuacccauccuguccauuuauccaucccaucuaucuacccauccaacacauucucccauccaucuauccauccauccaucuauccaucucuucaucccauauguccauaaagcccaucauaucuacccauccauuguuuguuuaaccaucuauccauccauccaucuauccaucucuucaucccauauguccauaaagcccaucauaucuacccauccauuguuuguucauccaucuauccauccacccauccaucuaucuauccauccauacauccauccauucauccacccaucuauccuuccauccauauguccauccacccacccacccauccaucauccagucuauccaucuacccgccuguauauccacucacccgcccacccacccacccacccacaaaaccacuauaaaaacauccaucucucauucauuacugaguaccugcugcauacuagguccugaucugggaccagacaauucaaacuuuauacacucacucagucuucaccauucugugacaucaacuugaagcugaggguuuaauucugcagagcgcaggccucuuggagguccccggggcacaccacaguauaagacacuucguguggagcacagaagccagugugccaaggacacccuuugcuccuguuguucagguguggguggggaugggucuggcagugagacaagaggggccauguuggauaugcgccucaagggaccaucaucuagcaagcaggguagcuuccagugaugcccuaggcaccugcucuccgaggucacucccuuuaacuucuggaagacaggagaggacacagccaaauguacugaaggcagauuugcuuaggauccaggccaggcguccauggaucucugcaaagagugaaaguagacacugcaggggagcucggauggaugcucugucaaggcagacgaagugggcacuguuccagucaugaacuguauguuauauaaaucgaccccucuguuuccucaucggggaacagagguagaaacucuucucacgguaccaguguaaugguugugcuauggauagguguagacgcugaaauucaugcuuagugagcagcaucagcuagggcaugagguguuugucacauucucugugugacuccuaugugcucucagaacucacugaguugaggaugagagcgccgacggcccggauggaagagucagaugagacaaagaacaggugcucuggcaaugucaagcagguugggagggcagggagucuuaacugggccuccaucugccaaccucccuggccuuggcugucagccagggcagccucugaccucugaagggcguguccucuguuuuucugagcaggaguugggcccacaaaggcagcccuucagucucggacgugaguaaauauugacgcuggggcuuugggggcccugaccguugccacuuaagcaugauguggaugucucuauuggaagcucagaguggcugaggacugagcuagcugggcaaaccugcucccuaaggcaaccacguucuaaccagcccccccacucccuggaguucuuccuccugcuucagggcuaggacgacccugaucauccugcacaauuaaucaggcaggcaacccagugccgccacaagcagucauuacgcagguauuucuaagauggaagaacugguugcuuagaauagcuaagaggaauggaagccaguccuuccagcagccucuguggaaugggggagacccauggucucauauguucaguugaaccaauuuagcugucccccccccugccaucgccacccccagucccgugugagaagaggcacacgugguuugaagccaccaagcaccaccucagcuuuguauucaugagcacucgcguguguguucguucacaagcucucucugcuguccaugggaaugcacagaggauaucuuuaaagucagcaccuagacaccaucuugggcccgguguacagugacagcagaucuucaaccuuggccucauucgagagagaugugcagaaacacuuguugaauuccccacaggauucccugcccggugcuguccugucaccuuaacaguuaagcuacuguugcccaccgcacaguugggcauaucuuacuuuccaaacauuuuuuuuuaauuuguauucccuuuauccaguuaguccucucgauccuuucccucccucuuuacccaagccuuuccacccucagcauucccccuuuuuacuuauguucuuuauacugacggucuaccaucucccugccucuaaaagccagcuguaugaggccacugucccugaaaugacuaggugugaacagggaagauucccucaugagcaucagggggaaauccuaugauauaaaaaugucugcagugggcguuggagagaccaacuagccauuaagagugcauacuguucucuaaagggaccugaguuugguacccacauugggcagcucaaaaaccacucucagcuccaguuccgagggacccgacacuccagccuccaagaggauuugcacccacaugcacauacagucacaaauguuacuuuuuaaccuuaaaaauggcugcagugggaugagaagcugggaaguuuaggccuggagauucauucauagaaaggaagcuggcucugcuuccccagccaaucucugcuggauguuuguaaaccccaaauuugaugcuguuaaccuuugcucuaccagccaggcuacuccagauggcucuaccggauguuguaagcaucugauuugaugaccucaugaauuugagcaauagaaaugucugcuggaaaugguuuaccuucuagagacagggucuuacuauacaaccuuggccgucccugaacucacuccauaccucggaacgcaggcuggccucaaacucacagagaucugccgccucuaccucccaagugcugggguuaacggugugcaccaccacacuaccagcaagggcuauauuuuuuaugcucuugcuguggacuguucuccuuguuacagagacuggggccagccuguaccaagacauaggguuuugaggagacaagggaaccuccccacccccagagucugcuucugcagagccuaacuggcacaugagaguuuaccaauauaauguguauuacaacaggaauauaguagggugcccucaaaacccguacacuagugguuaagaauaugggauagaaauucugaauucagcauucuggcuguucauuauccuggguccacagcaacuggagucuggugugguaugaacaggcaaaguagauuucugacauuuaagagaggaguucuuaucugccgccagccuauggagaccuguguuguugagaugacgguauacaggacguauugugaauugcaggggagggcaaaaaacagggagagagaugagcccaagguguuaagggguccauuguaccauccuuggauuuagcuuaugugcuugagaccaucaacagggggagcagacauuguaggguugcccucugagauuucacccccccaguucacuuucccagguagugggagccugcccccauguuggucgccaggaguaggaucaaacacaauacccguaagccugguagccaguccccagacccagggcucccugccaggcuccacccacuggcuuggagcuggccacacaggccucccagcuuccguaacuucaaugucaucaccuaggcaacuggacgcugccgccacugcccugccacugcaagccaccacggggccuccagcaccucuacccaagucuauggacccacccagggcccaggcucagccaagguaggcaggggcucugcuugacucucagcucucaagucaggguucgcuugcugucccccuuccccacagggcaacagccucaagguuccaucaggauaaggaaaccccuccccaucaacucaccugguagcccagaaguaaggcuccauguaagcaggccugccacacgggcaggcugguggccgagacagucugaagagacaccaucuguggcucugguggcacaaggcaacaugguauggcacuuuggaaagucacauguacugaguagucuccagggucucucugugccccuguacugugacaggucaggauggagacaagggauucugagaucucccaaaagugguucugguaucuccacagccuucauuccuuuaagccaccugaauuucucuuuauuccauguccaagagacaccaaacagcuaccuggaucuuccaaggccaugguuagugcuauaagauguugccccuacccagugccucuuccuaacucucccuccgcuacuuagucucagagucucuuucauccuuagccugugcugggcuucccgccccucacauggcuggugcucaacaugucuacaugcaggccuaaguguugagagauggggccucgguaggcccuguuccugauguuguccacuugugcugcuguccugugaacagggcuggauguccuaggacuggcaaacuauacagcgucauaucaggaugagauagagaaaauccuguauagaaauuauugcaaugaggccagagugagugagugagugugugugugugugugugugugugugugcgcauacacgugaacaccucgguuguguggugcauugugagccagugugcacacguggguggagaagcagaguaucaggaguguaugggccauacacucuuugugguuuuaccaccguguucucagcaggaccuagcgguggcccuggagcccaaauggcuggaguauugccugaaagagagauaucugcccccaguuuuaaagucaagaucucauuuuguagcccaaacuagaauucacugugaaccccaggcuggucuuggauccugauccuccugccucagucuccccaugguugaaauuacagacauguuuuaccauggcuaguugucuuggguuuucucuaauuugauugguuacuuccacugcuggcccuguuagcauacacuguaugcacaagaccaucauagccugagacccauagccugagacccucauagccugaaacacccauagccugagauccucauagccugagacccccauagccugagacacccauaaccugagauacccauagccugagacccuaugccucgagggucuugugccuacaguggaugcugacaagaccagcaagaagacacagggcccugcuaugugucacacaaagccagugcuauuuccuugggucccaaaaucugaacuccuaagggcccaaagcccaaaugaggauauauuugcuuuuucuuauuguuuuaauuuuauauguauuuauucauugugucuauauguaugaaggcaugugagcauauccugagacugaacucacgucuuugagcuuggcagcuguacauuuaguugcugagccaucucaccuagccccuggggugugaauggugaguuuugaccucuaacugcucacuccugggucugcccaacuuucccugaccugcaaggccuugagaucaucauacuaaccgguuaauucugccuccaaugucuauucacugagcaccaaacuugugcugugcacuugcugagcuacauggcuaagccuguccauccucggcauuacaucugaacacacauaggguuuuaccccugcagcagaugccaugauacuuggggggcuaggggcuguccagaaaccccgaggggcaaggcucuguagcuguucccauucugagaugacuaguaagagucuaucaggcagcacagagccuuuccucauggccccagggcugagcacaagggauucugauguguuugacaucgaauucuaccagguuaaaggccaccuggaaccuucuccaagguagccccuuggagggguaagugggacugguagugccugcgagaagccacuuuccaaauucaaaaccaaauggaagcugggccaugaggccccacagguggcuaaauuacagacauagaacuguugggcccuugguaaccuuguccagcaaucuccugaaagccuuguguagaccauucaugcaaggaaggugugauagccuacuugagggacaagaggcuacagacuccacacacaggaagagauggagggcccugaauuguggcuuguugaggguucugauguuggucaguccagaggucugagggucaggauggacacucuagacuccguuucugucuguguccucacuuguucuaccugucccuaccacggcacuccggucaagucagcuugccaggcagggaugccuaaaagcugcucaugaggcaaaaagaguuucacagaaacucacuccuggagucuggcgugcucucuaaauuuuccauucccgcguuagucuaguggauggauccacaugcucucuuuauuauaagugccuuuuaagauugaauucugacauagcuaaagccuuucgccaguguuccaacaguccuagaacgucuuugagcuagacagugacauucagaauagccucugguauuacacuaucaauaaaagccaagucguucccauauacaggaauuuacaaugguuuaggaaguagaucgggcugugguuuuagaguauugcauuauuuaugagaugguuaaguagaacagaacucccuaguuagaaccaugacuugggugugaaagcccuugcccuaggagaguaaagaccucacaccuggcuucuaagacuauagcugagucacacccauacacacguauuuacaauggcuuaaggggaagguagacuauucaauagacuaaaauaggagcuauggcaagggcacgaagcccuugacccuggcuuuuaagauuaagcaaaucuuagauagagcccuuuuugaucccaguuguuaacaaugaauuuuaucccaggugguuccuguuagaccuucuguguuuacauuccucuguuuuauguaagaauccaguaaccucuuuguaccuugcuagugugucacccaacuuccuuauugucuuuugcauaaaaagucugaugcucaauuugacauuacauucagauuccacacgaccucuccugugugugucugucugucaauucauccuacgcuuuguccacccgcgacuagagacccguuccacacaaacaaaggggcccagagggucuauggcaguuggcgccuucgaacagggacaccagagcggguuagucuuuauuucuuuuucuuucguguccuggaucgggcuugucucugugacuugcagucucugcaccccacagcucugucagggaguugggcugaguguggaagagcuagggcugcgacaacuccugugaagaggaugcuugcccugcugagaccuguucuggcuaccuguacacacagucuagacagacacccacccugacuacagucuccugucucuccugacuucagcaugagcuccacucugcccucgaugucgauggaccugguccucuuuccucuccauccuugcuggcccaaaccagucuugccacucacuccccccacccugccuggucucccuuggaagcucucgccacauugccaggagggggcugcucccuugaauugccccucuaucaggccugguguaccucugacccccgcccuccaaauucaccgguccccuuauuuucagccacgauaacuuggaggcauaggguaggaguccagacucccugggcuuccugguccuucucccuaguacccagccuuggacaucagcacaggaugaucauccauucugccuccuaguaaccagguuacccaggauccccucuucuauacaauaggaaucaauuugguuuuugagacacccagugcuagggacagugcucagcaggcuugagaacacuuucaaagaguggugagaccacaguugccgugauggggcagagaccagaucaacguauguaugacacacguaugucugucucuguccacagacguaguuucucaccaggccuuccccugacaagaggaccggacuuguucucuuccacucugagcccuauacuaaaggggcugugacuuugcugugguuuguccccugcucuaugcaggauugucaccugcccgaugcuucacgcucauccuauuacaucauuccacaggggugggugugacaauccgcaguuaucacagaggacacucugugaguguccucuuuacagaggaggacacugacacucaugugggcaugucaccugcccugguucgcacagcuggagaauggcagagggccauguggccagcacaggaagagccccagcuuaagugccuagcagggcugaauuucagguuagggaaugguggagcuagaggccauaugucccacauggccccaccauggggugaagaaauggaagcagaaggcaggccugagcaggucagcagagaguagggucgucuuugguugucugaacaugggcagggcuuuggaaaugagggugugggcuuccccaggaagguaagaguguguacucgaaguacuaucaucuccagggaggggagaguagagugcaggggucaauagcuaggcacugugugcccugagugagcaaauaagaugcaagacacacuuacucucuguauaucgagggguuccugcugucuuggguagaugcauggaggucagcaugcuacaauguucacuuccuuuggucuugucugaguuuccacguggugccaggugacuuagcauggaugggaaguuuggucaacuacugucucuuucaagaagcacagggaauguuggguggccugagggaugcaggcuagucuuccuccagcccuguucccauucccuggcggauggccugagcccaggcgagagaagguuaaugcuucacauagcacacccugccccacauggggcagcuaaauuugucuuccuucaccaguacuuggcucccccagcuuggggagaaggccaccgcugccaucuggacaucuagggccacaccuggcuagggaacagaauguccugcugaaggaugagguugucuugugagagaaggggagggauccagccaguuuccagauggggcaggaccaagaugguugccacacuggcccugaagaaggagguacuucugccugcaucgggugggaccucagccucuguguagccuccuuuucuggagguagcuugagggaaacaggcuuccggcaccaaggccccgauguggccagguucuugauacucugaguucugugucuuugccacugcccagagauaccgucauuucaggagagacacucccuggccauguuccugagccuggcacgcccucugcccacacaaggaucucauggugcuagagccuucauguccgcuggagggaaauucacacaguggcugacauggguccagagggccccuccugucaucaccacuaauauacuaguuacuucugauuucaauuccccuguccacuggaacaaauuauuagaagggaugacaguggagacaaaccacaguauugaucacgucauguagacauaccauaacagagauuucccaggccggguaaguuucucuggggauuuccuugcugacccgaaaaaggcccuugccauagccaggggacccagugucaucaugcugaagauccugccucuccugugucugggcuauauguggacagacuugcuuuaguuuccacuagggaagguggguauucaggcuccuagaaggugggggguacauccccauggaugggguaccccuuccagagcagguucgggauaauuaugggcaucugguauaucacagguggcagugaggcuggggcugagcaggggugagaggagauggggaauaacaaggaaggagguccccauccugugugauugaaguguucuauguggccaagugacaucugugucuccuccuccagucagguggcagggauggggaaggaaggcucagacucagagcuggucaagacagagguuuucuugaggagccagccaccucuggcuuuuaagggagaggggggcuuggagagccaaacauuugaagucacauguauccaaagccguggugacagggcaugaugggggaaugcuugggagaaggacucggcugaguugggaguaugugggggccaggcaggagguucgaagguugguagcucuugcugggaaguugagacucgcggccacgugcagggugagguaaugggagagucggagacuuccuuaggggccagaggauagaggacauccccggcaaaccugcucuggugcaagcccuagcugaauuacuugggcaagccccuugggucucaaacacaguuuacucaucucugaacuaguugggggagcccaucuaggcugcugcgugggcccagaaguccugccaggagucugguuagcaucccugggcucucucucuccguggaggcccacggggccuuccaccacccaguuuugaggauggaauuguucccagcagauguaaauauccaugggcucaaguccagucagagcugccggagcuccguggaggagccgcgcccgccguuggcucagugaggagcuguguccuccagugaggaggccugucauuggcucgguguuggcucaguggaggagccgugccguuggcucagugagcaugugcuauccguguguguggcuuuccguuuacagccuuauucuccuccgcauauccuggcaccacaggucuggcugcuguaccccugacucucaugcuuguugggacuccuuggggggggggggcggguagcaggugcugaggucugaguuuggcacagaccaucuuugucagcuugcugugguccuguuucaugaugcaggcacugccaggccuggaggagauccagcucagcaaaggaggaggcucaucugaggcuuugacggagcuggaggcaaggcuagggcagggccagagacagcccagaucccugccaugcccacagccugugaccuggcugcugacagagcuucugacacggcgggccaggcggggccagcccuccuugguuggugcuucucccuaaagucucccucugccgauucugggccuucuaugccucuccucacaccacgggaugcguguucucucuaggaaaacucaagucuucaguaaaaacuacaaucucagagccagugagauggcucagugggugaaggugcuugcuaccaguucugaaaacucgaguuugaucccugggacuuacagaguaggaggagaaaacugacucccggaagcuguccucugaccucugaguugagcaucugcacucacaggcaugcacacacgcacaacgugauuauuuucuauaucugugcuucccaacacugauuuuuuuuuguacuuuccagaggacaaguaguuucucaaaacuggccucuuugccaucaugacuugauguuuuaaaucacuuuccgugcuuauguaaucuguuccugcggugucuggggaucgcuccucugguggacacaucucuuagcuagaggagugugugggaccuauagaaagggcucaguaaagagcuugccaugcaucuaucaaucuaucaucuaucuaccuaucuaucuacaucuauauaucuaucuaucaucuauguuuguauguaucuaucaucuaucuaucuauaaucuaucaaucuaucgucuaucagucuaucaucuauguaucuaucauccauguaucuaucuauguaucuaucaucuauguauauauguauguaccuaucaucuaucuaccaucuagcaauaaucuaucaaucuaucaucuaucuaucuaccaucuaucagucuaucuauccauucauuuaucuugccucugccccugccucugacugucauaugucugucucucuauaaucuaucuaucuaucuaucuaucuaucuaucuaucuaucuaucuaucuaucuaucuauccauccauccauccaacuauccuaucccugccccugacucuggcucugacucuucaauuaucucucugucucucugugccccucccucccuuccucccucccucuuucccuuucugucucucugaagagagagacuauaaguuuauaauauaguaagguuggguuaccagcugcaggaauuuuguagaaaauggggggagggugacagggcugggugauagugguggcuuccgugaggcuguggugcuccaugaguucagagcuagaugcuaguaaggaccauuuaaggacgugggcaaggaggcaugucccagcugaaggacuagaaguacagagccaaacacuagcagguggcccaugugccucccauuaagacuguuaggacucuagcaaccagugaggggcaagauaggagggugagcaggggccugugucccuggcaagcaggucagaauuugaucuucagcaugagagguuugguuggaugcuccuuccuugugugggugcaggaggaccugguaggcaggagguguggaaagcagaggacuuggcaaggggucuuggggcagagcugcaaacucugccaagcuccuggaagucugcugccugcagguagccccuuucccaccucccgcucuauuuccaggcacugggcaccugccauuuuuuucuucccucugcuugagcuggccauguggacacaaggggugaagagggacccaaauccucccuugcuuucucaguaggcuguccaccuucagauaugccguuucuggaauugggaaggcaagccagcaugggugucaacaggugggguaagguguggcagguagaguuaccagcagaguacuccugguacaaucuguacugugauacccagaucccauccaauccaaggcucuugcugacaacuuccaaggcuacaucuaugaugggaaucuuccaggaacauacacuuggaguccucagccuaacagggggucucaaagugcucauuccuauccugagaacaucaguggguguggcaaaggaauuugggagaccaucucagacaguguggucacagcaggacugacauucauuccaggugcugccugccacaaaugucuuucccuuuuuuuuuuuuuaauuaaaaaaaaaugugggccagugaaauggcucaguggguaagggugauugcugccaagccugaugaccugaguucaaucccugaaccccauguacuggaaagaaagaauccacuccucacaaucaaucaaucaaucaaucaaucaaucgaccaauguaauuaaguaaaaauuuaaggaaugcccugaaauucuccuaacauauaacuagcauuuuauucuaaaaguauuauuguuguuguuuuugacugaccuugaucugaugagcuugccucagccuugucacagcagggacugcacgugugcaccacugcugucuuccaaacaacauuuugaagcuugaagcucagcgacuuccagcgucuuaaauccccaggagaaacccuggccccaugagcccuugcucgcugccguagcaccucaggcuggcacccccaaccugccuuugccucccuguucggauuuccuguucaguacauguugcucggacacuaggugguucagcacggucuucacaguccgucuacacugugcuguuuugaaucagcaguucguuccuggucacagucaaaugucaccuaacauguccgggucauauuguaucuggcaguuccucuucugauguguucccagucucucacccugucuggcuaaagugaauaaugucacugcgaaggggccuggaguccauucacugugugacaugagccauguccuuucccuuucugagcuuggcguaguccuuguaaaagggagaagaggaccaaguggucccugggguaggacuucuaagcauguccucuugggucucaggguguccaccagccuggcccagcugaccagcccacucugacugcgaagagauaccucccugaccaauggcuccucaccagaaaguaccauucccccggagcuggugaaggcagcucuguccaccuuccaugcugguuggccaauggcuugucaaaaccuucaugacugugauaaaugggaggugggaaaaauuaauccuuauuacuggagaagagcauaaauuauguuaauuccugugcuuauuauaguugugugaccuugggcaaggcauguaaggccucugagccugucuucugaguagggcaggacugcgauauguacaggguacuuguccugugucauccucccuugcugacugagcccccaccccacucucuaccugugcucagcugguccccuuuuacuggcccucucagcuugugccacuucucugaggacccauggccuggcgcgugccaucucuagaugcgugccacaaaccacuaugagcagccuccugccuggggucagacaaaagcgacagaucugcccugccagcccugggcaagucuggaccugucugcuuggcagugcagagcugggccaagcugguuugcgggcuuagaaggcugccccagggaggcugcuccuuaaugggcagcgggcaggugggcugggguuucccugccccacccucccacaauuuacugugccugagcgcccuuacgcugccccgccuccagggugacugugagugggcggagccuccgcgugggaggcugugcugaggaaaucguggggaaagcgguuguggguacuagcuggggcuagagugacccugcuccccuuuaucuccuuugaggagaccauccacaggugacaacuccagggcaguccuaggacuuuagccuuagaccuuggagggugaggaccauagagggucuugagucccacgguaaccugcauaacugugcauuacaggcaugguuccagcagggggcgcccuacacacgcucuuacuaagaggaacggaugaaguuugagcugucucgaagaccuggcgacaagucacagccuucccccuccaacauacacaaaccaagaccuggcuugaccuaacccuggccgucauuguagguuuaggacacggugacggcagucauggcccauucucucaaaaaacugacccaagaccacaaagacuaaauucccuucuccaacagcaucuacccaaugugagggcacaugcccuucuuacccguuuucuggcagcagaauccgggaauggcgucucuaaaaccaagcuugccucagucucaccuccuggaccagagaaugagcugcuugggaguggugaugguagggaggaagagaaggggagcuagacagggaaaagggaggcaaggggggggggagaaagcaacgugaguggaaggacuuagcacagcucuggggucuccuugcaccaucauaggcagccccgccguccacuuggcucgccugguacugaggaaggcaggauuccccaauucucaguguccucccucuucuuccagaaugagcggcagcguuggggagauggcccagaccucuucuuccuccuccuccaccuucgagcaccuguggaguucucugugaguauggagaacuccgccucacuggguuugguuggcuuagcuggcuuggaauaaauagguugggagaggggucugcugagguagcagcugccuugggccauguccugugugcaugugacccacagucauggucuguccucuggccaguucucuagagggcugugggcacagagaucauguguaugaagcauuuucuaauaguccugaagggcaagccgagggcuggcagggauugugggagcuggaaaacuccggaaguccaaggacauauggcuuaucuccugggauggacacacacacaugggguagccugauauccugaaccaggggagcacagcggauucuggagcagaugcuaacauccaguguccuuccccuccacccccacagagagccagacagcaccuacuuugaccucccccagcccagccaagggacuagcgaggcaucaggcagcgaggaguccaacauggaugucuuccaccugcaaggcauggugagcggggcugcgcuaaagacuggauguuggugauaaaugcggguuggcuuuucuccgguggaacgaggaagcagggcuuuggguagcccaccuugggucggaagaaaaauaugcaaugagcucaugguacugucgauuccuagguaagaauggauucaagcaugauuggacccagcgguaggaagagcuucgggcauggcuggacccaggugguucccugggaccacuuccucuuucacuugcaucucucuuucucugguuuuuccugggguaccuuuguucuuuggaagccucggcccucagagauuguccaacauuuugaggccccguggagaggccaccccucuuuuuccuuugcccagaaacacugcuucuucauguuggucugagcauacuuguuugcuaugugccucugagcugucccuaucuuucugauuggcccauguuucuauagcuaucucuggacuggucaggaugaaggguacuaaggcaggcuccuuauauuaggagaggaagauguggccaguggagacagugguuuuauuccucaucuugugcgcucuuuccugggaccaagagggguaccaagcagccagccuuuggaauuugccuccuauugggagcuccucuuggcaagaagacacaguagcugugggauucuguuccugccucacucucuggcuaccacugccgugcccugguggugccaggaacuggaggaaggugacugaagcaugcaaagggcaagugaaggccucuguucccgaggaagucccucgaggccuucuguccucagcauccuccccuacuggaccaccaaagugcuaggaucccaaaggcgagaggguugggaaagcgucaggcggggacuuguuggaggaacccugcaagcacauuaaggaagagcaaagcccaagccgaguuggcacaugucggcugcagaggcaccagacagcugagcaugucuccaguguagccuuccucccacuagcaccugaugagccauaugcuagaggcccagggacucuagaagccaagcaaagugugaggcuaaccccuacuuggagggagaagccuggccacuuuaggcauuagugaacaaggguugaagagacaggaggcacuaugcccuuacucuccccucucucuguagagguggaagguuggucagagcccacugaucucccauggaacugggugagacucucuauaguggcagccccaggggguaaggguaucauccuggugaugcccacuucucugagcucugccuguccagcccugaucucugccagcucaggagccuguuucagaauagcaguucaccuguaaguguccauuuuacaggcaagggaacugaggcagaugcuguggaaggagagccuggggcuuggggaagagaaugguccugcaucauggugaggauagucccccauccugccuguuacuccguagagacaugauucugacacccaucaucuaggauauauguguucuccaguauagagggauaggagguggcuacuaggcuccagggagggagggccuuacacaaagacucuaaagaugccugcuuuaggaguucuggaagcugccucccacagucuaagcuacccagcuuaugccugagagggcagagugcucagagaccccacugugacugaaggaagaagcagggaacagcccuggggccccggaggcuagggaugugguacccaccccggccccaaagaugcccaacguaaacguguuggcgggugcuccugggugcucaccugcuggggcaugcugcucccagcagggguaacacgggcggggcucaacaccuccacaaacaaggggccgcuuucucagguagcaacacgccuugcaguaaagccauggacgaaauuccugggcgcacagcucagcuccuagaagugggaauucccuggaaacaggacuuccuggccucccuucugcagggcucagcugacccucaugcacaguucuuucaagagacagcuacugguccaacagcuuccuguaugcucagaacuuccagcaguccugacagcaaaaaucaagacucagagaugagugacagauagggccauguggcagcaaugcuccagagcucaucuggacugcagggaacuggggguggggugaggucuugcaggugcugcaggaaguuggggguggguggggggaugcagagagcacuagacauugcaugccaugaaaugagguagaugaaguuugaucucauaaauuacauggucgauuacagcuuauuaggauggcagaggaaaggggcauccaggcaccacagggagcaucuuugaguccagggauggaggcagcuauggaaaugacaguuugggguacagaugugugagagugguuuggggaccuacagaauccaucaucguuucagggugcagcccggaggaagcaauggucuggguauagacuacagaguacagacuggucugugaaugcugcagacaggguagccugcccaggcccacauucagcuccacaggugcucugcuauguccagugucugaaguccaggagcugagccugcugacucacccugggggggggggcuccaaagucugaugggcaucagagggagggguuguggagcacucucagagggaggaguuggugagcacucucauagggaggagggugugcaugccauggauucacguguuguuugcagcggcuucuaaagugcugggagguuuuaagagagugccugagugugugugguuuagaguuccaggggcuaugggaggcacagagaggaaagggcccuaagagggcugggauaccagggccagcucagcgcugugaugagguggaagcucccaaaugcuauccccaucccugagaacucuagccccaucccuagcuggguccaggacaagaaacacuacccaggcauguucucaggucaauaggcaguucuggcauuugagguucuaaggacuuccagcaacuccaccuccuguguucucagguacccccuccacccccacagagcccuacucagugaugacugguguccaguuguuccugugugcuggacaaucccacccaaauaccaggauaguccagcaaaggugucauggcuuaagccagcauggcccuugaguagaugggauauguauucucuucaaugguuccuucugugucuaagggaccucaaacgggagauugcuuucugucacauggaauguccugagcaggucuaccagcuguggugaacccucagaacuccaugaugcucuucucccccaacuuaauggcugucagaaaccggugcagucagugaguucaaguucucacaugcucccgagucuccacauccuugcuugugaaguugaggugauggaaagggcuagaauggagaggacccugggagaucggugcagccuccuggguaccagcuugucugccuggccuugugcagaggggugggccaggccucgacaucuaaccauucccgagucucauuggaguagaguguguuguaagauuaaagcaaaugggaugggcaggagcggaugaaccccuagugggucugaggagaacccuaggcauggugagggacgcccuuguggccuuagcuuccuguggccauguagauggcauagcagagccuagacaguugugauagguaaagagggaacugaaggucucuggggcucgauguccuggguuuguagcccauccuggucuuccuaguugggagguucucaggauccuuuagucuccuggaucugaguggccccaucucuaagauggggaaguggacagaucagaagcccauaagugcuguuucucccacagggagugacaguuagcucaagggcgaaggccuauguuuuccacacuguuggagacucugcacaguuugccaugcaggggcaccggacucuagagcuggcuuugccccuuggccauuuuggcuucugcauauggagcuccuugcuccugcaaauggccuucaguucuagcuguccuuuuagauuccgggugcuucacagaaacuccacuuuaaaaauggccuggagacuaggugcgguggcacgugcuuaaaucacagccccuggguggccaguggagguggaucuaaaguuugaagccagccugaccuacacagagaaacccuaucucaaaagugaaaugaucccccugcccagcuagaagagaacucagagaugccucucccgggugcuguguagggugagcugaggggcccaugccaaaggcuagggcuagucacagggugcucagcaagguugagaaucaauggguguugucacaugucgggggacaggucccagaucaauaaggcccuaccacagggucuugggagauugaguggagggcaaaguucacauugugagcaccgugugccaagaggcaguggagggcuugacccugagggcagaaaucccaguucucacccuccaugcccaguguuugagcagaccuuucucucugcuucccugguucuccauggaccacaagaagguggacaccaagagccagaggccgguccagcucuucaaauacagaaaaaggacagagugcugauggucagcagaggaaaggggagagaggcaggugcccugggcgcggcugcaggaucacugcccuuucccgccucuucauguccuccuccaggccugcaccuccccucagaugccccuuucccgcuguuucuggcgccuuucucuagcaacagcuguuaggaacagaugggccgcagaggguuggggaggugcugcagcuggcugggcagaaggugcucugcugaucucccuguggccugcaggggacugagccagggaguagaugcccugagaccccaagggacacccaaggaaaccuugcuggcuuugagaaagggaucgucucucuccugcccaagagaagcauguguaugggcccuguguaugaauccuuggggcagguaggucaggaaggauagaccuuggcagggagaauuuauaucaagggaagggcagggcaaacggagauggagacugaguuuuaugugauccucuuggggacccccagcucccccaccacuuccagugguuucugaccacucuuccuuggcaggcuuugguagcaagagggucgaagguguauaguacugaacuuagcugagcccccuccccaguuccagagucucacugagagcccauuccucuccccaacuccaggguccagaggaagagggacaaagccaccagcagggacaguaugugguguguuugcuccugaaucaacacaccauacuugggcacuguagucuugagcauguguuguggagagaacgccaggggagccugcagaacuucacuuccaccucagcugugagagcuacaggagcagucagcaaggcagagccuccaguguguuacccccagagaagcaggugcugaggacccuggcacuaccuaggggcaccggcaguggaggcagacaggcaaaccaccuaggaggaagcaggagccaggcuggggcuguggcagagaggagagcucaguggugggcgucccuuucccuggccagaccguuccucagggcucacagacucucaggccaggugcuuccucugggagucaggugugaguucucacggacagucccauucuccuuuccggccuuaauccuucccuuuauuuucuccuugggguguuugugaagccaacacgacaauugauugaugaggacccagaguggcugagggacacaauuccuuaaaccccaaucuagaaacuugaaggccaucucuucagggcucucuggagcagccuggccacaccuacggggugggagucuguaaacucagcccuuaguccccauggagggaggcugcaguugaccccuggucuaucuauuauaaauagaucccugagcaguguuucuccaaagauugcuccccaaaauuagacuagaaacugacuuuauuguucauagcugacuuaugagcagugcacaccugugcagccccagccaugaacaugccucucagaccagcguagggaucaguaugaaguaguccaucuuuacugcuucugugaauuccagagcuuugaacaggggcuacagccacugccacagcccucugaccaagcccagauacugcaagcucucuggagggagaaggaagcugguuuggaacuuggcgagaaaggguuaaacagaggacucugucuucacaccaucucugcgucuucuugaacauccuuagacucuaaauguguguguguguguguguguguguguguguguguguguguguggcggagggggcucaagcuguccuucuaggaggccuagagauucagggccgaugacccuuuucacaggacacgcaucuguuguggaccacuauggugacuucaugcgugaaccagaccugaaacucaaaugcccccagacaaggggcagugguauccacuguaugguccccacuaggcagaugcugauauagagccccuggcucuacaaacucuaccaugccuguggugccuucucgggugguccuucaaaaauucucuuugguggaguggcccugucucugcuuccuggacuuagcuagagccaggacaaaaaugcugucuguaaaacucuguuauggguucuuuggcuccaaccgccacuuugggccuuugacgguaguuggccguguucucgacucuccccuagcccaagcauacuggugugucuuuccucuacucaguccuugggguggucccuguagguccacgauucccuggaaggaggcagguucucuccccugggucgccaaggcuggcggcaccaucucuuccuucagggugacccaacccagacugcaaaggucuccaggaccagggcugacugcucaugcuuuagaguguaggcuguuuguaggugacugccacagcccuccggagccuucccugaguggcagcuuagaaggguccgagugggaguguaugaucuccaagccagccacugacccugcauccccaccugcucccccugcucagccugcuuggugcgguccaacacaucuccgggcaagcugaggccugcccugaguugaugaauagucauaaggaauaaaggggcgggccccgguuuguuguuggaugcagccaguugacagaaaugagggagaugggcagggugagaaugccaacucucaguccgcacgccucugagcauccuccgcuccugccuuccuagccacagagccucaaccccucaguccaccccaccgggcagccaccagucuaccccuaccccaccuagccacccagacccaugccucgucccgcggcacaccagcuccucagcgugugcagacccccacgagccuaccaugcuuuacgucggugaccccaugagacaccucgccacgguagguguaacgugccugguauagggucugcuuagaggccugaugccauccaccuagggggcuuggcagagucugccaugguugggguucagagagacguucucuugacugccugauggcagagggguaggcuggagaguggacagguucugcuucuguucauccuuggggcagcucucgaggaucagcagcuccgggcugggcaggaagugggaugugggaugggaggcuuggcuggcgucuggucagggugguagagcugcugcccaagccccuggguuggauacuucugagaugacuguugaggcugguggcucuggccaugcucaggguccccaagauagucugcccuaggagcgcugcaaagaggucaucuuuguuugggcuuuggcgugaagcugccccacccugccaagagcauccucaccugggaguuuguucacuugacagcgcagauggggcguuucucauagccaugggcucuccuccgugugggugugaacuccaaggcagagacaggcagcgggcuggacccaaggcucccuguugcuccucucaagcagguacagccagccuggcagagagcagaaggacagaaggauggaaggagccacagccugugcuuggccugagcccaagggacuugggcucauuuccagacuugccaggucccuggggucaggcagacaccaggcugcuaauugagcagccuuuauugaccaguuaaaaugggggagauaucacaugagaucaccugaguaagugacccacugcaugaucgucauugggggccagcccuucuugaugaagcagaauuaacaucagaauacaaagggcagcuuagaagcagaauuaacaucagaauacaaccagcagcaggacaacccacaacaccuggguacagcugccccacaaggcuauuucccuuuuaggagagcagagagaguaaggaauuguacaggaauccugggauggcagagguguguguguggguguaggggugugcugguaagggugugcauguggcgugggggugugcauguggcguguaugcauccucuuaugaucagggaaaagacugaguguggguugaaucacgguuuugcacaggugcccuuccugaggccaguaggaggcagagucacuauccaggaccacacagagaccugcccccaagacagccgcugacucugguccuggugccgcugcccuaggucucagaaccagugguggcuaccaugucaugauauuucucauuuugugugugcuguggagcagugugcugugguguguguguguguguaguacaggugguguagugugugugcaugugguauguaugcaugugauguguauauaugugugugcauauggugugugugugcgcgcgcgcaugugguaugugcaugguguggugugugguguguauucacauauguguguguuuguacccacaaaccaugugugguguguguguguuuauguguaugcaaacgaaggcuagaggugaaccuuggguaucacuccucaggugcugucccuguacucugagucucucacuugcaccugggguaugcugugugcugaguaggcuagacuggucuaucugucugucucugccucccaacacuagaauuacaagcacacacugccaugucuggucuguuacauggguccuuuggaucaaaugcagguccuuauuuuuuuuguggcaugcacacuaccaacagagccaccucccugggccccguuguuucuucuuaaaacgcaggcucuguggcuuucucuccccuucauugcuucaucacagcaccaugcgcuuccucugcauucugaccagcguagcaguguagcuugggauuugcuggggcuccaaggcugggcugagccaucauucuaccugcgugggugacuuaguuuccucauuucuuugugagaggaucguguaggagagcauagccuuuugcccagagaauguuaaauccaauguggauggagccuucgcccgugugucacucccccaccaucugccuuuguuguccuuacaacuugcagcagucccuugggagcucacaggcaagaccuguccuuggagaccggacugauuuucaggaugccaccuuaucccuggauggguuucucauaaguguaucccaucuugguuugggggcucaguauacaaguucaggcuuuaucucuggugaccacuagcuaugguuuugggaugagacaugugaggccaugggcugagacaguuuccuucucuguaagcaggguaguagcaacuaacucucaugccugcucaggccgcagauaugagcuaugagguaccauggccucuggccaugacugugccagccuuuuauaagucaguggagguacagagaagcuggccuagagaacugggcacauguucuuccuccugugagccugccucccaccuucccuucucucucugaggacuagagacuuugaccgagugaugaccuacagcugagugcagcccuguauguaaggcgagguuggcucgguccuccugcacacggugagcccauuuacagagcuggaaagagcugaggccacuggagcugggccugauagaugggaugagaugagcggggagaggcugcaacugccacuaucuccugaugccccaaacucuuagcuucuucaucagcuuccaguucuccugcauguacacgucucucucucucucucucucucucucucucacacacacacacacacacacacacagagagagagagagagagagagagagagcagcucccaggauauaguaaggcaagugugcucugguucuucagugucuucugugugaaguggggcucagcuuucuuucugcagaaccagcaucaugguugcaggacuggugaaccugguuauccuccaaucccuuaacccccagaccaacacacacacacacacacacacacacacacacacacaugcucuuauaggcaccacacauacauaugaacacaaacacaccauacaugcacacacaaacacacacauaugaacacacacauaugaacacaaacacaccacacaugcacacacaaacacacacauaugaacacaaacacaccacacauacacacacaaacacacacauaugaacacaaacacaccacacaugcacacaaacacacacauaugaacacaaacacaccacacacgcacacacaaacacauagcacagcacauaucaauauacaguggugcaugaauaccucauacucuuguguaaggcagcauagacgugcaugcacagcccagggcuggaguucacccugucuggagcaggcuucccugugcuccugcagaaagcauggcuucuggaccggaggagcccgagggggcagccccaggugagagaagguagccgaguaacaggaaagagcuguaggacagacgaguggagcuggugcagugcugguaacugaccacacgggggcagggccgagacugggagaagggauuugguccaggugggggccaccagcaccuagggaagucagaguagaggaaauucuggagauucugcacuggacuugcugacuggcuagaugucggggaaggaguguguuagaguggccucaaaggcuuucgacugugauggggaauugcugcaggggcugagaagugagauugggcauuucugugcaguguuugggggggggggggcuucagcaguugagcagaugagguagagaggguggccgggacaggacaucuguggagguggucagaugugagaccaagaccaggcuagaggacaaggccacaauuaccuuagaaggccuguagugaugauuagaaacacuguaggguucuucugugugggagguagacaaagagccugagcaugugggugggaguggccagguggacuugcaggugugggaggcaggugggcaggguggugugauggacagaugcaugggugggaguggccaagcagacaugcaguugugggaggcaggugggcaggguggugugauggacagaugcaugggugggaguggccaagcagacaugcaggugugggagguaggugggcaggguggugugauggacagauacaugggugggagaggacagguggacauucaggugugggaggcaggagggcagggugguguaaaguggacaugaguguuauuuaagucggggaagggggcuguguuaagaggagugggagacaauuuugggaaagagagccacacugaggagcagccuggaagccagaagagggcuucauggugacccgggacaaaggaccccauuacaagguuagaaaagggaccagaaucagcugcauugagggagcuggugaccccggggaggguagaacuaaguaggaucaggucugaggccaaggcauacccaccagagucggauccaaguaggucauccuggacccaugucccuucucaguccccucgcuguguuggaacgcaucugcuuuccaugcuccgucccgcuccccugaaagccagcugauggggugucagcccauggagccaaucugagcuccuaggaaacaucaccucagcuggugggaagucuucuccacuggcccaaacccaaacccuggaacuauccucgauccccggcacaacaccucaucuaugccgucuguguguccaagggccucagagcuggccacccagugcucagacgugcacggauccacugucagauguccuccaccaccaagcaaggggacugugcacggcuagccuauaacccucucugcugaacccagaaguuaugcucucucaccucuucugcuguguucaucacccaugcacuugcucuggccaggguccuuucccugccaccccacacagaaccuugccgaaucccacaagaccuacagauuaaaaaccauggcagcucuugccuuucccagagccccacccuuccaggacaccggcuucugccucuuugguggucaguauuuucucccuuacgucccggaggcccuaagcuugaaugcugguuagcuggauggcuuguuacuguacuacgaggggagagcucagaagccucuaccaagagaugucaggagccuaacugagccagucgaugcccuggauaugugggcagccuuuguccucaccuuucacagcccaucccccagcuuauauugggaugccuucuccauggggggggggucccaagacaacgucacagccucgcuaugggucgcugcaggugacagggcgacacacaugggcccacaucacgcuuagugaacaucucaugugucacuaucuaauuucucagcuuagcugcucauucuuuguuucucccugaccuaagauuuaggaagagcccgggagguccccacugacugucccaugaauggggacagucccaguggggacugucccaugaaugggacagaugggcagaaaggcaguagggggcggggggaaugcacgaacaccaaugcuggauuugagacuacaagaaugugccagggagaggugcuggcagagcuguguccccucuucuguucucucagacagacaacucgccuuugcuguugggguacacucggugauuuaaaaauuccugugaaucacugcagcuuguaggcagugccaaagagaugggggagcugccuagagaaccccuggaaggcucugcucugugauacccugguucaggcuauguugguggagggguggccugggugggucuugcagacacaugccuggcagcccaguagagcuucugggggcacguuucccggguuugagguguggaaaguuccacauggcccuggcaugggaccgggcaaggcccugccucggcgggcaaaaggagggugcaaugcacauaccucuagggaggcagccguccccccaugcacaaguccugucuuguugacauuuccauucguuuaaucauaggcucggggagacugugggaaacaccaucaggauggaggucuccagcuagcacagaggcgggagagauggcugucuccacagagccagggggcugucagucacuaaccccaggcaagcggaacccaggcucugaccugccugcaggggaagaccccgguuucagacgcuuucuucccuuuagaagaauccacaguguuggcugguguuuuggaagcaggaggacccuaacuccccaucccucagugcugggcucagagcagaaugagugacauuugucaccagggggcccuggggugagccauuccugcagaacaccaagauucccuggaaacagauguggucacaaggucaugucacucauaccugugcuggaugggugaaugccucuugaccccuacccagaauuacuuccuaguaagggagcggugaaggccauggggcagcaaaucacgugcccagaggcugggccuugaaucgaggaagugauguugggauaaaggaauggaggcugcgcaguggaaccugagaagccacagcacacuaugcucuguaagcuagcuccugucuccaguuccuaccccaguugcuucugugaggaagcuagggugggccacaacuaaccugaaauccauaggaagggggugugcagaggccagggcaaauucuagaaagaagggaggaaagaaaauggaggaagggagaaaggcaaagaagggagaaagggaggaagaagagggaaggggagagagugagagaaggagagggagggaagaaagagagggaggaagggaagggagaggagaggugagggagggagagaggaagggaaggagagagggaagaagaaaagggagagggguagagggagagaaggagggagggagagggaggagggagggaaaggagaaagggaagaagggagagaaggagagagggaggaaggagagaagacagaaaggaagaagaggaagugauggagaaaaugcaggaaaagauggagaaagugugggggaagggaggaaguagaagccuaggcaaaauccucuccuacugaggucacuggauuuggguagggcugugcuccauacucuccaguuguccgguggucuaugagaccauguucccagccgggcaugguggcgcacgcuuguaaucccagcacuugggaggcagaggcagguggauuucugaguucgaggucaaccuggucuacagagugaguuccaggacagccagggcuacaccucgaaacccugucucgaaaaacaaagcaaaaaaacaacaaacaaacaaacaagagcccauguucccucuguacacuuuggggaccacggugggaacucugaccuuaaggcugaguucccccugcugugugcuggggauccugguaucauuccugagagccuggcugaggauuagaauuggugggaccaggaagacugucagagcugcugugggcucagcaugaggccagcacacaggaaguucuccuucugaaagggcaugcucaauacaggguauggagauggugggugcccccugccggccaggcagaugagccucuggcugguggcugugaaucagggacuggugggucacuguggcgagaucuggaggccuguguguggcuucucagaagcacaacagugacagagucaagugccugugccucucugagagggcagcgccgggucaggacccagcacacuugaggcccugugugcuaccgugaccuguucucauuucuuuguguguacugacuccgagucccucaucagcaucacaccgaaucaccucgauguaaacugaggcagaggagucacggaaaggguuucugugugaagcaggguuaggggagaccggagauaacacagauaaacuggaagggaagcccagagcgcuggggcggcuucaggagguaggauggcuccgcaggcugaucuccugccgaggagaugcaggucagccuauucuccuggaacuccgcauuuaaaugugacaaccgacaggcaggcuuuucugucacuguuuuuauuugagaaauaaacuucucgggggaauuggguguaauaugcccuuuguugcuaagcacuggaugcagccaguccaccucugagguccgucuugguguucugugcuauagcaaaggcugccguggguacugaagucagagaggagucgguguggaaggcaccugcucccaaccuuuaagaggucguucauuuucugucuacauauauaagaacagaucgaugagauuguuuguagguuagaaacaguuaagaugugagaugggagucuucgggguaaaaucauaguauccaaugugugcaugugagggcaggagccugauagcaggacgguaagagccuccuugucugguuaggacaagagagugguggagaaaggagaggauagagggggaggcccugcccucaaucaggcaucaaagagcuugucuaacuaugguuggguauccacuucaaugccacguguugguacaaccaguacacguccaagagugagaccccggcugcuguuccccauguccccugcuuuaugacgcugcucagcugccucuggagcucagccuuuggagacagccuugcuccuugugggcagacaggcucugucccuuccucacugggccuuguguuagugggcuggugcugaugauggaucaguugcaaagugucagagcuccuggauucuggcguccugguggcugaagcaggguuguuccuucugaaagaacagccauagguuuucuugcucccagaccucgcccccacaaccaugcgacaagcuauguguggauuucauucucacuaugcagaagauaaaaauggaggcccagggauguggaauaauaccccauuccucuccugcuccuacuaccuaccuaccugccaagguauagugcucacccugggcucaucugucaaccuagcucagccaagagagagugcuagaggagugaaccagcgucaucuacgucucccgaugcucaagggagauaagaaacucagcugccuuguagcaggagcuuggggaccuaagggacccguugugaguguucuaugcugaugacccucugcuaguagagcgaggucaccagccugcugucaccccaggcccugaagaggccaagggagacaaggugugaauacugaagucugagccuaaggaaagagaguagaagcaccaguggcuguuuccagcagaggugccggguaagcccccagcagcacuaucugcaaggaccaggaagagaccccgggacuaagggaauaagagauccuggccuucucuguagagguggggcucacugagacccccaucugucugagcccaaaauaggucuuacccucaauugcccugggguuuucuggaugaucccagacccuguggucacaguccagugagcgacacagaccuggcaauggggccguguucucaaacccucauccccaucggaacuauugucccccaauucugauguuggccuuucccaugaaggcugguccaccaguggccuggacacuguaggaagggacacccuuuggcuccaugacgcccucauuccucagggccucuucaggucacgcccagacacuccacuugcaaguauaggcacaugugugccgccgcaggccgggcaugcccuaauuagcccacuaucuuggaguucucauugaaagcaaaacaaaccaaaaaaguuuggguuugcccagguucuucccugaggccaagugggucucgucugggcuuccggggggccucugggucugggggaccccugggcuucuguguagaccugcuuaggccucucugacgaggcuucucauuucaacagcaugacgggaggcaaaaguggggggccagguugagccucacugccuggcaaugaggaaaugguuuccuucccaugagccucaggaggagggaacccuguguagaaggaacgucucuuacacucuccagucacuggggucuuuaccaucuuugggagacacgguagacacuaagaccagugagggaguggaagaugaccuugggacuguaagaaacgagcaggcacaggagauccagcauucacuagacaagggaacagacucuacugggcagccuagugccccuauagaagucugcagaggccugccucucugagggccccgggcuugccacaccagccagguuuugcaccccagugcugagggccugccuucccgaagcgccuggucccuccugcauaagcucccacagaugcuaucgcuguuccuuuugguucaaugacuaaguccuuggcacccaccuccaaucauugaagaaugcagacaaguuaaaauaugaaccucgcugccgugggccugcacccugcuucugagacagggcucccugcccaucaaggaugauggggaucgggcacggaggggcugcugcugccuucugcagaugucaugacuucuuccaaagcccuuugcugggaagagagugaacuugguugcaggaaggagguggcgcugcagcuucauccuggaucugaaacaauguaaccagguucugggaucccuggaagcaggaaccaggagguagagccauagugcaucucugcucauuccuagacagccgcaccagagagagugaccuuccugacuaucacauagaugugugaagcugucuucagacuuaucacauuguuguacauucacucauucauucacucauuuguuaacucuuucauucauccauccauccauucauucauucauucacuuacucauucauucacucauucauuccucugccacuuuguccugacagaaaacgccuugagcaaccauuccaaaucgggaucaugugguccagaucagcaccacucagggaacacagugggugggauccugugucuauagagccaucugucugugggauugccugagucuguuaaauccuuuguaucuucaggaucccugugucuguggggacccgucucuguagguucugcaucuucaaauucuaaugaguaggaauccagaaacauuuggaaaaaaugcauuuauacugaacauguacagacaugauucccuucaucccuuaagcaguguguucuaauggcuacacggcaucugcaguggguuagguuuugugagccagcucggggaugugugcaggcucuguauaaauacuacgccacugucuauaaagggcuuuauuuaagggugucugugggguuccugggccugaucucucaugaacgcugagggucacggguagaaugggaaccacguauggaauucugaaggucaguagcugguuucacauggugaaaagagggucagagcuguggcucaguagaggaguguuugccuggugugugugaauuguggguucgauccccaguucuggaaagcaaaccaagaaagaaacuggugaauguaaucaauaacuuacuccugccacuguaggucauagcggugugcagagaguccauugggguacuuuucuucccacacucaaacccuuuguagccauugguccaaccuucaguucugugugguuccucacagacucacggcucaauugaggcauaggagcugccuuccagaggagagcauuaugacuggucaaggccaacagcaugcaggcgcucuagcugcuguagccagggcuagccccucugagcucagcagagacuguggcaagaccaagguagaggcuuccacugggcgguugggcuguugucagaggcccgugggagaaugggggugcuugaauggggggcugugcugggccaaccggaguucugacuugauguugcucaaauuccuaccucagcagaagugggaccaugaauuccuaccuggagucuguuggcagaccuuggagugggguggggucuccucagccuagaaaccccacagagugggagguuuacggccugccucuuucugaagggggcagcugucguaucccuuguucccuuugaauggccuuggugcugggagagguaaagguugggugcuuuccuguuuuagacaggguuauuaagguauaauucacagagcauacaaucuucucacuuaaaauguacaguuugguagggguuguaacucgcauggcagagugcuucuugccuagaguguaugaggccauggguucaauucccaacacugcacacaguggguacccuggugccugccuguaaucccagcacucgagaggcaucggcaggaggaucaggaaagaguucaaggucagcuuccuauauaaugagcuccaggcuagccuggcugacaugagaccaugucucagaaacuaaaaauaauaaagcaagaaaguaaauaaugaaauguacugcucagaagcuuuugucugaacaguuguauguaagcauugcuucuagaacauuccacccccaccagagagaaaucccgagucccuccacucucgauguaaagccuagcagccuuguuugugccuccucucugucuggcuucugccucucugucuuugccgguucugaguguuuaccuaguugaagucacacugugugucugcucaaaacaagguucugaauuucauccacacuguugcuauguuaucacaccccuguggccaguggcaauucuaacuuguuuguccacuucccugggguagagguagggagacagggcagguguccugugacacaacaauuugggaaggcauaggaaggacuaugggggaggauucauggguuggacuauguccuacaaacccagccccucuguagagggauaguuuuauccuauggaaacuuugguccccuugacaaggcuuccacccaaguaaaguagggccuugcauauuggugggaaggcgaguccgagaugccccagugucccagagcuggggccgccaaggaaaucucugcuggauucucagaggcucaggguacagaggucacaguaguggcaagagccagcacucgggguucgagagauggcucaguggcuaagagcauuuacuuccuuuacagaggacacaaguucgguuccuagcacucacacggcagcucacaaccacccauaacuccaguucuggggggucugaugcccucuccguaauugaucuggggaucacacucuguguccgcagccaggcuugaccacccauacuuaguaagccaaaugccacacuaggaagugggacaaagagagccacucaaguuuggcuucgggguccaaagugagagugaaacuuaagcugaggaccaagaaguugcucaucuaacacugggucaagguguggggcagcccacuggugacccaucacugcaguuuaguuucagugggggcaaggcauuagaacucugugaagucucuuucugagagacaaucuucccuuuuggggccuuucccuucuccaaguaggagauucuuggagggaaacucccauuucuuugggguccguuguuuuaaacucccauacucagacacaaguuuagauuaccuucauuucuaccaauccucuuacaccuuucuggccugcuucugcacaggacacaagugugcugcacauacacgcauccaggcaaauacucauacauguaaauuuaaaaaaaucuuaaaacaaaacaaaacaaacaaccagggcuggagagauggcuuagagguuaagagcacuagaugcucucuuccagagguccugaguucaauucccagcaaccacaugguggcucacaaccaucuauaaugugaucuggugcccucuucuggccuguaggcauacaugcaggcagaacacuguauacauaauaaauuaauaaaucuuuuuagaacaaacaagcaaauaaaccaacaaacuagacuguuacuugcccuuugcacgcucagcuuuuucuacugucuccugagcugcucucccuccugcugggcgguccuuaguaggacccuuccuucuguaucagcuuccuugacucugaccuaaccccaaaaacuccugucaaggguucacaguggaccacugaggccuugucuucucuggccaccuccugcaaccauccuccauccuggacugaggcacaggaggggcugagcacaagguccccagcagagagagacccguggcauggggcaguguccaguccaggccuugggucuuagccucccuuguugucugcaaacacuucuuguucugaggcuuagaggaggcaggcugguggcaggagauauaugugcagagguuccaaggccucucugaagagggcaaugggguaaaagggggcacuuugcucugagaucacacuuccgcgugaucuagucucccguagauugcuggucaauuggaccugcucauuccugccucacaccuuugggccccucuucugugauguggggacaaggacagugcccaccucaggccugcgggaauccaucugagcuugagggaagguucgucagcacagacaggaucgauuaagcaucuacacuuagggacccauucugcacagccauuggguagucuuccccaaauccugcuugccaucucuggacguggacuggguaguccucccauugauaauuuguugaaacacccaaggaaggaaggugagacuuccuuaaagcuccuagggaaggcugacuuguccuggggucccaaggacagagaaagaggguucccagagcucagguuccuugaauaugugauuuaggggaaggacugggcugccugggcuagccugagaaccagcagggaugcugggaggagcuaccaacccuggaggccuggggaaggcuuuguaauggagauaaagucaguuuaaauaaauuccucuggaggcugucacuuagaucucugguggcugagcagccuuggcggaguccaucacuuagagggcuguaucuaagaauccugccuuccagggcacccaugcucuaaauccugcuguacccccaccccacccuugcagccagcauccaggcucucaggucuaugugagcacuccagccucugggcugaccugggagcauggugguacccacaggggucuccggcugggaacuuucccaaccaaacagcucccuuccagguaggugugcaaagccccaauccaccuugcuggcagcuggguggaucccaagaagcccuggcacccgggaggcggacggagaggggcaggcaggagaggugaaugugcguuuaucccaacacaaguaguggccuguugggguggggugggggccccaggaaauauuugggaugacuuggagcccgcuggcccuuuaaggcuccuguaacaagacaccuccccgacgggacagaagcgguagcuggggcuuccaccuuagcccuuguuucuccccucccaccucccccuuccuugccaggcccaguucaauuugcucagcagugccauggaccagaugggcagccgugcggccccggcgagccccuacaccccggagcacgccgccagcgcgcccacccacucgcccuacgcgcagcccagcuccaccuucgacaccaugucuccggcgccugucaucccuuccaauaccgacuaccccggcccccaccacuucgaggucaccuuccagcagucgagcacugccaagucggccaccuggacagugaguagccguguugccaguggaugcgugaagggagggcagcgggguugagugccacgguccugguacugaggacugaaugagcacacaggcuguccacaugggguucccaccuggccagagccaggaggagcaucgagcaggaggcgggcccuggggcugggcaguguggguguggccaccccuuggacuuguggccagagucagccagccucccacugaguccggaaaggucagaguguuguugccagugagguccauggggcaggaagaguggccggguuuucuauacucagugccuugaaauuggucugguccugaacuucugcugaaaguguugggagcccacaggggcccacccguuugcuaguuguggguuuguguuuugcccucauaucucucugugcauuggcuugggacuggcucuccaggugcugggggcucugguccuuucccuggugccuccaggaacaaccuggcauguggcugggauuagcagauguugacaaagucccaccuguacacuugcugagaguugggcagacagcuaaguacuuugacuugcccaagguggagucugugcccauuucacagucagggaagcugagguaugaaaagggaaagcaguuugcucaaguuaugcagaaagugaguagaugcuggacuggggacacauggccgugaguguucuuacccacugagcacccaggcucucugugggagauggggcugcaggaagagcagacugggacuucagaacgcuggucugggcacacaggacauuggguaggaagggcagcccuagagccauccaggucuccauacccagcuaagucugaguagagggaacccugagccugggacaguaggaggugcacugagggauguuaagucauccacccacucucuccagggagcagcuggagaugcagccauccacgcagugcaagcucuaucucacucuccuccagcggcucuuuaaaaacuaacucccacaguguggcucucacauucucuuuggagacugaagagcuggacagagccagaccuuguagguggccaccggugaucagcugugccugacuggcucugguuucaggcuuugaccuccuagaguuucuuuuaccuacuguucuggugggcuccccagucacuagaccaucaccaauugaaugcucagcccagcugcuggagcucugaggggcuucagugggccgagagggucuggguaccuguggugcuccaucccgagucacugugggccagugugcuccacucuccgugaccacaaauuauuggaaggcacugaggucaggaggucugaaugagacaggaaugguagaguacacagcuguuacuccuguccugggacaguggaggaaaccaucuaacauggccuccugaaguuggucuuuguguagaacuaccugcuaaaggccuccucuucugcacugucuguaguuuuggggguugaaggggaccuaggcucuuccuccacccaagcugagugaccuagggucaggucaggaagcccaggagacacauggguaccuaccucagucacagcgggcucucuacgcugcucuucuacuuccaaugcauucccuagcuccaucuuagagugaggcgggguccugucugucauaaagaucuggugaugcuguaugugggauugccucccuuccucuuccuugccagagaguguugaugaggucgcucuuugccgugccuaugggcucaggugccucugauggucagggcuggucuuugacaggggugacagugcccacucuacugaauucuuccucccauuuggguccugugcaguccccucugaggcacuggacaucaagcgucccaugauggccuguguuccugcugcucugcucuaacuguccccagggguuagucugcucagacuggccagacauaccaaagaucagggaaggcuuggccucccaacccaacuuccacccaggaccagggcagcagagcugagcugucaggcaggaggaugcuacugccagcccccucccggcccugucacacaggggcagaggugggaccaacauugauaaugagauuuuuggcaccucggcgaucugggagcagacacccaaggguuuuucucgaugcugagagaagggacuggcagcagcugcucucagcucuggggguccaacugugugggugcugcccagacuugccaccgaggccccugccacgccaccggcugguaacugauagauaauucauauuuuucucaaguacuauuccauauugacugcugcccccauuccucucagauuggcaaaaacaugcucacuggccucuaagugaccacagcuguuaauggggccuuuggucuugccauugcugaagccacugugggacucucugaccccaaaggaucuacuuacuuguccugaccaacuucccuuagccugaaaaucugcuggugcaauaagaggucugggaccuuagagugugacccugcauguaugaacacauacguguauauauacaugcacaaggucccauaugcccggacaccuagguacacagguguguguuaugcauacauguauauaccuaugagcacacauggguguaaauauauaugugcucaggggccuauauauauggauacacagaugcacucacauauaccuguaaacaugccggcauguguguacauaugcacacacauacacaugccaacagaugagcaugugaacaugcaugcuaaucucccugguugcugccugggggacagcuggucucaggagucccucaguggaggaggaagugggacaagguccuuuacauauccaaacagcaagauggguucccugcugcugucuagcgccagcucagccccuucacccuggcuuugccuugcugagagagacggcucuuuucaguauuggagacauugagagacagaguucugugguuaggcaagaggacccguguggauggaugguaacccuggccugguaugaugucuguagaacaccaagggcaggcugugacaccgccagccuacuacagaggcagcugcagaggagcccaagagugagggcgcgcucaugaauggcuugacugccugagagcauuacagauagacagacagacagacagccuggacauagucuuaagugaccuucaggugaagcugccuucaaccuguguguguguguguguguguguguguguguguguaugucugucugucugucuuuaugucugucuaugcuuaucuguccugagagagagagccccuaccuacccacccacccacccacccacccagccaggcagcagccccuggagggaagcacaaagccucugugagggauucuuagggaggacagggcugagucaacacuaauggauuuggagcaaacuuuccagccccucggagguuugcaaagcacaagaauagaggaggugucccgacaugauugugguaucaauugcguuauccuaaaaguuuauggaaugcauaaauggaauuaauaccuuuuacuggcacggggagcaauuauguauauuuaaagcccagagaagaguucuaacaauguuuauuguggagaugaaacgugaauuauuaggggaaacaagagcacuuauggagaaaucgcagcaauugcucauauugugucuagcuuugccggagagaaugggcugccaguaggcuggcuccggcuuggucugagcaggguaccugcaccggagauguaugucugcucucuccauccacuaguggucuaaaggacuuugguccccaggaggcacagaaucuagccuggagacucugaacuccugaauccaacugcagcucgacacuggcaggcuggucccugugucuaagggugcucccuccccagcugaguggucacaucacauaccucaggguucuagcaggggacaggagacagggcaccuuggaggacaggacucuauccugugaugcugagaugcagggcagggcucaguccagcaggggaaauguaccaugaaucaacaauaggaaaugaaggagggguguuccauaggucugacuggccuccucaucuuggagguuggucacuucuagaacguucuaaucagaaaccauuuaugaaucuacccagggaggauggugggcagauagugugucucucggccagcacagugcuaaggaacaagccaggccccccuuuuugaggcaagcaggcgggccucugggcaucagagccuccuugcuccugcucacagagcuccuaggaucccagaaccacuccuagggaacuuggagcagugggcagggcagagagaaagagaguuccucaaacucuugggauaugcuguuggguucaccauuuuguuucugcccuuugcugaugggugaccugcccuugaccggcccuccgagauccucuucuguaaagugggaaaggagguauacaugccuacugcaggccgagggauggcaccuggggucccgagaugcccauucgggucgggucucuauccccucuccuguaaaguucuccccaguguggcaugagcagaugugagacagucugaggaagggucagcucuaggccuuccagagucacaccaguucuccugaggggaggaccggggagugaaccaggaacacacucccaguacacacagccagcccugaaaaauggacaguucuuuguaaugugugaauuagcacucaauccuccauugacagcaccccccccccaaaccacaggggauagaggccagugugggaguguccaugguagguuaaagcuggucaggaguuggcuaacacugccaggugagauccaggugaguugaauguugcuuaccugggcccuccaggcuggugguaggcucuagggaaaccaccugaaauguauuagacuccauccugugcccugaaggcucaggcccugucaccuccucuuaggaaaaggucacagccacauccaggaccucuugcucuuauaugaguuagaauauucuaggcuuugagagcuguaagucaggguccugcaaccaccacuuaucagugcaagaagccaaggugggcuaagacuggcgcucugagaucggauaaccggguucuagguccggcugugcgguacaccugaagguagagaugcucuuuggaaaaauuguuggugugguagguaaggcagaaaccauucagugacccaaaucccacgccugugucugccucucaccucugucugugauaggucagcucucauggugcugaaccuggggagggugagaugggcugugccgcgcucugcaccugggccugguuccagggaggcucucacuagcuuugcucaguacaagaucagagauuuagaccccagagugucccuguccuauaguuccaauaaagauguuuaaaguucaaugacaacuuauauuuuaaggagcuauugccuacagcacugaagacuggcucuuucaaacaugcacacgcauauaugcacauacacacacucagguacaugcacacacacauuaacacacacacucaugcacacacauacacacacucauggcacacacacacucaugcacacacauacacacauacacacacacacucagguacaugcacacacacauucacacacacacacucaugcacacacacacauacacacacacacacacucagguauauacacacacauucacacacacucaugcacacacauacacacacacauggcacacacacacucaugcacacacauacacacacacacacacacacacacacacacacacacgcgcacucacgcacgcacgcaccuugccucccuggcuccuggcuaucacuagccccugagacuguauggaaagucacagguccuuagagaaggagcuggcuaagaugaguguuuagaagggucacagcuggagcggaaugugugacugcccugagauacccuugcaaucucaagcugaugagguugaucccgacuguggaagcuacagcuggggaugggguagggacuucaccacugacagccaacaggggauccauacugugcacagagcaggcuggcuaccagccucgcuguggguuccuguacuggacgguccugugaccugcaccccagcccuaaucacaggugggagaggcugauggcugguggccagaggagaggcuacucaggacugccugaaggaguggccaaggcacagcucuccugcuggcugggucaggaagaagggcagcaggggccccuuugaacucacagggaaggugagccuaugguucuuuggaucuggucacagacuguucucagacuacacucuuuucuuccugaaguccccagauggguccuggguccuggaaaaagauuagauguccaaguuagggcuggagugacggaggugacagggccuccuaggaauaucucugaaaccccugacaguggccuucuggagcuggagcaucauacagcaaaggaggucagccgcacccagccaaccagccaccuggagccuccaucccccccaugacuugaugucaggggagacacuucccaguaagaccagggcaggccagguucccccacccccaccccgccccugccuggcagcuuccucaccccccaggaacacaaccccagcccagagcugccugucuuuccugccuuugguguucuacuuggucaccugacuguccucuuaaccagccuaucuggauccugaucucuggucucugaccugguaagucugauggaaaugaaagaccaaagauggaggugucgggucuugagaagacaaaaccaaacuggaacucacuucuaagacuucuaugacccccucauccccaaaggugguucucaaccuuccuuuaacacaguuccucaugcugugguggcccccaaccauaaaauuaccuuuauugcuauuuuguaacuauaauuuugcaugggguaaggugagguggggaaggaaguaagagacaagauggagaaaggaugugagucucccaguccucucuggcucugcucucucugggcaccaucuccaaguaccuccucacuccuagcuguccaggagcugaccaagcccuguccuuugggauuuguacagacacuucauuauguagccaugauuagucuccugacauucgggaccugauugaccuucauccucugugcuccgucccaaaggcuggggcugaggggucacacauacuaacuggaucuuuucaucaggggugcucaggaaagcagcccccagcccucagcccccagcccccagcccccaggccccagcccucagcccccagcccccaucccccagcccucagccuucagccuccaggccccaguccccagcccucagcccccagcccccagcccccagcccucagcccucagcccccaguccccagcccccagcccuuagcccccagcccucauccagucauuagcauguaaaagagcaacuguugcuuggcaguccucuagauuuuaugagcauuuuaccagaaacccgaggucuacagccaaugcaaugcaaccucugauuacugcucuacccccagcucagcuggcaacuuuuagaaacaaaauucuaguuccuaaaauguccaggugaagggucagaguaggcaccuuacagagaaagcagcacagaccgggcccauguuauuccuuuggucucuauguaaagccaucagcugcagagcuauguagagcagccucccaaauucccaaccacuaccuucucccucucugagaugagacuaccaggcccucacacaucagcuccuccgccuggggcagaaacuacuggaagguucucugcuccugccaaggauaaaugggcuccaaaccccaugaccugggacccucugacuucccagucuuagugcaaaaaaaaaaaaaaagaaagaaagaaagaaagaaagaaagaaagaaagaaagaaggaggggggaggggcuggagagauggcucagcaguuaagagcauugacugcucuuccgcaggucccgaguucaaaucccagcaaccacaugguggcucacaaccaucuguaaugagaucugagacccucuucuggggugucugaagacagcuacaguguacuuacauauaauaaauaaauaacucuuuaaaaaagagagagagaaagaaagagagagagagagagagagagagagagagaaagaaagaaagaaagaaagaaagaaagaaagaaagaaagaaagaaagaaaagcacucugucucccaggccaccaaggugcccauauggcucuugcuugccuguuugagaucuugcucaagggucggggguggggagcagguuacucagcuccugaggggugccccagcuagcuccuggccaaccucucuguaggggaacagacuauggccuuccacucacagagcaaucagucagacuucacaucugccucccggaguguccuuuaucuucuuucagaccgcuguucuuuaggaacaacuacagccucuuuccugcacacuuggcaggggcaggcacuggggccuccaaugauguguuuauagaacauggagccuccuugcccucagccugcauccuggcuugauggugccaguccggugacgguuacccgagcaucauucccucccuaagguucuaucggggcucccuaagcugugcaagagcucaccccugcucucaggugcucccugaaugaccgaauaauugaacaauguaaauugugcgagucaaggccaagauguacccacaaaggggcugccccaggaccucuucuuggaugauaggauccauagguugcuccucucgcaguggcauuucuccaagagaaacgaaaacaugguggggagucauauucaggggcuguggaccuggguuccuccagauuugagagaucagacugagucuaccagaccugugcccugcucuguggaucugcccuaggaagaguaaaagccugugaucccagagaugauucucaaaggggucuacggccucagagaucagaaacucucacacacacguauacacacacacacacacacacacacacacacacacacacacacacacacaaagugggcuacaaaaaaaaguauuuuuaaaaagcccccaccacagccuuucguucugaaucuguccuaacagauucacccaagcugguuaacgguauuugcgguuugcaagauacuacaugucccgggaaaaugacagacaaguuauuaucaccuucccacuguccuccugcccaaaccugccugugccgggcacccagcugccgggagcgggugcgaggaaauuaacagcccugugccgcgcccgcccccgcccgcccucucacccaccacccugcaccgguccugccaggcuaggggcuuccagccaggcccggcccaucuuggacuguggcgggggggggggggugggggguggcgggggggguggcgagggggggcgcgggggggggagggagggagagaaggaggaggaggggucaggauagcagccguggcaggagggacgucugcuccgcuccgauguugggcaaaguauuuccugcaagccccgcggaacacacgcauccgcgcaggcaagucuggacggcgcugugucaacagccgaagauaaauaagauuuuaucagcucggaaucuguugaaacacauccaucuagcgguucuagggaaggagaggcaggaggagggcagcagggaggaagcauccccacaugacauucuggaaacagagucugacccuguguaggaaggggagcgcuggcaacuuccuagucucccggagacucgauauccuggaguguuguuuuuaccaccugaucuucggaggugugggaaagcuuugguaucucucgcugaaauuccccaccucuggcuaaaauggacuaccacaaacuuaaccuguggccgggguggggcugguaggugugugcgcccaaagccccacgaucauuggauucaagacggcauucaagggugcagaagugaaggagccauguaucuucaugggcuuggauuuuccuuccacccugaccgggugggagacgugucccaccagagaugacucucucaacucugauucuuucucugagaggagacagccuuuccgcagcugcugaguugguaccagggacagcuccaggcgcuuuaagcuccuccccaggguggggcauucaguggcucauccuuaccagcccggcuacucugcaacuauccuuagcuuucccuagaccuccuagggucccacuccaggccauggaaaacagugccaccuucuggggaggagggucaggccucagcuaccucugaccacaccuugguaguguuagugcaugguuugggguuguaaccaauuauccuagguccucagaggacagggauggaaaggacaauugccuucagggucacagcagggcuccagggaugggcacuguggucaggcgagguuugaagccucauugcucaggagugggugggugaggggagcucugaugccccucccuguggcugagcugugcccugagccuggcuccauccugauaagaacacggaggugaagcugaugcacccuuucucccuccaggcauguuugggcuucccaggaauguggccuuaggcaccauuacaccugacuugcucccagcccaucuuggcuccugccuuggugggucuaugacccccucuuaggucauuguucaugagcuagagcacuggagggaaagguuaacucuguaggagacuccagguccaugagccccagcagcugugccaacccacaaauuaccuuaccugguaaugagcaaccaugcuagaauaaggggccucugaccuugcuggcucucuaccacacagcuggcaucuggggguugagugguaagucagugguagacaaaccuggcaggugguccaauuuaggggaauccagccugaauuccugagccagaacagggagccaagggccagccuucaaaggcuaaucuccuuuuuccgccccuggugacuuuggucucagugucuccccaacccacugugggcaaggccuguuucauggggguguuggccaccuccaccccucagucuauuuucuuuagguagcuaggccucacaaacaaugggcacucgggagauguuugguaaugcuugggacugucaccuuuaccaggaaguugccugauuggccucagguugagucucucugagcucaggaugagcuggguucccuucaccguuaggccuuugcaauugucugagccuggggcuugcugggaaaccuucauuuguggauaagcaagagcccagggcacuucacugucacuguauaugaauuuacuuaaugucgggaggggcaccucgcacugugaacuucaugccaccccguguccuuccuagggagccacaguaauuacagagcuagugugcuuuuuaccaagugcaggcuguagacccccaacaccugcaggcugcugcugcugcugaaggacagguguguguguguagcuguuuauuggccuuuccccagggaaccagcuacuccugcuacucuguccccagccugcacagauggagaccaggcugcaguguacuaacuugaggagaggccguugcaaaaaaccaaagcccagauuuggaugugcagaggucagguguacccuguccaagucucagagucccccauguauccuggggaugaggcuguggcuccuuccuccagaauguuaggaugaggaucccacacaccagcagacaguggucacccccccucccgaaagucacaccaaccugcugguguggccauuagcucucccucagcugcucccccucuuaggcucucucagcuuuucaaaacagucccugaagccuucuguggggucccuauagugaguaucucuugcuuuuuaaacaggagggaagggacuaugucauggcgccucucccugcccucccuucauugcauuugccuaugguauaugcuauuucugcauacuccauuguggagaaccauaagcuauauaggguuaggguggucagaaucccccacugucccuugcaaaggaaagauuuggugugugagcaccaccugcccauuccuguuuuguuaacagcuuaccaucucuggccucagcuucauuaacugucacaagggagcaugguguauauaauucaugugugguggagacuuuagagugaaguggagcuucauaaaaaucccuugggagccaggcggugguggcacaccccuuuaauaccagcacuugggaggcagaggcaggcagauuucugaguuugaggccagccuggucuacaaagugaguuccaggacagccagggcuacauagagaaacccugucucgaaaaccaaaaaccaaaccaaaccaaaacaaaacaaaacaaacaaacaaaaaaaaaaaacccuugggaagagcuagagagauggcucagaggucaagagguccugaguucaauucccggcaaccacauggugucucauaaccaucuauaaugagaucuggugcccucucuucuggccugcaggaguacauucagacagaacacuauauacauaauagauagauagauagauagauagauagauagauagauagauagaucuuuuaaaacaaaaucacuugggaaggaagacaagaggagugagucaccagggguuucaggagccauagugagagucagcuagcaggugaauaaauggguaucuugcuuuuccagccuagaucaggccgcuggcugcauagguaggauuugcagcauugagcccguuugacaagcucagaauugcauccucugccuugcauagaauagucucacucugauucugaaacugacuuggucuuggcagggccaguacaauccuuagaagagugaccugggacacggagggggcgggggaggcaugaugacgucccauugucccugagagacauccuggcaugaccucagguccagucaguuuccaggauggggaaagcgggucuugccccccacaacagcuuggcugccuggacuuggugacuuuacuugguggcacagugcuggugacuggucaacagcaugcaaggucuugcugguucagagaguucuccauuggaggauaaaggcaaaggcagaaggggcaagccacccaccuacugagugauucuucuaugcaagguagaaggaugcaauucugagcucgucaaaccaccucaaugcugcaaauccuaccccugcagccaguggccugauccaggcugggaaagcaaaacuaggacugauucccacugaccucugacccacacccccaacacugucuuacccuuugucauccuuaugcaacgguccaccgcucgcagccuuugagaugcaggugagacacauagccaggcaggugaugagcaggcaccaggcacgcccaucucuacaaucugaagcaugccugaagcaucuggaagcaggccucaucggagcgcuugggaaaggggucuuguggaagcauccggaacugagcugccaucucaaccuggcccccuucucuccuccaguacuccccacucuugaagaaguuguacugucagauugcuaagacaugccccauccagaucaaaguguccacaccaccacccccgggcacggccauccgggccaugccugucuacaagaaggcagagcaugugaccgacauuguuaagcgcugccccaaccacgagcuuggaagggacuucaaugaaggugagcccccccucccccucccagcugugggacacugaccagaggcauagcugagagauguaggccagugagcacagcgguaagcugcucucaacucuccccucacaggaacccacacccuagcccucuuuccauuuccucagcucugacuacaguccaagaggcugaugguccagcaaggguguagucugagggaccagcugaccuuggagaaucuugugaagcaucccugcagugucccuggugaagccugugacacccccagggucagauuaucuggggacagcuucugucccgcucaaggccaccuaaaugaggguugcacagcucugagccuugccugggacucucacggggacaagcccuguggccucaguucugccacacgccugguacagggguaugggauggaagaugggccccucucuaaagcuguguccccuccuggcaggacagucugccccggcuagccaccucauccguguagaaggcaacaaccucgcccaguacguggaugacccugucaccggaaggcagagugugguugugccguaugaacccccacagguaggcgggguccaggcugggauacaaagccaaccuuacagggugggguucccugggccucugcucugaccucagccugccucucaggccuuuuccugacaguucauuucacugugggcagcgagcuugggccugugcucaagccaacuuuagcucucugucucucugucugucucucgucugucugucucugucucugucugucucucgucugucugucugucugucugucugucugucucugucucucucugucucugucucucucucgccucagcuauauagcgagguauaguuauaugaccuccaaccuuucaacccugcccucccuggagggucuaaucuucaaucuucuugcuuguuucucucaaguacagucuucuagacauggaagaaagaguucccagacaucucaggcuccauuugcagggacaaaagcaagccagcaagcauggggugguggguagagggugggcaauuccauguguggggggguagugaucaugaaaggccuccuagaccaggcugggggaaucacagaggacgccuacaggagauuggagccguggaacacaggcucaggagaguagggaagacagagaugaucggucagccuuaagagggccugugugcagagccucgggagaguggugccagcuggauggaggguacaguggaggugaccagacaugcugcacacugaggugcaggguggauacggagguucaggcuggaggcgaagggcucagaccacaggugagggcucuaagggagggaaccaggcuggagguggugguugccaaaaguagacaagugaaggaagacuggaggaggcagcuguccacuuugacaccagaagaguguguggucaccuucuagaucugauaugagccccaguuggggccaaaggcaaggugaagggacuucaguacugaugugggagguaucagggcggagacucaggaggacugggguuaggucucaucucugacccauccucuaccaagcccugggguccugugaggcagcuuugaaugucagugggacagggccccauauacacacagacacacacagacagacauacacauagacacagauucacacacacagacauacacagagacacacagagacauacacaccuacacacacacagacacacacacacagacaaacacacacacacacagacacaaacugagaaacacauggacaaacacagagaccccacccacccacaccacacacacagaaacaggcagagacacacagaacacagaaacacacacacacacauacacacagacacacacacacacacagacacacagacacacagacacacacaccccacaagcauccuccccucucaucagaaaaagccucaccagcucaggcaugagacacaacguagguuucucuugcccucuagugguuggcagguguaaguucugugaaggacugggguuuauggcguuuguacccuaaccuuugaaacuccuuucuggggauggagucccuuucauuccucugcccagaugaguccacaguacucaucacacacuugacacaaaggcucacacacacccacucacauacagcccugacauuugaccucugccuguguuaaggaagaugacugcagcaagcacaccacaaacucuguaccuccccuaagagcugaaaccaagacugagcucucagcccagagccagcacagggcugugacggcacagauggaucggugggagggcgggcaaucucacgugaguguagauggcugaauggaugggugagugaguggauggguggguagguaggugggugauagucaggcaccacugggggugggcaggagagcaggugagcaggaguguaaguggguguauggguaggcaagugagcagguguguggauguaugugucaauggaugagagguugaccggcaagugagugggguagguggauacguggguguguagacaggcgugugagcagauggauggauguguagacaggcgugugagcggauggaugguuugguggaugguagguggauaaguggcgagauggauggauaagugcaaagauggggugguuggguagauagauggguagaugaccgugaaccauacugcagcgucccuaugccuccucagaaccagggccagagguggcagcuacaaguccuuuucuuagaaggugggcccugcaugcugacugauacuaagcccuuccccugucuccccuguggacaggugggaacagaauuuaccaccauccuguacaacuucauguguaacagcagcuguguggggggcaugaaucggaggcccauccuugucaucaucacccuggagacccgggagugagucugccguggaaggaugguagagguggggccgugggggggcaugucauggacacagggagggcuugcucuccucggugggcauucagcuucaaggccagucacgaggggucugcgggaguugggcagggucaagaguggucucuugagcucacagccacgcugugccgacccaacaguggacagguccugggccgccggucuuucgagggucgcaucugugccuguccuggccgugaccgcaaagcugaugaagaccauuaccgggagcaacaggcucugaaugaaaguaccaccaaaaauggagcugccagcaaacguggugaguggggcucugggucaggguaugggcggaggguggaguuggaugcaccugaguguggggaguaccugcuccaaaggugccaagcauagcuucauccaaagauggaucugggucugaauggcugaggcugggaagccucuccaggcgggacagggcgaauguggcccaagacaucucacuugucuaugcucugaggcuaggagcaugugggacccugguccagcuccuuccagccuagguuugcccugugugcacaccacacccauggcagguguucaccugggcaucucagucuuugcucucuggcucauuuaucuuucccgaccugccuucuagcauucaagcagagccccccugccaucccugcccuggguaccaacgugaagaagagacgccacggggacgaggacauguucuacaugcacgugagugggcugggagggcaggucuguguguucccaucacccaagaucccaggcuggggaaguacagaugucaccagagaugggcaaggguggcaugcugacaccugaggauugaaacuguggcccugaaggaggugggguucaaaggaggcucuguuuagagucagacccugaacucacugagugugaacaugccagccaagucagcugugcaucaaggagaccuaagggcacccuuuauaauggagacccccaggguggaguuucaguaggaacccaugauccuauaggguucagccuguguuuaaauccaugguccuauaggguucagccuguguuuaaauccaugguccuauaggguauagccuauguuuaaauccaugguccuauaggguacagccuguguuuaaauccaugguccuauaagguauagccuauguuuaaauccauggaccuaugggguauagccuauguuuaaauccaugguccuauaggguauagcuuguguuuaaauccauggaccuauaggguauagcuuguguuuaaauccaugguccuauaggguauagcuuguguuuaaauccaugguccuauaggguauagccuguguuuaaauccaugguccuauaggguacagccuguguuuaaauccaugguccuauaagguauagccuauguuuaaauccauggaccuaugggguauagccuauguuuaaauccaugguccuauaggguauagcuuguguuuaacuccauggaccuauaggguauagcuuguguuuaaauccaugguccuauaggguauagccuguguuuaaauccaugguuguauaggguauagccuguguuuaaaucaauaguucuauaggguaucagccuacauggcucgaugugacugugguaccaaucccagugguaagaucauggugcacuccgaaagagugcuauuuccuugccugugaguccuccuuuaagacuuagagcuguuauaacuuagagccucuuagcagggaagaauaaacauggucucugaaccccgagggacccacuucuaaaccugccccugggaagaggaaagccagaguauccugagcguugggguacggggaaacuccaagagcagaucaacacuuugccauagccuggaguccuccugaggcuacggccauccccgucccaccagggguuuggggccaguggaaucucccagguaccugggccgagacucuguuuuucugugcccaggugcgaggccgggagaacuuugagaucuugaugaaagucaaggagagccuagaacugauggagcuugugccccagccuuugguugacuccuaucgacagcagcagcagcagcagcuccuacagaggccgugagugaaccccaccaucuguauggggaaguagggauauucugacccagcagggagagggccaggagcacaggagguaugguacccuggacuggacuggacuguaagaucagcacagcucagcuggcaccuucuccuccaggaagccuucugggacuuagccugcccugagauccugggucccuguguucagcacaccccugccucccacacaagggccuuggaaauguggauggggaagggacuggaagggcuguauuugcugaagcuggugagguguuagcuuucuuccuaacucucugagaggcagggucuacaucuaccugcaucccaggguguccacagagguaccacgugggggaggaguugcuuuuaccucuugcgaaugcgcacuguugcuuuccaagcaggagucaccugcagccuccauccuaugggcccgugcucuccccaaugaacaagguacacgguggugucaacaaacugcccuccgucaaccagcuggugggccagccucccccgcacagcucagcagcugggcccaaccuggggcccaugggugagucccuggagcauuggaggccucaugugggucauagagacccaagggagggccuggguggauuuaccgagaucacaaacaggauggcgggggaccuuugauggccaccucuuccugcagcuccagccugcaggagggcaauggcuauggaggcguucauuccaaucccaggaguucuaugccugggagguugcaaaggugguagaguuaagaacucaugccugccacaggaucuugaagaagaucccuagccucaguuuccccaucaguaaaauggcaacaccaaauccccucuucucagggguuacaggacaugagaccucauugagaggcagcuguagggaacccuuacaaugcuguaccacacugccaggcuagaccacagccugggacauaccccacuauguguggggcuugcucucagguucccugaccacucuuuugcccaggcuccgggaugcucaacagccacggccacagcaugccggccaauggugagaugaauggaggccacagcucccagaccaugguuucgggaucccacugcaccccgccaccccccuaucaugcagaccccagccucgucaggugugugggucgcggcuggaucuggguuugugguucacccuccaccccucaccccaugccucccacuaacugugcgguuccugcuggagggagcagccuugcauguggcucugucugacccuguuuuaauugcuuggcuggccugagggaagacaggccuaucagggcucgucagcagaugcugagaaaggcacuagaugguuaggcacugagggugggggugggguuuggagggguuuggggggcauccucuuggagacagggggaugaggaaugagaugagcagcugugggaggucagaccaggagagguggguaaugauuggacuguaaaaauauaaaaguaacauacacacacacguauauauguguauguguauguguauguguauguguauguguauguguauguguauauacacacauacacauauacacacauguacauauauacauauauauguguacauauauauauacacacauauauguacauauauauguaacaaaaauuaaaauaaaauaaauaauaaaauaaagaaauaaaaaagaaaaccugcccugagggagggaccagcaguuuugcccacuguaacaggcaguucccuccacgucagggccacuccugugagacccgagugcacagccaguugaugcuacuuucucaaacucucucugcaguuuuuugacaggguugggguguccaaacugcaucgagugcuucacuucccaaggguugcagagcaucuaccaccugcagaaccuuaccaucgagguaaaugucccaggucuuuccaaagggacggaggaccugucuggaggcacagugcacugacuagggugacuaguggggaaacucccagagacucccaccagcaaucagauucuguucugaagucagcaggauucgguaaugugaaggagacuggguagacaaucacaugucccgguccccggcaguuaccuggagagcuuucucucuuguuagagccuccugguggcccagccaggcuaccuuugauuucuuaggcaggguuguuuccaggacccaaugugugagaaguguagaagcuaaggggggaacagaccuagaaagaaugaaugggucuccacauccagccuacacgugagacacagaacauucuggguugaaagugggauagaaaucuucuggaaggcccugcauccuguuacagccuagccacacagacugccuugauguauccaugagacauggguccagugugcaacagcucagccccuccugccccagggcccagugugcaacagcucagccccuccugccccagggcccagugugcaucagcucagccccuccugccccagggcccagggugcaacagcucagccccuccugccccagggcccagggugcaacagcucagccccuccugccccagggcccagagugcaacagcucagccccuccugccaugccucccaaaacuguuuucuagacucucacccaggcuaagaggccauauuugucaccuacccaggaacucaggcuggacacaaauauuuauaagagguuguggggcuagagucuaacaccugcauuuaugggaccacugaccacuaccuuucccauccuugagucauacauuaacccuugucucaccagagcuugaagcuaaaggaugugccuggaguuagcugccaauuaauggcuuccaagggacaccuguggccaagagaugcauggguggucuccuaggucuccauugcuguucucgcuguguccaggccucaggcugaugagcaggcccucgucacuguccccucugucaccuacacaugucaucuagcuguccuagacaauuaugugacuagacauucugugcaggugacccugaugcugucccuacccugucacccacacagucaaggucugauaagucagcugcccccucagacagaggcuuccuagcagguaggacacccuugcaggugugagggacacacaacucuguagcuucccucuuguaacccaaaggugcccaucgcucuugcaggaccuuggggcucugaaggucccugaccaguaccguaugaccaucuggaggggccuacaggaccugaagcagagccaugacugcggccagcaacugcuacgcuccagcagcaacgcggccaccaucuccaucggcggcucuggcgagcugcagcggcagcgggucauggaagccgugcauuuccgugugcgccacaccaucacgauccccaaccguggaggcgcaggugcggugacaggucccgacgagugggcggacuuuggcuuugaccugccugacugcaagucccguaagcagcccaucaaagaggaguucacagagacagagagccacugaggaacguaccuucuucuccuguccuuccucugugagaaacugcucuuggaagugggaccuguuggcugugcccacagaaaccagcaaggaccuucugccggaugccauuccugaagggaagucgcucaugaacuaacucccucuuggaaacuucuggaacugcccuuagcuacauauacacaagggcagguggugagccaagugcugagacagggagcugucccuuuguggguggguaugcagcacccauuugcuucucccguucucuauugaggacucugccaccuccaggacagagcagcauccuucacuugcucacccucugccacaaaguauuccaacaucuucuguuccugcuaaccaugcacagcccagccucugugucaucagcgcuuacguacaggucgauuccacugugucuugaaagugaauucagggccagagacaucuucugcaggauguguggacagaucugucccuaauguaggucauucugccguuaccccuugucucccgagucuugauugcuggggucagggaagacuguggcagagcaggggaagccgcuggcccuccgccucuagccagcacccugaacaugcuggcuguagcagccucuagggaccucucuggucagacaaagggacagaaugagucucagacuaccgaaaauugaauugucaauauuugauaaaagguuacucuuucuacuugguggggucagcuugcuuuuuccccccucucugacucucucagcauuccuuucugagaucagccuaguguguccacacguacuucucaacaagucuaaaacgccgagcaucaauccaggaaggguccuuaccuguuaccaggaugguuggaagggaaagagacucagagagagcauagccgugggagugcaggucagacagaccccagcugugaggaacaucuguucucacuaagugcucagagucugggcucugugccugagugcuagcccauccucguggccuggaacuggaguggcugcugggggcccuggucuucaugauucauccccaaagagucaguggcuagagaaacagcuccugcaugcauucagccaauggggcccuguaccugccagaagcuuugugaacuucugcaaugagagcccccagcagucccugccaggaguggagaagcacagaggagccccugccaacaguaaagcccaacaucugccgagucacuuuggagccauccucuuuaggcuuggcuuucauuagcaaggcccaacagaggcagugacguccgugggauagccucagagucagcacuaccagggcuggcgucauaucagggcugccuccucgaagcccagggacaauguugccaaucuuagcaaucuuagcaagcucugcaaacuuaggugguuaccacccaugcuaugcuucaugaaucucugaggggcaggauuugggugcacuuaggguaggugcaggcaucacauugucagagaccagugcugaccauacaggccuuuccaacuugacagauguugacagcuuaggcucugggggggugggggguuccugcacccagaugggccguuaacagcugcagcaucaggcuugcuucuuggguguagguuguggcccucccagugagugguaacacacuucacaaagccugagguugacuacacacuucuuguugcugcucagaugaggaagcugaggcuagacagacugagugcccugccucgggcaucagcucauugcagaaguggguguucacuccugagguacaugcugccccaugcuaccucagaaacuaggcagcacauucucacuccuaggccugugaaccccacugagaugcgcuugcguucugggaucucacauaaguaugucucaggcauuguccaggagggaccauccuaagcgccccaccacaugcuccugggaaggaggagugguuaggaggagugguugucaccaggcaucugaggagggaagagccccccuccagcaaggacccagggcuugugucucccuagacccugccucaagugccaaagcugucucgugagcuuccaggauccugacaggccuggagggaacugcaaagggccaucugccaggaaauaaacgucacagaggcaaugcuugcagugccugagaagcucuccaggaaccagccuuugggucugaaccaaacuuuguucuacaaaacacagaaagcaagagaaagcaaaucuuccagccaccaacuuucccaggagcacuggaguacuaguuuggaaacaaguuugggggugcccuggaagacaucuguugagcaagggcagguugagcagggcuguaaaagcaggccacuccagccucagucuguauggucccauccagcuuugugcauccaauuaacagcagcucccaugucccuuccuggccuugcuuaccgugccugacagcucuaccuugggcugcuuugagcuugugaguucgcagaaccagcaccccuacgcaagaauccugcaagggucaaaaguugccacuuaguugcauuucagaugggagacaaaaaccaaaacuaaauuguccauguuucaaugugaugaaaugcuucuccaagcaguauugauggauacagucuagugacucuauuaacuguuuugggugaugucauuuuagaaaaauguguuauuuuuuuuagcuguguuucggugggaauuuuuguuuuuguaauauaauaaaaaucacauguucccaugguugacuauuguaacuaacccaucccccaggcuugagaggagcaucaugggaaugcuuagagcaagcacaggcaggaagccuguggccccauacuggcucaggggcacccacuggacuuuugcaucagcccugcaauaaugcauguguccuguggacaucacagacaccauacgugcuguguaguuggcaugcuaaccuucucagcaggauguagggaggaacacuuggucuccacucgcucuccgcucaagucuccaugugcuucuaagauuucuuguuucucagccuguggacaugucuuagcaaaaagugagacgcuaaaaaauccacucaguuuugagggaggcccuaggcugcuaagaguuggacgaaguuuagaacaagauaagaaaggcugagguaagaucuggagaggggccggcauuccuccucaccucccacagcugccagugcaggagcaucaguccuggagucuccaugcugccugccuugcuaggugaagcaaggugaggcagggugaggaggcuagguaagaccaaguacgguggggugcuccggcaacaauguuucacacuggcucccucccgccucaucaguccccaggguccacaguggagggcugaaggagauacacuguauuucucaaucuucccugugagugaucuaaugccuuuggagcuggcaagagauccagcucccauaccauugggauucucaacuuacugugccaaacuaccgcagagcgugagggccccagaauuuggguuaaaacuccuagcacugugugcuuugucugucauaagccuaguagaaaggguuuaauaugaucaggagauccaaugccugggugaauuuuuaaucaggucugaggcuaugccaucucaggucaucucagggguccaccuaagaguuccucucucgcuuguugguucccugaaggccucauagaaggguuuagcugaacuacauagaguccaaauucaccuauugugcccacaagggccucugcuuauugucuucuggaugggguccccaugguuaaaaugagauccuuucugugugacucauggccccaagaccuggacccuuugugaagagauuugagccucugaaagagagaacccuuuuaucuauaaaaggccugcuucuauagaguuaggaugaagucuaaaugauggauguauggaggaggcuauccccaaggugaaauuugggugugugacacuucccuugcuagggucuguccauaaaggcaggggcuaaaaaccccgaggaaugauggucuccaggagcaauguuggggagagaggucccaccauaacaggaaaauaggaaccuagaauugggccuggcaggaauaugaaagaaagccucucuuuagaucugacaccauacccuaggagguguuggcaggcaucugccccaagaggguauaagaguugggacauaaacugcaaauggaaagccucauuuaugguccucggguccuguaccaucugguccuguagguccaccugacuuccuuacugaugagguacaggugugucauggaguguuacaggauauagaaacccacuaaccaggaaccugcagagagagacaaggacauuggggacuuucaagaaauuuguccuuaagagccccuuggugagcauccaggaauggagguauuucagaagucaaaggaaacuugcccggugaaguagaggucuguggggaagguacuugaguccuugauggcuccaggccauuacaggacuggggacucaaaaaaugucaggagagccuccagacuaucaaaaagcuuuaucuggacuugauauuuagauaagaugcccuaccuaggaagagaacggagaaguuagaccagaaaggaaugaacagaaagacuguccuaccaguuaagauggguguaaguaagguugguuaggguuugccaucaguaucugugaggagagcugggaacuagauaaaccagaaauggccaggguugaaaagucacucugugucaauaagaauuguaacauccaucuccucagaaacagagauggugaacacuggagucuauguagccuuggguuucccucagcccucagagagggugacucuuccucacugggaugcucauacuccaggaacaaagucaggguugccugcgugcuuucaguguugaugaccuugggugaaggcuggcuguuguacaggacuguccucugaggcaaaaugccaccaucuucaggaauccagcugagcuugcuuaccaaagacccucccaucugggcuuguugacuguuuguaggguauguggacaugcuaccagauaggcauaagaaccugugaagugggguuugcucaaacccccaaaaucucaaagaucugagauggcaggaguggggcuauuuccucccugccuuuaaugucugcuuuggaaccaugacccccaacagaggugaccacaggcacucacuucuguagcccagcaccugagacgccuucccaggcuaaugaggcgucucaauagccccagccuucagccaaugaccuucccuuccugaguauccucacacccuuccccaaaaauauauaaucccugguucaccccaaacaaaagguauacauccaaauccacucccaauaaugaaauaugaauaagaaaagaaggggcuggugagauggcucaguggguaagagcacccgacugcucuuccaaaggucaggaguucaaaucccagcaaccacaugguggcucacaaccaucuguaacaagaucugacgcccucuucuggagugucugaagacagcuacaguguacuuacauauaauaaauaaaucuuuaaaaaaaaaaaaaaaaaaaaaaaagaaaagaaaagaaggccucagagagcugcuucauuaaagauggccccggggaaggccuucuccccuaugcacuccacacuggcucccaaugggacggggauccugucagucuugggcucugcuucccccuucuggucuggugugcaauggcgcucugauaccccaaagggaaagguggacuggugacuccucauccugcuuugcuuuguccucccugagccaguguguauggacagcagcauccagacaccaccagaggagaggcagaacucgagaccacaaccauuggccauccuucuuagauggaaggguagggaguaucaugaagcccucaccucaauauccagcuacaucaccacucccaaccaguuguaugaauucugcucuaauugcacauggucuuggggcgggggggaucucugggaagaauuagagcauacagcagggcuucauguacacagccacagggaagccaccacccugcagccaccuuccaguguggcugcuuucaggucuccugugucccugcccagggccccacagccauugcucuguaagaaagcuuugcuggacucucaccuugguuugugguugggaccuuaggaggaguagaugucguucaugucccccucugggaagaaacuuuagccacccaggcuuucucucgggagaggaggaggggcauuuccacuuccuauguguccugacguugcagucuggauguggagcgaggagaugcuugugcccugguugcuugaggcaaugacagcugaaggauucuggcugaccacauuagcugggaaagagucaucuggaggaggcucgguuacuucucugagccuggaccagguggccaucagauggagugguaggauuuccuaauggguggggaugaggcccuagcugccgcugcaggcugagcuugccacauugucucuuuucuuccucgguuuggccuuucugacccuccagaucucuuccuucuuaugaaagccuuuggacaaugcaccugaugaaagaggaagaaaucuggaggccccgggcuaguuuugaagcuuuucuuccacuccugugaguagaugaugauaggugggucccugacuagggacaaagagaacucugccccaucaaaagccccuuccuaugggcuagggggaggucaccaaggccuagacccuaggccuccuggguagguggugguuugaggcuuaaugaaggcuauguggccuccagcuauccccagccuauccuaccuagcucacaagacucaaaucaggugacaaaaauccagaaauggggaaaguuggagugggguggggagaauaacauuugaggaacagguccuuagccagggccaaggcuauucaauagggggugggacucuugucccucagaggcaaguucuggccuguucaggugcaccugcccccagguaacugucauuuccacuuuggagucccuucucuggaccuauaaucucucugcuggugaugugucuccucccagggggacugccucgauccauagacagcucuuccuaccaauuuauaccuuugaaaaaaauuagcuuugcagcaaagacaacagaaauagacucuuuagggaucugauauuccaaccaaucuuuacuaaugagauucuugaaacacccaggcugcuguucuggggugaggaacuagugccugggucugggagcugguguaccauuaaggcucacacacccacaguggcuauucuuaccucagagugccuggggagaauuuggcaagcaguaguaaagacucaagacaacaaggagugccugccaccagggacuguugcuucauuagacgaaaucuccggugcuaccuggcuguguuuaagccaguuccacacauagcucauuaauugucccuugaaauaacaaggcugggguucugauucauuuauuaagcuuagaugucugucccaagauaaagccuucuauaacagcaaucgauugagcuucuguaucaacugucacuuuguauuucugcaacccagcuggaagucugaguguugucaugaccgcaaguuuguaguuaggcuaaauuuaaaagaccagaguagggcuggugagauggcucaguggauaagagcacugacugcucuuccaaagguccugaguucaaaucccagcaaccacaugguggcucacaaccacccauaaugagaucugaugcccucuucuggugucugaagacagcgacaguguacuuauguauaacaauaaauaucuaaaaaaaaaaaacuuaaaaaaaaaaaaaaaagaccagaguacaccggaggucagacaauacgugaauuuguacuuuaugcuguguaacuguuuugacuucaugaauguauauucagcauauaugcauaucuggugcgguagaggucaaagggcagguuugaaucucauauagauggaguugugguaagcucuguauggcccucagacccacagcauggccuccagacauaccucauaccaugugggugcugggaaccaaaacucaaguccucugcucuuuuuuuguuuuuguuuuuguuuuuguuuuguuuuguuuuuuugagacaggguuucucugugcagucuuggcuguccuggaacucacucuguagaccaggcuggccucgaacucagaaauccaccugccucugccuuccaagugcugggauuaaaggugugcgucacucaagcagagcuauagagugagaccaggcguuaaaaaaaaaaagaauuuguuuuauuuaauuguguguguguguguuagucuguuugugugaguguguguguggugugugugugugcaugugccuguaugugugugugugaaugugccuguauguguguguguaugugugcauguguguauauguguguguaugugugugaguguguguguaugugaauguauguguauguguguguguauaugugugugccuguaugugcguguauguguaugagugucuguauguguguauguguguguguaugugugugccuguaugugcguguauguguaugaguguguguguguauguguguguauguguaugaguguguguaugugugugccuguauguauguguaugaguguguguguauguguguguaugugcaugaguguguguauguguguauauguguauaagugugugugugcgcguguauguguaugugugugcaugugccuguauguguguguguauguguguauauguguguguaugugugugcaugugccuguauguguguguguauguguguauauguguguguauguauaugagugugugugugcauguguauguuugugcaugugccuguauguguguguauguguauauauguguguguauguguaugagugugugugugugugugugugugcaugcacacagauucccauggagggcagaagagggcuugugaccucugcaagaguagcagugcauacucuuuaugacugagccaucgcuccaguccacaucgugugucuuucaaauggcaggguuuguuccuaagccugcuaccacagcacagagcuguccucagaaauccuuagaagcuguguugaaaaauuacagaauaagcacccagagaggagccagcagggugagacuucccuugguuuccagagauagauaacauuacccguuucauuuuccuuuuuuuuuugaaauaauugaucacaagucagauggaauguggggcacacgccaugggccucacagcucuucucucucucucucucccccuucagcccucccucagucaccuuuguccccacccccccccacccucggacaguuucacaucuaccuuaaugucauaaagacauacaugauuugucgugucuauguaaaugaaggaagauggugucugucuuucugagacugguuucauucacuaaauaguuaucuccaccuuuauccauuuuccugaagacacuaaguauuguuuauggcaaaaaaaaaaaaaacaaacaaaaaacaaaaaaaaccaaaaaacccacaggaaugucuaucacguuucauuugccauacauucauugccagaagccuucauugguucuauaucacggucacuguaaauuacagugaguuccauuucuuauuaaaaucuaccccaaaaauuaaacaaaaaaagaucuauucuguaauuuguuuguuuguuuguuuugagacaggguuucucuguauagcccuggcuguccuagaacucacucuguagaccaggcuggccucgaacucagagaucugccugucucugccucccaagugcuggaauuaaagaugugcaccaccacugcucagcucuauucuguaauuuuuaacauuuguaaagcauuuugggguccuuaaaauugucuugggagguauucuaauuuuauuucuguugcugugguaaaaaaaaaaaaaaaaaaaaaaaaccacaaucaaaagcagccugggaaggacagggauuguuuucaucugcaggucauaucugucucugaguuaugaaguuauaaagugaacugaagcaacccugga

SEQ ID NO: 9 - RNA, 92750 nt, Mus musculus
gacaaguucucaccacugaacuaaaccccuaccucuuuuacuuuuuuuuuucuuucucauuaagucuugcuuaauucgccagcugcccucuccuugccucagacuuccaggugccuagaacugcaucuaugauugcaccacaguagccucuaaccacauuguuugcauguggcuaucuuaucuucucagcaucacuugaugggggcuuucuuucaccaccaaauggcuucugggaucuuucaaaaacagucaguuguuuagaggguaagggccugugcagaggguaaggaaagauaauguuuguguguggaggggucuggucaagguacacuauacaaacuuagcaagaaucauaaugaagcccauuauuuuauauaacaaauacacacuacuaagaaaaucaguugaucgccuacaguguauuuaaauaugaauuuauaucuuuagguauaucuggaucauuuuaaaacaucaaccuuccuggccgggcgugguggcgcacgccuuuaguuccagcacuugggaggcagaggcaggcgaauuucugaguuugaggccagccugcucuacagagugaguuccaggacagccagggcuacacagagaaacccugucuugaaaaaaacaacaacaaaacaaacaaaaaacaaacaaaaacccaucaaccuuccagaacuagggaagcucaguugacauauugcuugccuagcacacacaaagcuccggguucaauuccaagugccacauagaccaggcguggugguacacaccugugauccuagaacuaggaaacuggcggcugggcaucagaugaaggucauacuuggcuacaucgcuagcuuaagaccagccuguaguacauaagauugcucuuaagaaggaaaucaaucugcaaaguucaguugugacugucauucuuuaacccauuuaccuugagcgucauuucugguaagacagacgucacuuugaccauuugcuaacuguuauacaugucaaaguuuuucgguccccuguuuccucauucuugccuuucgcguuuuuuuuuuuucuuucagugaauaauuuaaguuacuuccuuuucuguacauucuacacauacacaauacacacacagagacaucacacauaccuguacucauaccccucacacucagagacaacacacacauguacacacacauacacacauacacagacugcacaaagacacaaacacacacacaacacagggaacauagacacacaaacacauacaaaacacacacacaaacucacaaaacccacacacaugcagacacuccucucuccuuucuaugugcauuucucuguacuggggguugaacccaugucuucccaggugcuucugagcaucucccgauagcacccugcuucuaaauucacacugauaccaacugacaaauguuucugucuucuuuugacuuacugacgucauugcuacgaacacgugaugaaauuuuucguugucaacuugguggcauuuggaauaacccaaaggacacacucuaaggugugucugugagaucacacacaagagagguuuaacagaggagggaacacccaucuugaaugugguucacuuuaugcuauuggagguccuggacugcauaaugaagacaaacucauuggggaaccagcagucaccucuuuuccugacuuggcugccacaugaccagccaccuuguaccccugcuaccaacacccucucccccaccccacccugaugaaccuuauccucaaacccugagccagacugaaccugccuucucaaaagagcuucugaaagggcuuuucugagcaaugaguaaagucacugagacaguucucaacaguauggauuaguuauuuaucuuuuaacucauuuaccuuuaaaucuuugacuacaaaucaaaacuacaaagcacuggcuuucauagucacccaucacgacagaaguggcuuuucuauuaaccucgauucucacccucauugaagacaaugugucaaggggauucagacuccuguugucugucuugaccaggacuacucuucagcaucccuuggcagucaggccuaaugauauguaaacucccucagcuuuuauuuuucugagacugucuuaauugcucuguguugucuaguggauaguuuuguuagauacagacuuugaauugacagcuuuuuguuuucaaguugggacaguuaagaagaaaaugacagagaggacuuccauuguuuggaucugauuuuuagugacaaucucaccuaucgagaacucaaaaaugaacagauggcuuggccaccuuuacguugguccuucugaauguucuucgugcuugcuuaugucuucacuacaagccuuucuuucugugccuuucaugcuggggugugacagagggcaaaguauucaaagauuuagauaucucuuuaaaaggagacaaccaaggagacguaaaaggagacaucugaaccuaguauaaaguaugagaguacuuugguagauggagauuguacaccauguuugugaaagaauuugggggccuuaagagcaccuuuguguauuugcaagaacuaaauauuuaggaucaaugcacugaccaguaaagugacuguauuaguagugucauuaaauaucaucccuauauuuauacucugucccauaguuuuauaugcuuugcccacucugauuuagggcucugcuaauugacuugcuacuaagucagauacuagcaaaugugucacaaguagugacuugagagauuuacacguugaauauuuuaguuacucucaucucugccauaccaugagaacacauccugccagccuaauccagacagggaagaaauucggcauugcccccaucuaagaugaggcuguccuacaugugucaauguacggaguugucauccaacacaaagcagaagaggaaauccagcugauauuagaagcaucucccauuaaaauggaugacucacaaagaccuucacaaaguucuuuaaaucagcuaagauucagaauggcuuuuuucacaucucaaugauggcagcagauaacuguguaucugugaagaaagaagcuacgcaguauguccucugcuucauuuuaaauuuuaaguauucggaacuucucacggaguagacuugacaagcuugugagucauucugauauaaagaguggacaugauugauuuucuuucucacucggaaagcucuuaagagucuaauccauggcucucaucuaucaagaugaagcaccaguaggcguuguuaugucucaguaggagcugcaugcacaauaaguggagacuucucucucuuaauggccauaacggucucaacauucagacaucugaacacacaccaaaaaaaaaaaaaaaggcauaauugucagcgaacaucacaacgagagauuaccagaggucagcgggguuauaacucguguuuauuuuuccauguguuuauugcuccggaggucugcuugagacagacuguguuauacauucaccugaagaagaccccuggacuuccuaucuauauccaugcuagaaccuuugaccuaggcaacaugauggcuagcuaauauuuagccaucugcuauagcgcaaugagguuaguuucagaagacugacaaaaaaaauuauuuuuacagguggcauugaaaacucccaagauggcacauuuacuuuucuugucccuagaaagauuucauauuucugauaagaaauaaaaaugcucaaaauuaaaaaaaagucuugcauguauccuugaugucuucaccaacacagaaaaagaaccaaaaaauacacuaagaccaugauuuuggaaguucucuugaguccuccauucccuaauucacaugauguauaauucaucagaaaauuccagcaguucuauguucaaacuauuuuuuucaaugacaaacaugucuauuccuucaacauccucagcacaaaaacgagcugcuccucugcccugacaucagcuucuuguccuuucaccccgcugugacauuuuggucacaauguuauuuuugcucuuuuuuuaaaacuaacuugguauauucaugugugccacaguguacccgaggggagccagaggaagccucucaguaaauggcucucuccuccugcucuucgugaugccagaaaccaaacagcccuccaggcccaagagcaggauccuucacuugcugagucauguugccagccucuaacaguguuguuuuuaagaaguuaacacauuaucuguuuagucaucaaaaccagggauuuaugauggacugaauucuauuaucugacagguaggccuuauuuuuaauuuauaaauugucccaguuagguacuuguucugauucagaauucaguuagagauuacaaucacaaggaccaugucuccacugucuucauuaaucuggaauuccugucuuggcagcgaugagcucagaaguugggaaggacaggacuggucgucguauuauaugucuuuaaguuuaauaguaucauauuuccucuaguuuagucucaggcaggcauuuugccauacaaaccacaguaccuucacuguacagcagucugugggacacugauuuuuaaccaacuguuuaaaguuagcaugaauaauaguggacaugauacauucgccccuugauggggcauguugaaaauggugguucacauucauaauacccaaaagagggaagcaagccgcauauuuacaauuaggagaaggaagagaaagaaagguaaaggaagaaagacugacucauuagaacaaguaccaacaaugaacauaauuuuuaucaguccaucucuaugugauuuagaauguaaagcgguauuauucguauuaucugggggcucagaaauggguuaauuuucuccauugauuaaagaauuaaaaggcagaaaaaaauuuugaaagucaagcaaagcuuaaguauauucugagaggaaacaaaaaucaaguuuaaaagccaggccccagggcagggaagcuguaagucucugaggcugcccggaggaggaggaggaggaggaggagagcagagaagaauagggaaaagguguugcuguuuggguuaaggcagcauagaggucagccacuuacaggacgaaaagccacauaguggcuuuagaggaagguuacacacccguccccccguaaccccccccacacacacccccaaaauacguagguucuggccaucaucagaaaggagaagaaggaggcuaagccagggcucugagagguggacagacccaagcaaagcacauggaauuagcucagggcugugcuacggguggacauuuggggaagaaaaggaaugcgaucucaucaaacuuuaaguauuuuaauugaaaguauuuuaauuuuuagaacuauuccaauuuaaaaucacuuaauaaugaucccuguaaugacuagaaggaucauuuuuuccaccuuaucuccucaacgugacuuaaggacagucagcuuuucuacgggguggugcucaggugacugucagaugggcccuaccuacugugucagcuuuuuaguauuuggauagcuuggaauguuaaaucucucccaccccagacagagauuucauccucuuaagaaacaguuaguuuuccuuuaacuggccuuuccuggcaggcuguguuguuaccuuuuggaaaacauucaccaggcacgugcauccuauuuucuuggagaacuagaauagcacuauuuggcugaacaacacccugaaaugggcacacggagaacagggcgucgauaggcucccccugagucaaugaccuccucggccaucaggcccuauccacagcaaggcaccuccucucugcucugaacuuaacauucgaauccccacuugccugcuguucuugguuuucugagaagaaccucagguucacaaugcagaagauagaacucacauuuauucccucagcccuguuuacugcccugugucaucugucagaacuggaccuuuccuguuccauaccacauuuuccaaacuacauguguaccaguguugcugcccuguacuuccuaaguagcucuugagucccccaacacucuuggacauagaugaugcuauuauuucuccauguagaauaauaauguucuauucacucccacccaccccacugcucuccuuacuauucuuagauugcuuggacagggaugcaaaaugugauaucaacaccuuuaaaacucuucaggcuuuauguuucugccccuaaguucacacaaaacucagucccagagaccucaugggucugcaccacaccucgccagcaccccuugcuuguucuucacacuagcaacacuggauucucugacagaacccaaugccucucuucaucaagaggcucugaaggccuauucacggcaccaggaacuccuucacagaagccucuccuuccuugcacagcagauggggagcuccugagacaaccauguuccauagaaccaauuacuuucccacauauggggucaucguggcugcacuuuggccuuuaugcguauggcuacucaauuagccuuuccuacaagaauguacagcaacacgaggaguguugguguccagucagggucaccaccggaucucuagaacacugacuccgauuaauuuauuggccauuaaaaaccaauaauaagcaaaugguaagcuuguucuagagaagcauacacucacauccauugugggauuuuuuuguuaaugucauccauccucuccauugggauggucaaacaugcaaauguuaguuuaagucauggggugggucagggucacauggcuucacgugcuuuagcuauacuugaagguauuggcuuaaauaguuucuaauuuucuaaguauucucuuagcucuaaacccagccuuaauccuucauuuaucaucaaggcagacuugcagaugugaaauuugccuguguguguguguguguguguguguauguguguguguguuucaaauucuuuuuaaaaauuuuuuuauuuauucauuuuacauccagaucacugucccccucacagucauucccucucucagucccucccucauccucccuuccuuucuccucugagugggugggggggguccccuggguauuucccacccuggcaagaugugauuuuuuuguuguuuguuuuuguuuuucaagacaggguuucucuguguagcccuggcuguccuggaacuuacucuguagaccaggcuggccucgaacucagaaaucugccugccucugccucccaagugcuggguuuaaaggcgugugccaccacaccuggcaagaugugacauuuuuaaugaacauucuaaccuagcuguuuuguagcuucuaguugucuuaguacauguggucccucuaaccacuguuaauaauuccuuuguuguucacugucaagucccaugaccagugugcauaaagaggcgauaguuucagaaacaauauccgagguuuggugggaacccguguuaagacagucaguguguucaaggaccauguuacuuuggccagucuuagagaaccauggacaugggaucggaggauugaugggaaaucucauaaccacagguacaucauugaaccaauuccuuaaaaagaauuaaucucuuauaugacuauaccugggaggauagaggauauaaauugucuugggauaucugggcucuaaauccaaguuuaaaucuccacauauaggacaccaguuuuaggacaaggcuuuauuguagccaacugaaaagguauuuauuuuauuuccucacuacaaggauacauagagaucuucaauuuauggaagcauauccauuuaaaaaaacaaaacacucaaaucaagggucauuaagguauuagcaaucaaagggaaacuucugggcuuuaccucucagaguuuuacaucagagggaugauugcuucugcagauggaucuuuagagaugaagguaguugacaauguguaaggcucuggacaauggucagggugaagaucaauguuaucuccagcugcauuuuccaaaucucuccauaauucuuuacaaaugagucauuuuacugacuccugauccacaauucuuugucaauuagccuacuugugcucauuuagugagcagaacacuuggauuuuacgaacaggacuaguaguuuaagccuuucucugggccacagccucaaccuuuagagucugaacaggcauucuuuccuuaggacaugggccuaauguaauaugcuuacaauugccagcuggucacugccaaggaagagcgaguggcaaugcacugguugucuuagaagaaaaagaggagcuggaaagauggcucggaugcuaagagcacugacugcucuuccagaggucccagcaaccacacgguggcuguaaugugaucagaugcccucuucuggugugucugaagacaaugacaguauacuaacauaaaauaaauaaaaucuugaagaagaaggaggagggggagaggagaucuagagcaccuuggcauauuacuguauauggcauauuacuguauaugacauauuaauguaauccugguccuucacaggcugaggcaggaggauugugagauccacacaggaaaauguuguauccaauuuuaaaaaaugaaauuaaagaaauagaaaccagcacacaccuauacaguaaguccuaggaaauccugacaagcucagggaggugccccaaugacaugauggggcauucccucuacugggaggcaaugugcuguaugcaauaaacagaagaauacuuuggauuuugaaaugccauuuaaauguaaauauuuugugugacaucugacuaacuaccagaucagccagaaauuugcccagaauagagaaagaaaaugguuuacagcuggucaauccucagguaaagcuguaagcgucugugaccacaaccauacuggcucuugacccauagcuucucggcucaucaccuuaaaaagauacaccucaaaaaucucagagggcucagauugaguugugucucaugacacauggcuucagaagaacaaaauacuaugauuuggucagaucagccuuucauuccuggcuagucccuggaaacaaguaagagucaaugugggauaucugccacuugggagaaauguuuccccaaaugaccagguauauuucuuugaaggcagcuaaaucugguugucagacugaacacuacaugccaacuaaacagcuaacauuaacaacuauagcaacugucuuaaugccuaaagaugcaggaucuggaaauuaaugguucaaaguaauaaggaauuauuugaaaaauauuacaugagcuuaccucaucuuuauaugacuuagcucacuuacuaauguuaauuuucuaauggucuucuguaagaagggccaggagcugguauccacaaugacccaacaguguuggagucauaaaacagaagaacauuggaugaagaagacaccaagccuggaccuugaacuuucccaugguaagacacugcagggcugguuuacagcccuauugguaacuguucucucucuguggaacagacccuggcuugcaaacauccaauuauaaagccaaguauacacccugggcugcccuacauaaacugggcguguucuauucucuguccaaacaaacaaacaaacaaacaaacaaacaaaaccacuaugcucacucuaaagcacucuauaaaauacaaugaaacaagaggcucuacagucugcaggaguuaaagcauuauuuaaaugggagaccaugaaagagcaucaagccuuggaccuaguacagacguuagugcuauuaucugcccuuaacugcucuauuaucccagccagugcucaggcccagcaauacagcaucaccagcuaguucacuuguaaacuuucgauggaacacaauucauaagaagcacuuaauaaaaaauccuguugacugaccccacuccuagcgacuaacaaauuucuaccacacaggaagcaaucaaauacauuucugaaagaaauuuuaccacacauuaggcuccauuaauauuuauuuuaaaguuuacuuuuuauuguaacaaauauaaagucguugaugucuuauaaauuuucaaaaaugcuuuaaguacaaaaaaaaugcauuaguaagugagagaugugucacgguauuugguucucaacacagugggcaugcguaaccgaugucaggaaagcucaugcauuauuggaagggaaaggggugagacacggcugcagcagugcugauuauaaacucauugcuucugucagcuuucuuucuucagggauaccauuuaccuguaaccgggaugacaacaugaacgugaguuaggcaggcuauggcacguuuagcucuugaacauaagacuuguuacaagacagacucucuuuuaaaaauguauacaauguuuauauaguauuauuacuaaauuuuguaguuaccauacaaaaaggaggugguaugucucaacacauguauaucuuggauuuugcucauauuuguauuuaucaccuuauuuauuuuaauucuccuuuccuuugguuuggucuaaacagacucacuucuguuuuaugcuguacauaagacauguacauguauguaucauaucauauguaucauauaggacacauacauauauauguaugucauauacucauauaugaaauuuagauugcaaggagaacuuuucuaccaucuuaguuuaaaauaauuauucugcauuauuuuucugugcuugguuuuaaaaggagaaagaaaggaagggauuaauauuaaauuaguacuccuuuuccugaaccuauuuuauauucucauaaagccugcaaacuucucucacaauaaacaagcagaaugagguugacugcgggauguaugacuguaccuuuuaaugguggcuucaaaacuaccacaugcguuggaagggcagagaggauggagaccaugaaagagcaucaagccuuggacuuaguacagacguuagugcuauuaucugcccuuaacugcucuauuaucccagccagugcucaggcccagcaauacagcaucaccagcuaguucacuuguaaacuuucgauggaaauuuaaaagaaaauagcuaacugcgccaaacaggcugcaaaucaacuuucagcugauaaaguccauauaggcagcuaagaauagaaugacuugcucuccaagaguugaccuguggguccccaugccccuucuaaauaaaaagcccauugcuguuucacaacaaucaugcacagaucauccccuccaccccgagcugagaugaagagggggacaagcagggcagcucaaagguacucuuaaaaacacacaaugggccuugcagaugcaacagaauaaacuggaagcucagaagauuuugcugaagggacccugguauagcugucucauaugaggcuaugccagugccuggcaaauacagaaguggaugcucacagucaucuauaagauggaacacagggcucccauuggagaagcucucuaguaaguacccaaggcgcugaaggggucugcaaccugauagguggaacaacaauaugaacuaaccaguacccccagagcuuguaucucuaccuguauauguagcagaagauggccuagucggccaucacugggaagagaggccccuugguuuugcaaacuuuauaugccucaguacaggggaacgccagggccaagaagugggaguagguggguagaggagcgggcggggggguggucuagggaacuuuugggauagcauuggaaauguauauaaagaaaauaucuaauaaaauaaauuaauuaaaaaaaacaauaucuuaauguaaaugacuagaggaggaauaaaggcugcaacuggcccucagcucccuccccaggaggccuaacaccuuuaaugcuuuaaauguuugggaggcagaaagaaccaucucuccuaguuagcacccagugcuaggguggucucgcucccuucugcacacagauccuugagaggcucacugagaaaacaguaacagcaaagcacccacgagaagauccuaccgucuggucuguaacacgcaucaacgugcagaaaacaagagaguacgagguccgcccuaaccagaaggaggaacucuuuccaucgaaaugcuacuuucccaaaaaucuuuuuagaaaaauauuggaaaaaaugagguugagcagccaaaagaccuccaaggggaaggaagcccuucuucaucaguguacccagcucugcccaugugcugcucccgacaaggaaagcugcccagugcugagcacagcaccccaacauaucaaacaagucccauuaucuacugauacuaucuccaacagcaccuauucaagaucucuauucuccuaggaggcagagagugaaaaaaaucuagcuuuucacaagucucgaaaaaauguuuauaacuuuccuagaaauuuugugauuucuacucauugcacgccacaagugaacaagagucagaaagcugacaucucaggagagacagacuuccuugguuagagagaaaggugcucuaucaguuugguuacagucguguuccuuuaauuuuuuuuucucuuuaaaaagauagccaugaaauuagaaguaagaacuugaauguuuuccucuuucagugacgaauauuuauaacuaaguuuguuucgucaucaauccccuggauguuuacagacgcacaccacccaucaauauauugaauggucuacuugaaucauauuagcauuuaauuaaaugaagcaaucaaaacccuaggaacaauucugauaaacaucaucuuauaauuaaaaucugaugaaaaacuuuauuauacuugccucaaaucuuugaaaaguugucaaacgaaaaucuccuuaaauucccgagagcaguaauagaggagauaacucugaaugaaaacauccaauacauuucuaauguggcuggcauuuuuuuuuuuuuugagacucacuuaauggcuuuucccaccacaaagccacuauucauacuuagaauuccacacucaacuuacauuuuuagaacuucucuugcuuuccaaaagaggaacaaaggcauuacugguugccuggcaauuagaacuaggaaccaaccacuaauuaguagacaauugugaauaaguuaagaaugaaugaaauaauuggcuguggagauuuuuuagggacacuugaaagaaaugaacuuaaagaaagcauggcuuggggaaagagaacagccagggagacuugcccaucaucuuguccucacuggucauauucuaauggcuuuuuaaagcagcuuuaaaacaggccaaccauuucucauugaucgcccugaaggcucagcaauuagucacaaugguugcccuuugugagagucaguuucaaccugaucacuuacugagacaaauccuggacccacccaagcuaaaaaucuuuuauaccaaggggaagaauaaggaguucccauguagaaagggaguggaaugcaucuuucuuaauuagacaagaccuccacggaaggacacugcugcuuuaagaucauuuaccauuuguuugucguucugaggcccauugaugcaaaagucuaagccacucuucugagcuccucagucuaauuaaggaaugauacaacuguuuugccucccgugaugaagacaaaagugucaucaauuauagagugcuaugacaaucuuuuacuauauuagcucauccauaaacacugaauuagcaucuuaguacucaccuguagucugcgguugagggaucugagucugguguggcaaguuccuagaaaugauuaacauuauugaguaaaaauguguuugcacacugguaaucagagaccaagacacauuaagauagaaaucugcucggagagguaucacucagauaacgggcucagguuuugcacccuguggggcauugagcuaugcacauacaugagagaacugaagaccaaggaagacaaauagcaaucucugauaauguccaugaaauucuuaccauaugccauaacaaaacucccucaugauucuaaaacauaggucuuauuaguuuuucuauuuucuuauacgugaaaauagccuuaaaguuugaaaaucacacggcuaauaacaguggauaaagauauaaacacagugaugccagcaauuaaauuacugauguguacaaucucaaacuaggucuagaucauaaaaccgguauggaucugugcauacacauaugucuauauacaucaucauaucguacaaucaucacugguacguuauaacagcuuugaaggcauaucacuaccuuuauucacuaaacaugcuaucuucaugccaaaaaaggccauuucccugccuggacuaggaagaguuucgagucccccuugacguuucuuuccguucccaaaggcaaucacugggauguuucucagcuuucguuaaaucuguccccuucguuuacaccuucaugucucccuuggagccucugacagcucugauguaguucuucgucccuuacaacccacugcugaccagugaccucccaagacacagaucuguaacacacaccucaauauuucuuauuucuuucucucuaucagcaaauucaauuucuggcuucuuaguaugucuuaagcagacggaaaacuaucuguagccucacacacacacacacacacacacacacacacacacacacacagagagagagagagagagagagagagagagagagagagagagggagagaaagagagagagagagagagagacagagacagagagacagagacagacagacagacagagaaagagagacagagagagagaucuuccccuuauaugagaaccccaaacaaaaccuggccggguggugguggugguggcgcaagccuuuaaucccagcacuugggaggcagaggcaggcagauuucugaguucaaggccaaccuggucuacagagugaguuccaggacagccagggcuacacagagaaacccugucucaaaaacaaaacaaaacaaaagaaaacaaaaaacaaaaaacaaaaaacaaaaaacaaaaaaaccuguugugguggugggggagacaacucgaugaaccugcaguugucuucgcuacagcagauauacauuauuuacaaaaagugugucuguguguauuugugggccuacacgugugccaucgcauggguguacucagaagucagccugcaggugccaguucuccuaccaucauguggauccuaaggauugaacaaagguuauuuaugcuuggcagcagauacuuuuacccacuaaaucaucuugcuggcccuuuuuaaaaauuguauagagcggauccuuacuacucuuaggaguaaaagauuccauaugaauguauucaguacugaaauauuuuaauuuaaaaaaaaugacaccuuaggaaccaggucuuuggggucuggggagauggcucaguggaucagucacuugcuggacaagcacagcaucagaauucagauuuccagcucucacaucagugccugcugggugucagccugcccauaauuccaguucuagggaggcagagacaaggggucccccuggagaggagaaugcaguuaguuuagggaucagccccuucugguuuugacugagagacucugccucccugaacaagguagaguguucccaaggaagucuuuguauuaccuuugagucuuccacauacacacaugcauucuucaugugcccacauaugggaacaugcauguacagguuccacacacaaauacggugcagaaaauaaaaauauaaaggaccucuucuacauguuuucagucucuaagcauuuccaaaugaggugauaauuaggccacuuauuaugcauucaguugugcugacugccaguauauuuuucugcauaugguauuuuguugcuccaaauugccuuauuaguaagaaccaucuuaguuuguuaauaacucuaagagaaaaagaaacauggaaucauuuuuaaugaauauaugcagaaaugagauacuugcaaagacucagguaacaggcacacauugauuaacauguagaugcauaaauucuacaucaaauuuuuauauuguuauuagcuuauuaaaauaaacaauuuagauuguagguggcauaaagcccagagucacccuuuucaaugcaguaaggaguguccauccacguguuuuguuucucuuaaguacugcgauuccuuagcugaaaucauacagagaacucugauauaccaaaaaggaacaaaggagcuaggaaucuugucuccucugaauucuucgccucacauggaguccuaaaaugugucaaggaccccuccaagacacagaguuuuaaaaccccucauuuaaaucacucccacaaggcaaaauucuuauguuccaaauacagcggcuggggagauggcuuagugagucaagugcuugucaugggaguaugcagaccagaguucagauccucugaauuuacguaauaugcuggcuggguaugucagucuuccuaagacucaaggcguggaggcagggggauggagacuaggaaugugugaaggagauuggccuaccccacacugagugccagauuccaagaaacacccugccucaaccuaagauagagaacaauuuaaaaagaugucccaugucagccaugggcccgaacacacaugugcauaugcacccuccacacacacaaacacacacacagguccaccuacaugcacacaccauacacaauaaagaaagaaaagaaaaaaauuacauaaugaaagaaguggaaaauagcacuugcuaccuaaauaguguuuaagucuccagggguuugguuuguuuguuuguuugaacagguucuuucuaacuauguagaucaggcuagcccccaaaucauagagagccaccuggcucagcugucuucuaggauuaaagaaguaggccuagccugaacucauaauccugcuaaaugccucuggaugauuaaaaaaagaaaauaaguuccacuuaaaacccauuuaaaauauuguuaaggaauaacaaaauucauucucacccaaguuaagacaguuauuuaauaauuuaccacaaugguuacacccucuucugcucuuagguuuuagcgauacuuauguguucuagggaauguuucuuuuggcuguuuuguuuguucugaaguuuacagacuguauuuauguugguuuucuacuagaagguaaaagaauugauucaaaaaccauaaagagaccagcugugcauuuaacaaugcaaaagcccaagaccuuuauuacacaagccaaaaugcaauuauacgcgcccaggggaggagggcggggaggagccuccuuucagcuccuggggcauaacugacaguggugguuccagaccagagaggaggcugcucuaacacuuucccuacauucugaagcccacuuccuccuucuccauuagcuccaggcacacagacaccuaaaaaacaaguacuuaacccaacacacgucagcaaaauuugcaaggaaaagaggggaaaagccagaauugaagggcuguggcccaggcagggcuuagucaaaaccaccaaauuuucaaaagcuguacacaaaggguauccuaaacucaaaaucagcguuuggauaaggccucuggaaccccacauccuuguuugggccccacagcacauucuuuaauaaaauauucuuuaaaaaucaguggucaggcugggcagugguggcgcacgccuuuaaucccagcacuugggaggcagaggcaagcagauuucugaguucaaggccagccugcucuacagagugaguuccaggacagccagagcuauacagagaaacccugucucgaaaaaaagaaaaaaaaaaucaaugcucaaagucaauccacgccugccauuuccuagaacuuuucuuuggcuacacugucaaauguugacagucacaguggucuuggaugggugaugaacaauuguugguucaugaauagauacacuuccaagacaucuggaaaagguacaugagaaagccauuugugcacuugaguuagucugaggguuuaaaacaacgaacccuggugguggugcaaaugauaagccugcaaaugauacguuagaugaguuauauagaaagagcucacauguucaaagagguugaaaaacaacaaaauguugagcuacuuugugggggugcauaucugugugaacagguaggaagcugaaguggggggggaucguggguuagaggccagccuggaauguucagcaauuuccaguccaccuggucuauauaaggucacgugugcugccuacagaagaaaggugcucaugagcauccuguugcuggaauaccgaaucacaugccuccaaucuacaauacuggggcuguggcgaggagagaacaaugggggaugugggaacauguccaugugugaggaaaacaggccacugaaugcaacuggauaggagaguggggcuaacuucaaacagagcaccuacacuccuucaaagaaagacccuuuagaaaagcauaagacuauuuaaaguaauuaaguuauuuuuggacuuauggaaagguuacaauauguaaacugcugcauuauauagaaagccaagagaaacuguaauucucugaauuauuagcauuaauuauuucccaauuuucucgccauuaccugcaucuaaauagaaaauugugcaaauuagucauuucacaagcuucauucuuuaagaaagcaaagguacauuaguaaauaaguguuuggaggacuacacaguuauucauuauuuguacaacugucacaucgcuggcucccccuuagaggaagucuauggguaggguggaugaguaucaacugaguauuuugcugcucgcuuaaagacuuagaaaacaaaaugauuugcauacagacacagaaucuacgccagagcuguggggguggagaaggccuucaguaugugaaaugccuuuuaaaauauggugacauuuauuagcaagcaguaguuccauuauuugggaaauuugccaauuauuuuagcaaaguugauauugccaaaaccuucauuuuuuuuuuuccuuuuaaaaugagggcuuggaccuacaacucuuuuugcugagaaaucaggaaauuggaagaggagaguaagggagggucacacagagccuagaaacacuggugaggauuuaaagaugaaaaccauaauuuuaauuaaaaucagcacuauauucuauaggauacauaaaggaggaagaagaagacuucuccaucuggauuuuuuuuucuuuucuuuaguuuuaccccuuugcuugugaaaggucagggcgaaccaucacagcuuuuuuuuuuuuuaaugaaaaccauauuuucuuuauucauucaaccaucagaaguccucuaaacugcuaccgauugauugugaacacuuuugaguaagcauaugagaacagaugucucuucuauacccagauuaaauuucuuuuuuauuauuagauauuuucuuuauuuacauuucaaauguuauccccuuuccugguuucugcuccaaaaacccccauacccucacccugcucacccacccacccacucccuccuuccagccuuggcguuccccuacacuggggcauagagccuucauucaaugggccucuccucccauugaugaccaacaaggccauccuuugcuacauaugcggcuggagccaugggucgcuccauguguacucuuugguuggugguuuagucccugggagcucuggggguacuagggguacuggggguacuugaugcaguagagaccuacagaacccauacccaccaaggaacaaacccaccacucugagucuauacuuucaaaaguaaaaugaaauaagauaaagucaaugucucugcaguguccuugucaacaggaacacgaucgucuuggucuacugaaacagucauuuucaacugacagucacuuucauuaaaacucacuuuuuauauauguagaauuuuaccuugaacgugguuuucauaauuacugaagagacgacaaauggaaaauagucacaaaaaacccuaaaauuaguuuacuagcuguaauuauaagacuuaauugcacuuuuacaguugauuugcaaaaagauuuaggaacggccuaccuccuguuugagggacacucaauuauccuggauuagauguuagguuuaguacgaugaauacgaacaaguuucugcauagccaauuaaaaauguuacaggaaaaugucuggggcaucugcccauguucuacaucacauaagguccuccaggaaguugcucccaccuagaaaaacucaguggcucuggaggucgucaccaaaugaaugaggaaguacaucauccccuggaaggugacacagcucaaaagacaucgggucgguauguuucuagaaaauucaauacuugggauccuccagucaauacuugcuucucaaggcauaaaacuuauauuucgauuacauuuccuaaggaauuuuuaucccuuuauuuuuuuuaguuuuucaagguucaacguuuuucucucuuacuuggccacuauuuucaagucagcagcaaugacucacuucccccacggcaguucuuucaagcagcugaagaaguccaaauggcuggcugcagagagucacaaacagcccauacuuuacagauaaaauccaccaggccucccauuuuacgaucccacccaagccccuugggggacaaggaaaaacagcugccuuuaaaacaccaggugggagaaugcaggggcccucugaacuggcugcacccagucagagaggccugggggcuuugcaauucccagucaugggaccugcacuuucaccugccuucaaagcccugauuuagggcugagcucugcauuguaaaaccccuaccgagagaguccggacucccugucagcaaucgguugucuuucaauucaaggacauaaaauucugugacucagaccucaacuuuguauaaagaguauaccuucuaggguuugggcgaagccucuaguuaaaagcaucaccccaauugccaugauucuuugggucaagguaauuuacauuuaaggauuacugcaaaugugauugccaaaacuaaauauauuaaaggggcugcugaugggagugggaggaguauucauugagagacacagacaaugaaggaaggaaagaaggaaggaaggaaggaaggaaacugugagccugacuaggauaggaaccacucccuuggacacuuggcuaugacuucuccacacuaucaaggcaaucaaucagacucugggaagccuaagaaacagcccagagcagaagaggccaaggaaacauggugaccuuaguacagugcccuuaaugaaauguuggaggagagaaaggacuugacuggaaaacuaguaaaaucuaaaaaauguccacaguguagguaacagcaaagcaccauggccacaagugaaaacagugccaugaggucuuaagaagagaaacugaaagaacuucagauacuccauuauauuugcagcaucuccaaggucauucuaagcaaagaucaaauuaaauugaucuucucucccuucaccagguagaaauaucgccacgugucuguauugucucugccuuuugaaaaguaaaaggagucgugcgugguggcacacuccuuuaaucccagcacucgggaggcagaggcagguagguuucugaguucgaggccagccuggucuacagaaugaguuccaggacagccagggcuacacagagaaacccugucucagaaaaccaaaaaaaaaaaaaaaaaaaaaaaaaagaagaagaaaagaaagaaagaaaagugaaaggagccauguucuacaucccccuuuuucugagcaugugacaugucucucuguccuauccugcuucccuuccucuuucaaugucucugugccugaaagcuggcucagagauaccguugaggucaauggccauacacuauccaaaguaacuaucagaaaugguaaauacugugaucucacacugaccucauuuaucuuugucuauuguuagugucuuaaauuuaucacaaaugguuuuagucuggagcccagugaaguauuaugccaaaaaagaaaaauguaugagagaacuguaguggcccuuaguuauaucgaaguuguaagcuuucuauaccucucaaguggauugacuuuguuaaaggaucaaauaauuuuuuaugcagauuugaaggaaagcuuugaaugguccuaagucuuacuuaucaguucauguaaguguuuggacauauugcuuugguugaauauuucugcuuuaaaaucugaggaagaaacaggaaaugcuguugcugaucaaacuccuuaugaaagauagguuuagcacaaaccuaugugugaggcugaaacgcgagcuagcccuuucacaaaggccuaaugagaaaacacaaagcaauauuauccaagcauacaccuggccacaaggaccacaagcuugcucaaauaaauaucucauuuucaccuugaaaauucuguuccauccaaaugaccaaaauauuuauguaucugcuugauacuaaaauaaaacuuuuaaaaaacccaauuauuuucaguuaaaguguaaaaguugaaauuuuauaauaaaaaaauguguugaugaaucugacacaauaaauuaccuauuaucuggcauaguuagaaaaugagguuaaucacauauucuggcuuauagggaguuaccauagagaccaugcacauauuauccauuucuaagaauaaaagaaagauaauauacacucaacacugaaacgacaccgaauguaauuuaauuuuccucggaugaggcaggcacacuugaugcucccacggugccucagaacaaucauugugaacaucaucaauuaucuauggacccuauuuauucagaaguguuaguuaauggagcuuuuccauuagcagaaaaaggaauaauagaaagguuuuccagacuucaaaacacauauauguuaaaauuguugcaaguucaguguaauaagcuauuguauuugcaaagaacugaucugcauaaugguggucuugaugggcucuggaaaggccugagaaaggcagacacauaaacuagacaaaaaauuuuguuuuguuuauauaucaauaacagcagcauaaaauccuggacccaagaaaaaucaaaaauuuuaaggagauauucucaacauacaugaccagaaagggugucuuuaaaaguggucgcagccuuucaauuuucauuuagacuuuaauaaccuacacacauccaaguuccucaacucaccauagcaacuacugcuguauucuaaaguuuuaaagcagaaugaugucaacaacagaaacauuuccagaccuguggucucuggaaaauuagcccuucucacccuuacccauagauuccagacgaaucccgugacauagcucagaggauaaagacacuugccucagaggcuaauguccuaaguuagauuccuagggcccacauaacagaaugagagaaacaacuucuauacuuugucucugaccacugcguaagcacuauagcauguagcccucccagaauaauaaaugcacaaaaauuaaaacgaacgaaaucugauuuccagguacacuuacuaacuucgaguuuuguagacuaugaacacuucuuuggaacacacacaauguaggaaacaguacuuaaguaucaaguaugauucugaaauguauaugcucuaaaaauuggacagauggauaagcuggauauuauuauaauauucuuaaaacuacugaaguuucuugucagucccuaauucuaguaaauggggucuuagauuagccuguaacaauggaccacuaaccuuuauacagagaauauacaugaacauacuuucucuguauuaaaauuaaauauugugaaaccugcauuuacauaucacuaguguaauacuuauuuccaaaauccugaauucaaaugcaugcaaaguuuccccaccauggaaggacacauauacagccuuggcccacgaaacccuaaguagaugaugguagaaaccuaagaaagcauucacaaucaugugauguuuucaaaaguguuuuagguaaaugcacgaaagcugacuguuuacacugucauacauaauuauuguuuaaucugauuuagcauauacauuuuacauaaugauaaauaagcacucucaauagaaaaauauauguccgacaugguguguguguguguguguguguguguguguguguguguacuugaaggaguaagagacagaagaacagagauuuuucugcauauccacucuauuuacuuuaauaacaggaagugaccgaaaaauaugauugugacuucuuguucuuggggguaacacaauuuaucccacuccaauauaagguaaaaaauaaaaaagaaagagcuacauucuaagggaauacaagucaguuucuccuaccacuuuauauauugaaaaaucuaguuucuaagcacacacaaucccucaucauccuuccccauagcuguucaagaaaguccccuuccugccuuccuuaccaccgucucuaaagcaggaaagauuggcuauaauuauauguguguucaucuggacaugguggcacucgccuguguuucuagcacuuggaagcuggaguacaaccagaagcucaaagcuagccugggcuacaggaaacccugccuuaaaagcuagccugggcuacaggaaacccugccuuaaaaggacaaaaccaagcaaaaaauaaguauauguccagagcccaagcagaguugcuuauuuuauauacaaacagaucauagagaaagaaaaaaggaauuuaaaaaucauuuauaccaaagaaacaaaaaucguuuagauuauauaggucuguggugguuaaaaaaaaacaaaaaaaacaaaaacuaacuaaacaaaacccaucaucucuuaaaaacaacaggauugucauacucuagccucugccugucuuuucaaaaggacucaucuugggacaaacauuuggauccuuaucagugucaauuccucacauauugauguugaugugcuuuuaugacuaaaguaagaaaaaaaaaacaaaaccuugaacugauucgauuacauuucugucaagccaagugaugauauuuugacacaauguucuccaauaaugaacaaacaaaaccaguaacagcuaaaugcuacgguuuggagggauauugguaaaagccccaugcacgcuggcgccuguguucccacauggguacucacugcugugccugcaucaacggcauguuggugcugucguaguugucugugugcgugggagguauaaccucuccaguuacaggguggaacacgggcaggguagacaggggccaugcaaucucucuguuuuuggacaugucucgaagcuccuugguagauuucugaaucgagcugugauggacaagcuggauacuacauaaaauaagaaauaaaacaacauauauuuaaaaugacgcacuagccguaaugaguugccuauuugaaaaggucauuuuuuuuucuuuaaagauaagacauuauugcuuggggggggggggcuguucuauaaacuagcucagaaaacauacaucucauauaccuuuauguaaaucucaaguuaaaacucagcuaggaaacacuauuuuaauauuaaagcccaagucauaaacuaguuaccuauuuauuuucuaugauuaagugaaaacuaggauagcuuuuuauauuauugcuucuguugggggcauuuauaaauacucacggaaguuucauucuauggcagguuauuacugcagagucagggcaaacauguaugaaagggcccugucauuuguccucugguuuauagaaaugcagguugggagaucgcauacuauaagugacauguuaauauucugaaucugaaaugguuuagguuuaauguuuaucuagguagccuuagcuuuugagcccuuuuuauuuuuuagcgucuacccagccuaaacaucucuauuuagaaagcagcuuuucgaguuuguuaagucaacugugagggauggcaaaggaaacgagagcaugagacacaugugcggagcaugauggguaaccgagaagcgacacacaaugagaaagaaaauaacagcaaagaagacacuuacucugggguuugcaugucucucuuuucccuagaaacaaaacaaaauuuaugaauuaaauaauagcauugauauucggaacauuaagacucuaugcucaugggacccugugggauguggcaaugcugaugucggacucaaaacgcaaccaggcagcauuugccaccaggguuauagaugacuuggaugaguacacauacaguaauggaauacugaugagaaacacacagaaaaauggaaaaaaauggagauuaagaaugaagcuccugauugaaauaaacucuaugacauaaugaaaucgggcuacauggagaauggagaauguguuccuugcugcuuuaugagguuuugagccuuugcuuuguuacccugacuuucaaguaaucucgggagauuaucuuaauugacauagauguccugaaagugcuaacuauucaugaagggaagacucauuacucaaaugauaccugauuuucauucauuuacuccuggguuauuuuuuuuaauauauuuuaaacauuuagauugugucacccuguuugacagcagaaugacuucaggaagaauucugacccucaguuuucaucacacugacuaagacaauuuauuuauuuaaaugcaauuaccaugucaauagacuccugucucugcucacacaagauggcuugcauaaccacggugucuagccucaauuauucuugggacuguuuuuccaucaugaauuuauaucuagccuuaaucauuucugaauaaaguaauuuuggccccuaauuuguuugcuagacucacaacuacuuuaauucauuuuuaagggaauaaaguacugcuguuugaucugaacaaaauuucaauucauuuacaguguguuuuaugaacuggaugcaacuuugcuuuuaaugggcgugucuacaucaucgucuuagcgggcuugccaauucuuuauuaguguuugaaaguacucacacuccuucccgucggcagcacaugauauaagcgaguauuaggaaaagcaccagugcuaccgccgagggcacagccaggguaacgaggaaauccguguaauagucucggcuuuucaaagaauccgaagggggcuuguacuccccgccgucgggcaaaaugcccucgccacgaacuacuuccugauagguggacacuugcuuuguuuugucaaccugauauaaaaaagaaaauugcacaucaaauuaaucacuaccaacauuagauuugaacaccuagauacaccaaaauagucuuugacaaauuaccuucaaaagcagauucauuuuccaauuacuuuaucauucugacuuguuauucuuuauuagagcugggccaagcacaaaugaaaguaguaaauacuuucucuuggccuaucuucccuauccuucuugcuuaaaaaagcacaaacauaccugcauguagucaagauguguguguguguguguguguguguguguguguguguguguguguguguguguuugugugugcuuucugguugcaaaauagagguuguugauaucgguaugugcauuucuugugagcagguaguucaaauguuuaacaaacugggugggaagccuguguacagggaugguuugucagguuaguaaacaagaaaaaaggaaauacagaaagacaacuucugguguccagcuuucuucaaaguggccgacauuaacuuuaggaagaagagcagagcacagcucccaccggacaguguggcuguuccacauuuuacuguauguuaugugcaucccucccuuaccccauguguauccccucugccuucacugugcuacuuucaauucuacagguuuuacugaaggguaccaaaaauguagucaugggaaguuuguuucauuugaugauuuaaaaaaaaauguugagaggauuaguuuuggcuuuauucaacguucucugcuggaaaaguccccguggccacucugcccugcucgccaaaccuagagaaaacucagcccucugccuccuuccgaacagcuaaguaacugcaauuccuacaggguuuuuuucuuucuuucuuucuuuuguagaauuaggaaacugguuguccaacaugcuuauguuuuuuacaauuuuaguccugauuguuuucauuuaaaaauauuuuauuaugcuuguuauaccacuguuauuuaucuuuauuuucuuuuuuagauaaaauguagccuuggagggccuggaagucccuugguagaauaggcaggccucuagcugauagagugaagggguuacgggcauguaccaccguguucagccccaacccaaugacucuuucauuuaagccuccuuaaauauuaaaaacaaacaaacaaacaaacaacaaacacuauuuaagaaauauccuuguggaaugauguggcaucuaaauaaauauguaacauauaaaauuaaaaugaaaauuuucaagcuuuucaguucuaaaagccuugccaucgaaacuuucaaacaccaaacaauuuuuuacuuuuagaaguuacauaguguugcuaaacauaaauucacguaauggcacagccaugagcagagugcugcuggcaagccugaugucuccugguugcugagaggaaugugugaaagucaugauccuaauugcucccucgaagccuuagcgacuaacacugugacugaaauauugagcuuuguaacauuacuacuuacucgagauuguacauaaaccacagugugugugugugugugaguguaugugugugcauguaugugugugcauguguguguguguguguguguguguaucuaaaggucauuaaaccauuaaaggucauaaaagcauuaaagaauccaaauaagaucaaaauacuguacagaaagacaaagaaggcauacacuauagaaaaacugaaauauuauaagucuccuagagguaugugugugugaaaccacuugcauuuuuuuaguauucaaauucaagauguguuugcauguuuguaaaagaauaaauuuaaucaauaaaacaauuuuaaguuugcuuagaagaaacuuauagaguugauacauuuacuuuuaagguuguaggcaaaauauucucccauagaguugucccgugucugcugagcucugucauuuggguuuguagaguacuggggucacagcagaacacagcuuuauccguacuaucacugugcucuguucuuucccuccaaaagugagcugauggcugcacauuuaaggagaccuccugcacacaccacccuggcucccuaaugucugcuguauuaacaacauccuggacauccgaaagcuuccuuggaccacccgccaagcuaauccagccucgacagcuaaucaagugcaggguacaaagguggcgagacgcucccuuacauggacggaccaucaucuaauucgucaaauccaucaaaucaaggaaguccacacaguugacaaagaaaaccuaggauuuauuuccaacagcaauucggguuccagucaaaugguauguccagacacaucacugcuaauuaaauuugcaaaagcaaaguuaaaaaaaacaaccaaacaaaaaacucaccagugaaaucuugcaccagucgauaugaaagugaguucggaacuuuuugucgcauguuaucacaggcuccauuucuugacugcaucuuaacugauucuguggauuuucaacuucucguaaacaagaagaaaaugcaacaucggcaccaaccaugacauaaacacugcaaaaauaugaaacucucaaguuauccuuuaggaaaauugaaaacacuggagggaaaaaaaauacaaaaaacaauuuaccccugaaagcaggauuuauccuuuugaauugagggcuuaacuagagucaucucugagauaggagccugggcucucaaagcagugauucauguagggcuucuguuguccauucuuuuauucuaccaguauuuacugagugcuuagguguaccaagcacucuuuccauucuauaugaaggucuggaacuuauauuucaugcauuccuugaauucaaaccagcuaagugcuauauguccugaucauuauauuagacuacuuacaauaagauucuccuucagauaaauuuguuaagaaaauaagccuaacccuaaaauaauagcuguaaguaauggcucuucauuugauuuucacauaaugcaauuaugacauuacacccugaggagccgagcucucugccaauuucacuauuucacugagcauuucugucagggucccaagcacacagaccccucuguguuugguuuucuuucagaucucuucucuucagcucagacguuaacacaagaaaaaaguauuauuuguucaccaagaaugaagcaaaacauguuuucuugaagaguacccugagcauugcagggaaagaauucuccugaguugagaaacaggauuucacaauuggacagaccacaguagcagcugacaggggaggucucagggaaucucgguaagauagggagccuuccagagaaaaggagaaaacaaaaaaauuuucuaaauuauuauaauuucugcccuuaaacgauaagaauuagcuacuuaucacguguggccagccuacuaaggauccagcugucuuugagacauacuucagaugccaauccaagcacucauaaacgguuaagaaaaacaaaaggccgaaaaagaaaaaauuccaguaaaugaaacaacuuuggaagaagcacgaugaaagguugcaaauggacucaaagcuacaacauaaagcuagcgaguacugcaaggaguuagacauagaaaucagugaaauagagccaaaaaucuagaacucaacucuaauauuuucuaaguggauuauugucacaagggagucugauggaagauaaauaguauuuauaauugguggucuuagaacagugagguauccacaugaaaauguaaaaauaaaaaaaauuaaaccccacuaaaaaaaauuaaaccccacuaccaacaucucaugccauaaauacaaaaucaacaucaaaacugaucaaagacagaaucuacuuuuguaccuagcgaacacaguagaagauuggcagucaucaccauagccuaaugaaacaaaccaaacaaacacacaaacaaacagaguaaacuguaaaaagaacaauuuaggcacucaagacaaauaagccuuagaacaaacgaaugccccaggaacugggcagagcagcagagggaaauggagaaucacaaccuccuggaggaggaguuugcaagccagagucucggaggggacccuugagauucugguacaggaaagcuuagcuacaguuaugauauugcuggaagguccacguagacaagccugagagucacacacuccagggcagccuggucacugaggauccugaacuuacguguucucaugggcagaccuggcuaggcuucuuugggaaacaggaggauuuccuguuguuggcaggagaagagggacacaaacaauucuggucuuaaaaaggccugccuacaggagacacuaagcagggguucaaugcugggauuaguguaaaaguccagcagaccugggagagagacaauuaaauucccgacuuaauggucaacuguuaauuauugccagcugucaauuaccuagaagaugggacucucaggcccaaggcacaggcucacuuaaaccugagaucuacacccagagcuggagaaacucccccagucucacauuugaacucuucugcaguuccuuuuacucauugucaguccaaugaaaaauaaaaaauaaauaaauggaggcagacaucacagcgugagaaacacagagcacucucugaacgaacgagacagcugcacuugccaacgcaacccaaguuccaaaacaaaucuucaagaauacuuaaaauauuuugagauaaauaaaaagaauucugcaaauuuucaaaaguuuaggacaacggccaaggcaguucuucgaggacaauuuauagugcugaauguguauauuagaaaagagaaagauacagaaucaaucacauaaacucucacuuuaggagaguucauggagacaaacagauaaucagagaauacuaaaaucaacuccauacccaaaauuugauugcacagaugaaacugaauaauuacaaaagagauccaucucccauacuagaaaaggaaggaaggaaggaagcaagaaagaaagaaagagagagagagagagagaaagagagagagagagagagagagagagagagagagagagagagagagagagagagaacgaacaagcgagcgaaugaaccuguauagacuuacaauccagaaagaaagaaagcuaaccggcaaucagcccucaguggcaaagagcacagucacacacugggcuucccuccacaauucauaaacuaaagccaguuugcugcaauucagaauaaggcagccaggggagcauuuucuagaugcugccuauaaucuaaacuugccaggcugaggcaggugaaccacaacuguacucacuagguuguaaguuuugaguguauuugaaauccaaacaaaaugaaaaacaaacaaacugacuaacagccagcaaacugaacccaaaaauguuuaaagaaaauuauaaaagguggccauguacaaucuuucccauuuaugaaaauaaaacuaaaauuaucacauuagugaauuacccaaggaaugauguuauuaauagauuaagaaauaucauuugacaagaucaaacauucagaaguaauaaaaucacuuauaaauuaacaguggagggagcucccuaaucucucaaugugaacuucuguuagaaucacaauaacuacuguaaacaguaaaaacaaaacacaacagaaacaaccucagacaguccccauuucaacacaauaguggaaaguucugcucaaggaagucagagaguaaaaagaauuucagugcaugcugagaugaaagaaauaaaaauaucuuuguucaagaaugguaagauccaaaauaguggacaaaaugucucucugagccaauggucccuuauaguaaguuuacagaauacaaagguuaauacacugaaaaccaauuuucuauauagcaauguagacaaaucuugaaacaaaagugguaucccauugagaucagauauaacaaaaauaagcuaaauauaaaguuuuuaaaagugcauucaaacuauagaugagaaaaaaaacccaugaaagaaucaagaaaacaaaacuaacggggaggaauguuuucuuuaucaagaagaagacucaguauauaaagugauagcuuuuuccaaauucauccauaaugucaaugaaaugccaagccaaagccuggugauguguucuguggaucuggacaaaugguucuuaagcucagggagagacaaaagacucugaauaucagacaccaugcugaaacagaagcgcgcaaagucagggaccugaaacuaucgcacuugcaacaaagcuguaguaguuaaagcagcuuccgaguguguagggacggcccuacagaagcaccauuaacugauguaacaugggacaaauagacuaauguaaauuaaucuuuucaacagauggugauggaacaaaugaauguauacauuuuuuuaaaaaguucuacaacugagccguauguacaagggugaccucagaaggaaugacagagcaaaguacaaaucacaagaagguaaugcagagaaguacaaaauuauuuucuaaaacaaggcauuaacgguguaauucaugaaauaaaggaauugauuuaaaaagaggggguagaaaggaggagcuuagauuuucucccauacuaaacagacugucaagcaaacuuuccagagccugggagaaaauauuugcaaauccccuauaucauaaaaagcuguuaucaaacauaaaacaauaauaaaacacaacugacuuaaagguuucucagggcugggggagauagcucacuugguagagugugugccuggcauucccaaggcuggguuccaucucuagcaccucauaaaccuggcuuggcaagagacaucuguaagcccaguaucugggaagugggaacaagaggauaggauuccacauucccagcuagugaguucaagaccaguuugagacugucucaaaauaaggaagaaagcgaggaaggaaagauagaaggaggagaacaaaaaaagaaaggaagaaagaaacaauggauauuuuuuaaagacauacuuuuuuaaaagagaaaaaccuuaauggagaacugaccaagauacagugagcaaaugaagaugaaaaggugucccacaucacauauuauuagggggaaaauugacugaagcaucacugggggaucauaaugaauaaacacugaaaaacaagcagcagccagaacuuuuguaacuagcuggaguaacaaacuauggcacagccaauucaaagacagcuugaguuuuucuuccagaguuaaacacauuuuacccuauggcccagcucuuagcaaaagaagccagcacuuagaucuacauaaaacuuguacauaugugaagaaagaacgcagucucucuauaauuucuaagugcaauguguacaucuuucagugggugaacagguaacugugguauauccagaaaaggaaauauuauucagcacacacaugaaauggaaggagcuaccaagaaaaagacauucaacugcaaguuacuaagugaaagaauccagaaaggccacaugcaguguaauaccaacugucugagccacaugacaucccagagaaagcucacuggggagaggguaaagagacggcugcuaggggcagaggaaaggaaagaugaagagaugcaacacagaugguucucagggcagagaaaccacucugucugauacacuagaaugugcauaugccaugcucauuuguccaaaccuaugacccuauguaagcuauggacuguggcugaggauguccuguccuguccacucuggcaaaagguaaugggaauugggggagcugcaaaugugggaauaguggcauacucagcaucuuucucguuaauguuguuauggaguuaaaauuccucuacaaucaguuuauuuagaaaugcauacugugacuuaaaugcaagaguucaaacuguuaagucuaagaagaaaaacaggcauaaauccuuguggccuuggguuagccaaugguucuucuagcuuugacaucaaaagcuccagcagggacaggaaaaaacuagauaagcugagcuuucucaaaauuaaaacauuucaggcuucaaagagcaacagcaagaaaguaaagauaaguuacaaagggguuauuuacaaaucacguaucuguuaagugacuugcaucuagaauauguaaaggacucucacaucauaaaaacacaaacagcccaguuuaaagaaugaccaaggaucugaacagacauaucuccaaagaagagcugcaaaagaacuuuucuuuuacauugcacacagaaaguguaugaaaagauucucagcacccuugaucacuggugagagagaugucaaauccacaaggagauaccacuuaauuccugcuaggaaucagaaaggaagccaaaagcuggugcuggagagaauguagaagaaucugcugcugggaaugugaaauagcccauggcuuuggggaggcagcuuaacaguuccucaagagguuacauacagggucaccagaugaucuggaaauucuauucccauagagacgucuaggagaagugaaaauagaucucuacacaaaauguauagcugauguuuaaagcaguagccuuucucauaguaaaaaagguaacccaaaaggccauauaacauuguaucauucacuaaccuaauaagacaaaaugaaguauuuuuucuacaauauggaugcaacuugaaaccauuauguuaaaugaugaaaaagccaguugaaauaacuuuuuuuuuuuuuuguggaacuccugaaagaaagauuaaggugaggaagcagcuaaauaagcuagaguuugccaagaaguuaggucguugguaguaaguggcuacugauguguauggggugcgggugcagagcucugaaauacuggccugaccugagaugauggccugaccuguaguauaaugaucaucuguucugaaugggugaaaugggucuuauaugaauucuaccuuaauaaagaugcuauuugcuuaguuuuuugagacaggaucguauucuuacagucuggauuggugauaaacucacuguguggcucaaacucauggcaauccucuagucucaaccacccaagugccaagaucaaagaugugagccaccacucagugcuacuguauuuuaaagugaaauaaaugaaaaauguaauguaaaaauucaaaacugucaauguaagcaugaugucccggccacauuugagaugacaacuguuccagaacuuuguuuauuacauuaggucuuaaguuucauguccggaacaauuuaaacagcaacaacucuauaccuuagggaaaguaaggagggagcaaugcaguaaauuaaagaucaaaguaaaagauucaggacaggagcuguaagaaaucucugggaaaggcaaguguuccacauauauucuguuuuuaaaagucacuucagcuucacaaaaccaauuuccaucuccuuauuaacugccugcccaacaccauacauuuuuuuucuugauagcugcaaaguauuuucauaaacagagacgaaugaauguguuccucaccacugcuaagagcccuuuugcucaaacaugauagugauuugcauuuauaauuaguaaguuuuuagauuaauucagcuaaaguuaauauaaauaagcauaagaaguuuugguacuuugaaauguguuuuucucuuaaauuauaaaagcaauauaggaaacuuggaauauaaaaacugaauucauuuauauuaccaagauaaccauuuucauuuuccaauguaccuugcagaauauuuuucaaaugcauauguuuuaacguaauugcaaucaucucuaaaauuuaauuuugcauccugcuucuccacuuaaugcgucauaagcgcuuuccacauuguacucuuugcaauuaugguuuuauggcaauauaauuuuuuaagugcauaugauuuauucugcaauuauuucagaguuggacaugcaguugcuucuaauuuuuugauguuauaaauaagacuguaaagucuaucucuguguauauuccuuacuguugcugucuaaaaagagcugccuagaagugaaaacauuuuuauggccguuaccaccaugccaaguuacuuucaucccuacaaggacgagccauaaacuccucaaacuugauauguuccgagcugagcucaucuucaccccuccccaccuccaccuguugugccuuccaccuccuucuccuggugauuggcaaccccaggugcucaagccuugaacuccggcgccauaucuuugacucuccuucuucucucacagcucaauccgucaucaguugcugacaguugcccugaaauaacuugcaaacauaugugucacucggucccaucucacugccaccacuugaguuugagucaccaacagucgaccccauguaggguacaaggcagcaaacagucuugcaauuguucucaaaccuagucucugccauugcccccuggcaccucaggugcugagugaguaagggagcagaugggcccaugaacagcauuuaccaguuaaaaacacaggccgcaaaugccaugcgaagacgauggaagacagugggccugucucaaaggucaacagguggacuuguugauucuuuuguagcagaagcaccucuggccccacuggcucuuccuaauauauaaugcuguaugagagcauagcuaacaauagcaacuggacgcugcauaugaaaagucuacgucucuuaccaugguuuccuucuagauaucuuuagaacauacaauuaaaacaaaacucuuaucaaguaaaaugaagagaguuguuaucuugaacccaaaugguccuaaaaaguugagaugggcacauauuauccacgagaaagcucuggaucauggcucccaaccuuccuaaugcugugacccuuuaaucauauucccggugcugugcugacccccaaccauaagauuguuucguugcuuccucauaacggugauuuugcuaucgcuaugaauuguaauguaaauaucugagaugcaguauaucugaugugugaccuccaaggaggucucgaccuauagguugagaaccacugcucugcaggccuagaaaguauagugccucgccaugccaggagcuccuguacacugcagagaacucuucagguacacuuuuauuuuguuuuuccuuugagauaggauagguuuguugaggcaccuaaacauuuaauguaaggaaucaucaaacaagaaaauaacuguagucaacacgguuuuccccagcaacagcaagacagcgauuacaaugaacauauguuuucuccaguuguccuacucaugggauacgucugacucuugagcuuaugcccagaagagaugccaaccaacuugagcauauauccaugcacgcuacaugucacugaggacuaugggauucugggagauguaguagccacuccggucuugucccuuaucccacuucuccccucuguaaacaacuguaauuaauuuuaggauaacauguaaaauuaaagauuuauaaacaacuuauaagauauaaaccaaauaacuaagaaaagcccagaauuuaaaaacaaaaaaacaaugggauuaaaaauuccauuuaaccuugagcucugaguuugcagugaauuucuucauaucaauuaaacauagaaaacaacaaaaacaacaacagucaaaauauauaacuuucucacuacugaaaggagaggagcgguuagcucuuagacccugacaaugcgcuagcucugaauucucugagaaucgguacggaguaaaagaagaucgagggaaggggggaaggagcagccacgcuggguggauuucagauggcccaacuuccacaucugaugcuccugagccaccuaaacucugcacagcucucucuacuaaacuccaccucgauucccugcacacuacacgugauaagccuaacacagaaacuuuccugucaacccuuuccuccagugaucccuuuguuucaggacaauacccacccaacuuucagagaauaugguucagcuguuggcugcuucuaacauaacuuaucucaauguuagggaagcagagacucaugaauccuagggcucuauguccgggcgcacacacucacgcaugcacgcaggcaugcucucacggagaaggggaaagaugaggacaauuucagagcugagcaccuuggcccagcaucaugacuguccaucaccacagugugugccagcaccaacuuacauucucuuccucaacugcucacugagccuuuugacacaggcaaaccucagccaguuagaauuguaugaaauggcucagagaauaaaugagaacagcuuuucugccacugacugaggcuagaucugcacgccuuggucaccagaggaaauagguuugauaaucuccuaugaaaagcgagcauugucuuuaauccucacaccccaucauucccuucauagucgccauuuacaccacaucacucagcugugguuggcaguuacaauaugaaacuagcaugaaauaugacccugcucuucuuuccaccagcuuuaucucacgcuaaauacaucuaugaguucuuagcucuuggcucuaugucaggagcaaaagcagcaccgaguccaugcacaguugccuuggggucgcgagucuggcaagugaaaauuaaucuuuuuggaggguucagccuuccuuugcagaagcuuauucacuuugaaguaaaucuuuaucauuguuuucuguucgauuuagaagaagcuugaaagcugucagcgagugcuguagagaugcgaaaaugcucaucaugaagaaggagcugcccagugggcucuacugccuggcauuuaauggcacuuugggcuguagauuggcauaaaagagucuucuccuaugaacgacucuaagccaccuguuggcuaugucacuacacauaccaagcacagaaaaguaauaugucaucaguagauuguggcugccaugagcaaauauguguguguguguguguguguguguguguguguguguguauucacaaagaucuuuauuuuuuuccuuuaaaucuaagcacgauuuauguuacauauuaggagaaaacauucauuaguuucuuaauaacuauuaccgaagcgaacacauuauuuuuuuaaaauaagauuauagaaaaguaauaucugaaauuccuuggcuaaaucagucuuucucuguuuauauuuucuauauuucauuuaguauauuuagagcucauaauuuuuuaaggugaaagcaaaaauuauauuaagugaauuacauauauacacuauauaucauuuaaaaauguaguaagugcauuacgcaugcacaauagacaucauuuaaaagaguauuaaaugcauuacaaagauucacuauauaucauuaaagagaaagucauagcacugagaaaacugugggauuuacuuguaauaaggcaacguggguaaagagacuugguuaucacaacuuuauaugacaacuaaggaaaauauacgaaaccauuccuagggacacacuuuucuccugcaauuuuaacucaaaugggaccugauuucccuggggcgugcauggagauacuggaggaacagagcuggcaucagguacaauuuauagaacacuauuuuaaaaagacuucuccuaugcauacuuugcaaagguuaaggcuuaacguuaaauugaagcucauggaaagcauuucaagcugggcagggaucugagacaagagucuaaauaaaugccauggggagggagggcucucucaaagagcugacaggugcugcagacagcuagcuaaugacugaacucucaucaaggacuuagagggccaagauucucuucuuaauuuagagucacaugcucaggcccagcucaaauacucaaaaucucuagaggcuauccaaggccagaagccuaucuaucguguacauuuuaaaugauacuuuagcagucauucucagagugggcauaguugaaaaguucugcgucggguuaguguuugggugacggagaugcuuaauagaauuaaguugagcucacaucuuaacauaagagugugcucuacugacuggagaaggggcuggugcucacacuguugcuucuaaaugcucgcuggccguuguuuuaacaaucaucuuggaacguguuaaggaaacuguugaaaagggggugcauacugggagaguguuuucaggggacccucccgcucaucuuuuccacgguuaugcuuuuuaauuuacuuggugaggaagagcuccacggguguaacuucacagugaaaauuuaagcucuagaguuaaguuucauacagagagccaaacagcacuuagacaagagauaagcccaccacuuuccucaaagcucucguacgugugcuugguugacuucgaaauccaucgcuauaccauucaagauaaaacuuaauucugcaauguuaaguugaacuucacaguccacugccuuccuccgccccucuucugccuacccucucagacuuucauuuauguguauuugggaucuuuuccguuauuuccaaacaaguucuccauuaagcugcccugaaaucugauucucacgaauccaguuauccugguuaauucuagauaucaccugcaaagaaguguuaccaggauuaugggagaagggagaguuaggaggggguaugugcagcaaacagugauuuauuccacagacugcacuuuugcaggauugagugagaagcaauucuccaucagccuacagauaagaaauuagagauggaaguuugguaugauacugacaccggugcuuucaauucucccaacaggaguguuuuuacuuacacaggucacacucuggcuugagaguugacauauccaucucucucucauuuaaccacuuucaggagccugagagagaaugucagcuccagugguucagagaaggaaguugaggccuagagggguuccacauuugugcaaugucacccagccugugagugacaaggccaagcuuuuggcucccgugucucaggcaugaguuucaaaugcacuucggccaucagccacggacacaugguggaaagaaugugaaaggcgaagaaauaguuuccuagaauaaagcucgggcaggcagaguccuccagcugauaacugggcaucaauuuccuuugaaaugcauggcccuaaauaaucagcuugucuccaaagguacaaaaggcuuagugcuauaauuuauggugucgguucugaucuacaauuagauucacaggacccuaguacagugauugaaggaacuguugauacuaucucuuugucaauauggaaaauugcuuauaaguuccuaucuccacaauaucuauuucuuauuaaaaagaaaaaugcaauaggcuaucuuccaucuauaauaaguuugauaaaaucaccauacuuaagaacccccauuuaaggcgcaagaugaaggcugucuuaccccuccuucaugucauuaauaggaagcggcacucugccaccccuauccagggcugacgugauguuuauggcguugaggcgcucuggcugccacacauuuuuuacagccccgagaaagucuccaagaaccucgcuggccaacauuucuuccacauucauauuuuugaugaagaauucugcuugauauggcaacgggaauucuaguguugaugaaaagagauaugcagaucuuuaaugaagcagucucucuuaaagagaacacuuugagauguguugaaugcuuucaugguccuagcaggacacagcaauacagaacaaccagaucacugugacccccaaaucaucuuuaaaaauuuuugucugaguggggcugcauuggugcacaccccuaauccugguacucaggaggcagaggcaggaagaucuccgugagaucuuggaagccagccuagucuacacaaugaguuccaggucagcuagagguacauagugugacaccucucucucucucucucucucucucucucucucucucucucucaguauauauauauauauguguguguguguguauacgcaauaaguaugucaucaucaccuauaccuagguggugcacauauaggaggauguaugcaggucauauguaaauaugaugccauuucaucuaggggauuugagguuuuucagauuugaguagccaaagggaucuagaagccaauuccugguggguuuccuucccaaaaauuuacacuaaaaaucuccuuaauuuuuuuuaaauguauauuuuaaauaaaccuaauauaaaauucaguuuucucagguguuaaucuuggguuacuaacaauuuuucuuaugauuuuuuuaaaauuaaaaauguuuucuucuuauauaauacuauuucugcaauuaugaguuacguuaauagcuaucuaugaaauagaaccaaugaagagauucauguggauuauaacagcaggaaagucacugggggcuuguauuuucccuuauacuuucaguggaaaauuaccuuuggagacauucagaaacacacaguaauuugaauuuauuucaucuaauuuuucuuuagaaaaccaugucuauaacaugguuaucauacuacaaacauauggcaaaaacuugugaaauuuuaaacuguuagcccggauucuaacaugaaaagguugguuaugugaauacuugugagcucuaagcagacuucaugccucuaguacaauuaccucguguacauccucuaauugauuucaacaaaacucaugaaucucuaaauuaaucuacucuugcuucauacauggaagauaaaaauacauaagcaccucacaucuucaugaccucccuucuuggaagcgucuuugauauuaauggacacuagauaccagagauuuggugagggagccaacucuggcuguaggguuuucuccagagcccaguagcagguggugaccacugcuaaagacacagcucugugagguccuacucacaaaccucuuccucuucuccagcaggcacugauuuggcucaagguuuuauaaauuuauucaacacacagcccaucuguaggcuucuaaaauauggacucuucauccucauucuugcagguaaauuuacaguuuauacaaacacguuuccuuuuuacauacuaugguaccuuaaugaugugacaccuuucccaugccuagaaauagucacagaaaugaaucaugaggaacaagaguuucucaguggcaaaugaaauaauauuuuuaaucauagaauauauaguuugggauauaugacauguucuguaauuuuuuuuccuaaauguuuuuacgaucaagguuccagaagaacacagaaagccuccaccccacccaacccaucuuauucaaugcuaccacugaacauagacacucugugguuguccagucaaccacccuuagugaucccuuucugcaaucuacuacaaggccugugguugcaaccccucuggggcucuaggcuguggggcucgccugcuaucuacugggccaagaacuacugccaggucucuccagagugagucacaggagcuuucuaacucuggggaaaucccauacuugcuauauuuggaaaucaaagaggccaagagaacaguaggccaguggauugguggcaggccucugaggugcuaaacccaauuuagggauucacuuucuguacucuccuugagcaccaugcugugugaggcuagaugacuaauuucccauuaggucacucagaguagaagagagcuggccuggccugaagagcugggcugcugaguaugaugauucugauuuacaacuuuguuguuccuuuuucuaaaccuuauccaggacaaguagcaugagugaaggccauguucaaagauguucauucucaaaugcauaugaaucuugucuagacugacaaggacagauucgugaccuuuuuaguuuugugguuuucauacuguuuggggucacuuaaccuuaaguagaaagaagucgaacagaucugccugaaguucaaauaacucuucucuugcucccuuacuaacacagcuuugaacuacuuugugcagggaaacaauuacuagugugugcgacccuccagcuguguaguacucauucuuacaucaggaacugcaugaauaugggucuccaugugacaauaacaccuagaauagguucuaaacacuuacuuucuacagucucugcuagagagagaagaagguccaacuguagacuaagaucucuuccagucugcccuaucugacaaagacuuggucucuugagccuguaauuauaagguucaagggaccaaagucaccauauuuucaauaugugacuuuaaccgugaacccacaaaugggaaggaaaagaccaaugacucugcucacuuagaguucccaccucuaaaggaauauguuaaacgagauagaacuauucaaucccaauggagcccagaaccagucucccuaagcuauggccaccuaauaaagcaugugggguagcccauaaagccaguccccuguaaagggcacuuugcauuuuaaccugucauagcugucuccaguuggaacuguuaaaucaucuagggaaagacccacagaaggugguucgagucuucaagcagucuucuccagguacauacugucaaauuccuagauagugcuuucuuuuauacagucaaagggcaaguuuuaacccagauuuacugaguuaucaugaauuucaaaguauuagguucuggcaaaauccuuuuguuugccuguuuguuuucuaccaauaaacagaagaagcaagucccgauagagaauauacacuucuuugcuuuauuucaggggaaaagacagaucugcaaccauucccuuccugccaacgccuuaccuggcagaaguaucgaagacauuauuagcccaugauuuucuaauuuucuaauuuucucuuucuuaauauuuaagccucaacaaguggaucucuaugaguucgaggccagccugguuggcaagcgcaaguuccagaaccuccagagaaauccugucuugagaaaacaauuuaagccucaaguuuuggauauggggugguacuauuuuccccuugccuccucuaguaccucccaugaacuucuccccucacuaauguuuccuauucuaugucaaaaugagguuaaaauauuugagagcauaacuuuuaagaauauuuccugugucccuggccuucaacguccucaagaaaucaucuagagugagcauguuccucuaaguaguugauagacucugacaguuacugacauaauaagcaaauuuagcuaauuagcaaauugucuaccucaaguccccgaaucucaguuugucuuuaccugaagcgaagccacuacuuagaacaacucuaauguuaaauaugaagcuaccuaauaacuaccauguguucuuagaccuaacucucaggcuugagaccuuauccagggaagcucugaauauuaugucacccgcugaugccgcaaggcguaaagaacucagcagggcaucugcugaaggacuuuccugguuuucaccacagcacaccauuuuuauagaaagcuccaauggcucauaugucuuuccuacauuuuacuacgucaucaauuacaacuggaauaccaacucugcaauccauaauuauacuguauguuuauaagcacaacgaaacccuucuuauaaguaagacaugauuaccaacauacuuuccauacuuaccuucugcugacauuauauuaauuaucaaguuaugccuugcagucucaaagguacgucuauuguaggcaguuaucuauuagaaaagaaaaggcauguuuaaagugugaaguguuuuguaaaaugcaacucauuaaagacaaaauaaaaauaaauuauugucuuuucuaguuuuucuuauuuguugauaugccuagaaaauuuccuuuccugagcaauaggaaccuaagacuuuuaguaauauuauaggaaaauaauuaguuaacuaggucuauucaacaugccaaaacaaaaaguuaaauaaaaaaauacucuuuagcagaaagccauuaggcacaggggacaauguacacaugucaccagaaaauggaugaagugacuuauuggugauguacuaagaucgaaaaaaauaaaaauaaaaaacuauacaugcuaugguuguacugguaaauuugauuuaagaaucaucgcaaacauauacuuuaaaccaagcagaccuauguugcauuuagugcuaaacugcacaacaaccagucaaaagagguaaguagccccuucaucacauaaaaacagaccucagagugaguaaaacagcaaggaccauagccuauaaaacucgggcacaugcucaaaaccgccauucgguauuuucauacagucaaauguuaguaaacauuugcagggucaggggcuuauaucuaagucaacugagaaagagcuacuagacagaccaagcaaaagccacagccucagaacucaaggaaggcaugauuaacuuuggaacuggcauuaaaugguacacacccauccauuguaccucaacaaaacccagcggcugugucagaggcuuaagagucccaguguuagguugcuggcgugaccacagcuguaggugacaucaaacagaagaguagaggaaaacuggcuccaccuacuacgagcccccugugcacugaacaagcaccaaagauguugacauagcaaucggaccaucuagagaagcgguuuacaaucauaagagauaacuaacugaguuccaacaggaagaaucagaaugagggggaugaauaaugucaaaccuuuggcaauauuuauucugaacagcacaccaacccacaguuaagggaguuucucucucuccaacuugucaaaauuccaugagauuugccuccuccuuccuuauagacacaugaucagugaggcucauaucaaacaguaaccuuaagauuagcuaccaaacauaaguaggaguuauuuuucuaagaaaacaaauagaaaaaaauaauaaguuguucuugggaauuuuuaugauuaaaguuuagccugcuccuauuaacauacauaauuuauuacaugcuaauuaguuaauuugaauuacuccuccaaauaaucauaaucauauuuucaguggaagaaaagaugacuagucuacuccaguguguuguuacagugagauuuugacucagacaagauaauagguuuuuguuguugguggugguuuuuuuuggggggagggggauucaagacaggguuucucuguauagcccuggcuguccuggaacucacucuguagaccaggcuggccucgaacucagaaauccaccugccucugcuucccaagugcuggaauuaaaggccugugccaccacuggccggcgauaauagacauuuuaaauuaauaacaauauuuuugguuaaucuucccuaguugucacaaauuucauuauuguaaguuuuguaaacucuaguaaguuggcuuuuguaugugucugucugucuaucuuucucuguuuauuuuauuuuauuuuuuaguuauuuugcuuuuuuuuuuuaaucacagcauacugggagaagugaaaaauauuuucauauuaagaggaagaauuuguuuguuuguuuguuuguuuguuuguuuucgagacaggguuucucuguauagccuaggcuauccuggaaacuguagaccaggcuggccuugaacucagaaauccaccugccugugccucccaaguacugggauuaaaggcaugcaccaccacugcuaagcgaggaagaauuuuaauaucugaauguauaucuaaugcuuaauuuuuacugcuauaucagaauguagugugccuuuucuuacuucuaauaugauauuuaaguacuguaaugaccucaaucaaauuuuaccuacugcaaaaaugugaagggcuucagaacauggggaggaggcuuucuuuuuuauccuuguuucuaaacuaaugccgagucaguuucagauguuuaaacucuaaauauuucagcuauagagguacugaguggguuaauucauaaauuucuaaaauuaaauauaacuuaaaacauauaaaacuuggccaaaucaauagaagaauaaauuaaaucaguaugcuuaauacacuauguagauauauugguagucuacaaaagguuguguuaaauuucuuucaguguuuuuuuuaagcauacuauuugcugcagaugcuaacacuuccugucugaggugacuuacaugaacaucuugaucauuguugaauucaccuggacauacuugccugcuugccagacuuaacguuaggcugcuuccaggcauugaaauugugaaauugguguuuaaaaucucauugacuuuuaugucauauacauguagacuuaaaauacauugcuuaguuugguugcuuugaaacacuauaaagcuggcaaucuacaugccauccacauugagucuccuggcccauccccuaucucccaauucccccauuuuguugaaagcauuuagccauguugcugggaaagccucaguuauauuugcucucaauauuaaccacauaaacacagcacacaaucuauucaccugguucuugcugauaaccuuucaagucuguuguuuuguggacuuccaguguucugcuuugugaacgguguauauagaguguguccauccaugucaugucuucaggugaguuuuagcaagcugcuaguuuguguaucuccuuagaagugggacugcuuagugacaagguaugccaaaacucacacgggacucauaugugauguugauccccacaguggcuauguuaacccccauagucaccuacagugcauuucgcugaugguaaaauucacauuauggccugauuaagacuguuccucaucacugauaagaacagagaucuuacuuagauuuaugggucuuugugaauuuuuuuuuucaguaaaacaucuuuuuucuuauugaacugagggguucuuuuucuauuucagauaccuuauugucaggcacaugcaacaaaaauauuuucuccaauuuuacagccugucucuucaaaaaaauuagauauuuuucucucaaauaaaaauauucaggugauacuuaagaaaccaauccaacccccaagucaacaggagagucuuccauauuuuuauagaauaguucaacauuuuguuuuucacauuucaucccucaccuaccuagacuugugcuuggaauuugguaugaaggaccuacggcuaguaugaaggaucguguucaaauagcuaacaauuuuucugagcauuaguuaagaaauagucauuccuuucccaaugaccccuggcacuaacucuucaauuaucuaucauuacucguuguguggucuuuguuucuggccuugcuaucaauucuucagcccauugguccauuccuaccccacugacauucuaugauagugagcauggguuuauggccaucugacauccacgugagaagagacuucucauuuguuccucuucauuaaggcuuagcuaugucuagcuuauaaccuuccccauacauguuagaaacagucacguucucuuuuuaaaaauccauuggaaacuuaucggcauugcacagaauccauagauuagggggaaauuaugccguuaugauacuaucuucuuauuauugagauuaccaucuauuuaugcaaauuugcauacucuguguuauauuuauuccuaguaccuuauaauguuugucucuuuugaaaauacaugcuccucugaaacaucuauuuucucaguacuuuuuauccauguacagaaauauaaccacauuuguauuuauccuacaguugauugcuagccuuucauaauauuuuaauacuccauaggcuuucuacuacugacugcucaauuucauucuuucagaucauaaggaauucgguuccacguacuucccuucaccagcuaugacuuuuaguccuauaauaaaauccuauagcaaaacauagaggcugccauucuuguuuuaucccugaauuuaagugacauuucucuaauguuccacugaaaaugauauuuggaugcuuugagggaaagccugucagguuaagggaggucucuucaauuccuuguuuuaaaagcgcucagcagagggccuggaggaaugacucagcagguaagagaacuuucugcucuagcagaggaaaugagcuccguuucccuaucccagaucaacagugagacacuguuaucuuuuaaguauaacuuuuuuuuaaaaaaaaguauuaauuuaauuuaaauuaccacuauugcuaccgucaugguuuugauacuagaaaacacugguguauuagaacaucacaauggcuuuagacuacaagcuaacucaaccauuccugcuuccauggcucuuggggauuuaccuagcagcucuaauaaugcuucucacuugucagcuggaauacacccuaacuucuagccacaucauuaacuuuuugagagcauaucuuuuucccaacacccugauuuguuugaauguguguguguguguguguguguguguguguguguguguguguauguaucucuguguaucucuguguaugugucuauguauguguguguuguauguguguguguguggggggguguauuugguguguaucugugugugugugugugugugguaugugucugucuguaugugugcaauccuguaugugcugugugugcaugguguaagugugucuguguauaugggguguguguguguaugggguaugucugugggggggggugcgugugucuguguauguguguguauguauaucuguguaucucuguguaugugucuaugugugguauguguauguguguguuguauguguaugugggguguguguguauuuggugugcauguauucgguguguaucuuuguguauguguguguuauguguucaugugucugucuguaugugugcauuuguguauguguuguauguguguggugucuguguguguauguguauauauagggucuaucugugugugggcagauguguauguguguauauaugugugcauguaucuguguguguguauaguaugugugugugugugugucuauguguauguguguguucguguaugugugugcugucuguguguauguauauggggugagucaauguguauguugggugugucuguguauguguaugugucuguguaugugucugugugugugggggggugucuauguaugugugugaucauguauguguuguguguguggugucuguguguguguauauggggugagucaguguguauguugggugugucuguguaugugucucuguguguguguggugucuauguaugugugugaucauguauguguuguguguguggugucuguguguguguauauggggugaguugguguguauauugggugugugugucuguguguguguguugugucuauauguauguuaguguauguguguauauauguacgucugugcauguuaguuuucugucugagugauugcuguuuugguuuucagugcuggggaugaauuugcgcgugcuucucaucuucucucccacuaagcuagagccucaaaccauauuuccaaaaucgggaagggcugcuuccucccccagguaggcuucccugauugugugaacuggucuccucagcaucuucugauuccagcaguuacuacagcauugggaaagugugccucucucagaucuucagggccaagaccauaaaacauggcugacuguacuugucuuucaucuuuccuaccuuuaucuccuuccacaauguucaguaauuaggauuucuagugagugacuuuauuucaauaagcaugaacuuugaauuuaaaaaaaaaauguagagcugacuuggcaauuuggcucagugaguaaauugcacuuacugccaagucugaagacacgauccucgggacauaugcaguggaaggacagacuccugaaaguugaccucuggcugccacaaaugcaccaugaacaugugcacccacacccaugcacacagacauaaagaacuggaauaauuuuuuauauauagaacaaauaaauuuuauuaaauacaauuuauauuaaccuauuucuuuuaagugucauucaauuuuucacuaauuuaguuuaucauuauuaauauaaaaguuaaaguagcaaacuuuacagaaaggaauaucaugucuaaacauuaauaaguacauuucuauauuuaaaaauaaccuuaaaaaucacugccauguaacucuaaugucaacauuuaaaacaaaugcuacaaaaccauaaugucacuuguucaaaauaacuuaccucaauaauaguugguuuccccacauuuucagcuguuggagacccauacaggacuccaucacuguacgggguccuuuggauauaucgaagccauccaggucuaucuggguagcccauuaaauuuguguuaaauguuaugggaucauuacuaaccuccccuagauaagaaacacagaauuaagacauaaaacaguuauuucuaaacauguugcuuuggugguuucaaucaaaacagucuauuggggaaaaaaaaagguuuucccuuuuccauauuuguaacagacuaaauacacaaauucaaacaaaaucaucugaaaacuugacuuaggaauccacaaaacaaaaaagaaauccuuuugguugcugaaauugucuagaggucuaauaaauauuauagauucaaaugaguuucuuggaaauauuuugagaagaacacaacaggaucguuucaccagugagacaacaacuaucauuggcaaaucuuucccgaagcucauucaccugcuaaugagagacauucccuucagagaucuccaaggacaucacucgaauaguaaggaguggucaaauaauuauaaagguauaauaauuugucauaagcacauaccuuuauuacacauaacaauugcuguuuaaaaagcuuagccauauaguuuuauaaaaauugcaaaucucuuuuaaaaauaauuuuaaaguaauugaugaaaagacccuuuuuacuauuaaaaacaggucucccuucauuuuauuaauguugucggauaagcuguuauuccucauguaaccaaaaaaaauuuauaugaauucuaauauuaaacaccuauucuuccaagauuuaauuuucagaagucauuuuuguuacuucagaauuauggcuuacuguuuucccuuacuauucuuucuauaucuuuacuaaugugacaaugcuggugaugauucaaaauuaacacauuuaaaucaauagugaauuaaauguuuuaaaaacugcuauuacuuugaaugaaaauuaaucauuauauuaugaaguuuuaccaaauuguuucauauaauaaaagcuuuuaaaaacacuguuaauuaaucccuuacuucauucucuuacacaacaaauguauacuuuucuagaacaauaaaucagugugcuauuuaagaaauaguauagaauugggugaagcuauaauuauuuuugugugauuaggagcuacaucauuugccaggcagcaauguuaacugucaacacuaaacuccaaaaaaaauaugcacucuaaaaugcaaaaaaaaaaaucuucuauaaguaaauuucuaaucuuaaaaugagaaagauuuccacagccaauuuuucauguauccacaucauuuuaaacaguguuaaucauauuugauuuccuaucauccaggucugcacaucacacaaaaagauacauugaacccuucucccuuccggcagagaaccuaccaggcuuuggauaagguggaaauucacccuuaaaauacucucucuccaacacaugaacaaagaggacaccugcagauggguacacguuccggucagagugcaccuuggagaaaagaguguacacugaaagcaagggggaagaaaagagacagaugauaaugagaacuguccugagaacagacuacagagaugcaccucgccgugcagaaauugccgagaaaaccaaacuaacacaccagagaaccguuagugcauauuugcuggaaauggacacaguuuuaggacaaagcaugagaaaacucacugacuuguuguuuuagaaacuguuaagauacuacacaaauaaaaugacauauauuacauuuaguauuuuuaauugccauuaagcauaaagacauaaauaacacuuugaugauguuuuuuuuuguucaaaaauaucaccaacaauauacauugaauaagaacugaaauuuuucauaauuacugcaguuuucucuuuucccuuuuuaaaaagcaaauacauagaguacuuuaaaaauaauaaguacuacagcuuuccaaacagcagugagucggccgauacagcucucauccaggauuaugcaguaacucacguuauacuuagggaaaugugcuucuuucuccgugcacuagcaaaaccuuuccuagacacuuuaacuuuauuuccugucucccaauuuuggcauccaauaauuaaaaugguguaaucuaucccacucugcuacccccuaaaugagcagcgacaucuacacaacacaguucugcacggaucacuucuuuaggugaaaugggacccauuucaugauucccugugacuucggacauaagacgugagugcacagaaauagccaaauugguuugauuaguuucuaccucuuguuuuuccucugauaucaucauuuccaccaacacauuacugucauaacccuuugccaccucugcaaugucuucugggauuccagcuucacgauuggccaguagauguaauuuuuagacugauaaaccauaucagcccacuucuuuccuuuagucacugauggauuuguaaaugugguaauuaaccucaggaaccccaagacuacucacaccaagcucaaacacucgcugaaagccccagguagccaaaucacuuacaguaaaguuuuuaguauuaaauaaauaaauaaauaauaaccaaagcaagcaagcaagcaaccaaccaaccaaacaaacaaacaaaaaaacucccacaaaauguuucucuccaugagaaaacuugucccuguguucugugcauagcuacacccccccccaacacauacaccaaagaaaauuagcuaaaacauuuggcuugcaguuuuauguauucauaacuugaggacugaaaacacaauuucacagccuguggaauagccaggcagaugugguggcucacgccuguaauucuaucacucaggaggagacugguaggaagauagcuuugaguuuaagacaagccuggguuacagaacaaguucaguguagccuggauuacagaacaagauccugucucaagacaaaauaaccauaacaaaaaugccaugcauccaaaucaaccaaucaaucaaucaaucaaucaaucaaucaaucaaagcugcaagauaguuaagaagguuugcagagagagacugaaguguuuggcacugaacuguguaaagacuucccuagcuguuucuuauugccagguucuacucgaggacgauuuguucacgauggggagugaggaucacauuguaaauaaugaucaccaaauugaagaaaaaacaucaagaugaaaaaaggaugguaauaugauuuuuuuugccccaguucaauaucacaaugugucuaaaauaucagauaguuucagaaaugugaggacccuuuaaagagaccggaucuccacuuccuacaagauuaccauccaguuuaagagaccaacaucuucugaacuagguauuaccccagagcuuuagucguucuggcgauaauuugaaggaugggcugacuuuagaaagaucuggaaaaaauuaauagauuuaauguuuuucuuaauaguaggugcuuacaacccagagacaggcacuagggauucagucauucagcaaugaaaacauacugggguaacguugcgacccuuuaaaggaauacaguggugcacaaucccgggucaugucagaggaaaacagcugggaaggaaagaaucaaaccauggagaguuucaaacuccugcugagaaguuauuuuucucuauauuaaaaauguuaaaauuucagaucgcagcuuuauccaaaguacuggcauacuuagaauaacguaaaugauucuccucugaacguaucggauuuauuaaucucccuagagacaaaaaacucuguguggugcaacagugagcuucauuuuccuugucauuuuuuuaauaccuugaggaguguugaacauauuuaaauagguuuacugacgccuguggaaugaaugaauacauuguagcacaaagacggugcagagacagauacaggucucaugcgagggagcuaaauauauaugacacuuaauuuaagguauaguauucuguagauuacucuccucuauuuccaucauaaaguaauagccucuuuuaguguuugcuauggcaaagugauauaugucagcuugcgaagcaaaaagaaauguuucucacacuaaauaauacugugaaauaauucuauuuucuacauagcccucauaaagccuaacaugacccauuaaagggcacauaucauuccacaccacaccaccgugacuaguauagaacaccucagauucuuauagaacaaaacaaacaaacaaaaaccauuucuucaauguacagaguuaauccacaauccaccaucgcccucucgggcuuuaagauggcaugcacauuguuuuuauucauguguacucaauugccguucugcaaucugccgaacugcauccuugcuggucaguuaccuuggcaacuccacaguaaagccugcuucacuuuaaguauauaugccauucacucgagaaaaacaugauacagauguaugacacacucaucauccagaaauggaaaaugacuaagccacuauguuuuguuugugaaaauaauacuuccuuuugguaugguagguuuaaauuaugggcacccacacaacauuuuagagaagagcccguuuccugucccuuuguuauuugcaaaacaaauagcuccucaagaggggcaguauuuacaccugugcuucuuuucagaagcgaaauggcauagagaauuugaagcccuggguugcuguucuucuaaacaugagcuaugacaauaauacucauaaggcuugcacaaacuacccacggagacuacuaccugacgcugacacacgcugcauucacaggugccuaggugggacccacaaacuguaaacuugauacacacgauuuuucuuaauaacgagccuagaaaaugacauguaaacacccugagaagccacggcccuaaggccucaguucucuacaacgcacauguguacagcacugugcuaauccagccgaggucacaggggcuggccucuccgugucuugcaucguucuaugaucuuauacagcuauaaauccauuaccucggcaaacacaccacuggauacaaaugaaacuuggagccuguguguagcuaaaucccuuccaaucuagcaacauaagugggcaaaacaauuaaagcaagaguucgaaccaucucgcaucaaaaccaucaccuucgaauaggaaagguacauauggugguacagauuaagacuucugaaaaugcacuaccauaaacaauagaauuuauuuguaaaaaagagcgaacaaacauaaaaaucuacugucugaaucaagaagagccaaaaggaaaauaguauuggaaaauaaugacuuuaauguuuccccucccuaagcaccuauguuucucugcgccauauggccauaaucuuauucacagaacuauucauugcauguugcagucacaggguauauagaaaggucaggguguuucaacaacucuguauuaugugacaguagugagcagagaaucaaauaauagaucuugacagcaauggcaauaaagugggaccucacacucccuaaauugugccugucuuccucugcuaagaaucuguuagaaauguuuucucugcgugaagggagagauaagcuucugcaucggugugcacuuuacacacauuuacauugaaaacagaagcaaacagugauacuucacaaacacugacguuuggaaagcucugcguugcugaagaaccucugacagagcuucucgauugcuguguagauugucgcugaaauguaaacagacacacaugccaccccaucuuuacaaaggggccagagaacacuucucggaccuuuuucugcgucauuaagaacgaggacacagccauaaagauaaaacagacacugagugucaggccggaaaguuccagcuacguuuaaucuuaaaccugucuccuuucgcaaucuuugaaaagaaugucaugaauuauugucaauaagcguguccaacuagccuuugcaagguagcaauuaugugcaugugucuuuuauagguucuucaccaacaaacugaugacuuuaaaagauccacuuauguggucuuuuucugcuuuuugagguuuaggaggauuggguaaaaccucaguuaaccauaaacccagagaauggagcauggagaagccucauguuccuaaggaagcagcaguugguccucuuucguggugcuguaagaccaucauuucgcacaccaguuaccacacguggcucuauuauacagggggccguauggacgguuuggcugccugucauuuacaaaucacaugagugggucccaguaggcuaaugcauuuuaagguuguguguuuuauagauuuuuuguuuucuccccccaguagacaaguugucagcugucauuucucauugcuaucaguauguuuucuauaguggcuucucucgccuuuuacgcuugcaauuauuaacccgcugcagguuuaaaagccagacuagcaaauaagguaggacugcgugauaaauuaagaggagauacgugcuguuucuguguguaccgugcucugccagaugugaaaaaagcagaagacagcauuugaagcauuagcugcccaaggaccccuuuguggugcguuuccugguuuccagcugaagccgcacacccgugaauagacgcuuaauauccccaggauagggucauuacuugaggcaaaagcaguauaaacucugugcaacauaacagagucagaaauaaauaagugcacauuugaaaaucuuaauucaauccagaugcuauguauacaugaguuuuugaaucaaaaugaacauacgguguuaugugaaauaacuucauguuugcuaugugggaaacagacugcauaauuuaaacacagauuuguggauuaaguauuacucuuagcaggaguaaccuaaccaauuuuaaaaauaccaagauacuauaaugaauaucuuucuaugacaaccuaaaaguuuguuuuuaaaagcaucucaauuuuaucaaugucugauuuuauggggaauaucacaaagguacuuuggagacaaauuauuuaaacaagacuaugauaugacuagauaacuagauagauauuuacaacugugcacagcauuaucuuaauggaaaguacuaccugggagaaauuaaauaaagauuaugaauaggauuuuucaaagauguucaagcuauaaagagagugcugaucugccaccugucuuaauacaacuuuaaaacacaaaauuugaccuaagcaaauagguauaaauauucugaaaaucaagcacuuuaagugcuaacgggggugggguggggagagauuuccucuuuuuuuuuuuuuccuuccuauuacaacuuuaacaggcuuaaccaucucucugagacucggagucccugugugaauagaacgauacccaauguauuggaacagacugagagaugaaucccuuuggcucucugaaucaagauaacucaucucgggauuuccagagcuuaauaaauuuauggauuccuuccuaauucauuuuuaacaaguuauuacaacauucaaauagaaaugaaauuauuaaaccagacaguuaguguauaagaaaucuuaauaccaaccagguacacaaccuguuuucagauuuuuuuuucuuuuuuucuccucucauucacauuuaugugagauuugaucgauccaaccuaauaaauguuggcuuucaauugaaaguguuucgccgcugucagcccuucaccucggggcaucaaaggcuggccagucauucauuuggaaguaggcagcuauuguuuuucuuacagucacagauagcccaugccuaaacugcaggauucauccuaaggucagcauuaagauuaccuccuugcuaagaauacaagcacuucuguucaugcgaggcagaaaucaaagcuuggaucuuuuucuacaaaaaggcagcagaauuucuucauaaaaaauuucccuccuaagucacuuauuaauuuuucuaaauuggaauuaucuugguuauuaucuaaucaaauauguuuuccccuuuguauguuugugugccuaugugucuuaaauguugauaggaaaggggugcaaacuauuguuaaugggugaucaauaaaacacgggacucagaaugccgaaaaguugaaagggguuuuagaugucaugcuaggcaugcaaauaucuuuauuaaaggacagaccaaaguacugguucuggccaagauacgcccuuagcuucccaguccagccaggacggccgugcacuuuuuuuccuggagaaguuaagcuuucacuuuacuguauagaugacaaaauuaaccccagagggacuagaugaugguuuccugagcauaggacuaacagaguauccacggagcuuaucaauuugacaauacaaaacacaaguuaacacauuugguagcuaaucauucugcuacaguaagauugcagcaagcagucgugugacugcuuaacuuucuuaauaauuucccauugauuuauauaaaaaaaaucagaacuugaucagauaagcuaagcuucugauuucagaggguuaucuuucuacagaacuacagaagacaagguuauaagcacaaacucacaaguucaaggaggaaggcgccuccuuagugcuuagaagaggaggcaucucagccucauagcuaggacuugggaggaaagccuugccuuucuuguacacgguccuuuagaggcuuaaaauuuugagauuuuucucuccugacuuuaccagccuuaaggcacuuccugguccucuacauucauggaagcaacgagaucaacaagaaucaucccuguaucuucaagucuccccuacaugcaccccgcucugguuuauuuuuauuuuguauguaggugaauaccuuagugugcauaugugcucuggaacuggaauuacagugugagccacucacugggguugcugggaaccagacugggcccuccgcaaaagcagcacgugccccuaaccacugcaccacccuuccauucccagcucucaucugaugaucaauaauguaccugccuugaagauugaagcucaagcuaucuaauguacauauuauuuuagucccaugaauauucaguuaaacuauagccuuuaaguugaagauuagggaaucuaagcacacucauuuugacuuuuuuuuuuucuuaauuucuuaggaaaaaaccuauagugucaaucaguaaaccuaaggcugacaaauuuuggaaugugguuuuucuaaguggggggagaggggcaugugcaacagggauaacaagagggagugaauacacgaauauaaucaaacuucauuauaugaauauucagaagugucaaguaaagaaaauguacuuucuauaauuaacacaugauaagauaacaagaaaaguuacuuuuaaguauauaaauaugaaaauauacuucuuuucaaauaaauuacccuaaggauacacauuauagcuacuauuucucuacucucaucccaagauacaaggagagaauccauauuuggagugcuuuuuauuacuuuuauaaucacuuaauauauaucaaagaauaaugugaaauaugguggcauaaagcaaauccucugaauuuuauuuagagaaauacuauucugcuguuuuaguuaauaauuaaaauauuuuaaaaguugcaucaaaauaaccauuuaaaaaaaucuuacuauauaaaugcucuuguugcucccuugaaaaugccaagcagugaaugcaaagccuagcacuuucaacaucgucgcuacagaggcugcucguacuuguugugaguuauaaggugaugguccguuaucuucauguggcuaaugaaagugacaccuuucucuacaagucaucccacucccucaggagaaggcuaagccuuaaacgggccgaggaagccaggaaaaaagaagguuuggaaacacauggaaauaagagcaguacuucccaaacuggcuugacagauuugagagggcuuuuucacuucuaguucaggagauagugcgugucgaguuauacacagaauauuagguccaaucagaagcauggcauucaaaacaaaaagagaugguuaccacuuggagauccugguggagucaguccgucagucagucagucugucugucugucagugaugcacuugaguacagacagcuccagcuuaauaacucagcuagaucuaugaacuaguuaggcaacagucuuuugguaaaucaaacagggaccaggggggaaugcuaggaaaggcagaaccacugaggaccauaguuuaaaacaagaggcagcaugaaucaguaaaggaugaguauaaucuggugcacaaaugcugggaagccuagagggagaaucuuugggaaucccaugggugcaugaggagccagagauggcuccguuccuuuggaagggauagaguagagaguucagugcugagcaauaaaggauacauacaucagacccauaacuagacccauaacuagaaagaaacaggaagaguggcugugucaaacaaaccaacaaaaccacaaggauuaccaaacugagucuuuugaaggcccugugggagacuccacuagaaauagcuaaggagagugugggaggaggaagcaugaggggcggcccuagaaugagugcucuggugcucuguaaaacacaugccuggcaucuuuucaugggaagcuacuauuauaaaacuauuaucuuuacauagauaugagcaaugaaaugccuagguacacagaugugugcugcaaagacagacaugauacuaggaaaacuugcccuaccauaaaacagauguggacgaugaagacuccagcugcugaauaauuugguaccagguauaaaaauguuagugaccugggaggcagaggcaggcgaauuucugaguucgaggacagccuggucuacagagugaguuccaggacagccagggcuacacagagaaacccugucucgaacaaaagaaaggaaggaaggaaggaaggaaggaaggaaggaaggaaggaaggaaggaaggaaaaaaagaaaaaagaaggaaggaaggaaggaaaaaaagaaaaaagaaagaaggaaggaaggaaaaaagaaaaaagaaagaaagaaggaaggaaggaaggaaggaaggaaggaaggaaggaaggaaggaaaagacaaaaaaaguuagugacccaacgugaaggaaagaaauuccuuacuguaaaguucuuaaucucacaguaagaacauuuuauuauauaaaauuuuucuuuucaaaaauuauuuuaacacuggcauuauuaugcaaccauguugguggccucaaaguucuagaagccaggcuacuacuugauuaaucuuuauaaccacauauagcuaauacauagggaaggagaaagauguuaaagaugaauaaauaaaaauuauauaagugaaaguuuacaaugguaacugauauucugagagaagcuaauccuaagguaggcuuuucccccugaauaagugcacuguuucagaggucauauaauguugcuaauggauacauuuauagauagaaaaaugcagacagacagacccaucauucaaggacccaccuuucuaauagaaaacaaguauccaguaauuauuuaauagcaaaacaucaauuugacuuacaaucaaaucacccaaaauuagacaaaauauuuauggccauuuuucucuaagauuacaaagacugcuuuaaaacgauaucauuaauuguacuucuuaguguuuuucaaugcuuuaaauaaauuggacuaguaagcacacgugaaugguucuauaagugucaugauagagacuggauaaggggcgaagguuaaaaacgagaggauuuuuuuuuuuuaguuuauaaaaaacagaaauaaugcacuaacaacacaagaggaucagaagcuuuuuagaagauuaggaaaacaaaaauuuuuuuuuucagacugauuuauuaaacacucacugacacaggacuaaaacguaacaaaagagcacuggaagcaaacacugacagccaauugaggauuuacauuuaaagccuaacucaccaucuuucuucccagcagccaguuuccugcugauacuaaaacugcuggcuuguuuggucuuccaguuaacuguuccauuuaugccaucggcacagcuuaauaaaaaagcuuuucagaauaaaacaaaugcacacagagacaugaaauuaaugucaaauuaaaaauuacuaucacaguuacuguuaacuuggcucagacuacaucuucucagacuaggagcugaauuccaacuagcaaaugcuuaguacauggucaauauggggacucgauaggaguaacaaacaagcaagacuucaucgguccugccccacaaggggcuuacagucugugaggauugaauagaagcuucuguacagagauauugguuaugaaaugacucuaaugguguccaaagaauggucaaaaucacgagggccacagcacggcuggaggggagacaauuaucucucgcuggggaauuuuccauuacaucaacucaggguugaguuuggaaauauuacaguggcagcggugaacaggcuuagauaggguccagagauauucaggaagacuggaggggagacaauuaucucucgcuaggaauuucgcauuaccucaacucagaguugggucuggaaacuugaaaguggcagugacgaacaugaggauuagguaagaagguccugagacgcacguagucuaucacaaccgccagcucaaagguaaaggggcgacacggaggcgccaggugcaagacacaaaggagauaaugcugacuauuucucaaaccucagagugcagagauaaaggagagcccaagauggcuuugaggguuugaucuagaaugauacuggccagagauaguaagcccagaagacaggucaacuucagaagagagaggagacucaaguuugggauaugugaaauuuagggucccaaauggacaugcaggugaacccaccuaagaagacaggguuccagguccaguuauaaacaaauauaaagggguuucagggacagauuugaagucauuucucuuacagaacugacaagagaagccaaaguuccagugcugacaacagugugcccucagggaacacauuagagacccuaaaauaugugguggucuggagcauggaccccaucugcuugaucuguuucucuucauccaaacugcuccucucuccgcccuuacccuucagagcucauggauuuugccuccauuuuucugacauugguucucuacucucccucagagaagucccacucuggguucagcacagcuccaaauccccuagugcuuaccccauacaucuguccuuucuucuaagccugaaacacauuuaagaaagaacacauaagaggcugggagacaugacacaugcuuaagagcacacguugcucuuuaaaaagacacugguuuggcucuuaguacccaacucauguagauugugacauauacggucagggaaucugaucccuucuggucuccucaggcacccaaauauagauggugcacauacauaaacccaagaguucgugcauacccauaaaauaaggaauaagaaaggaugcauaaaucagcagggauaauaaauauagaauguauuaauacacauacuuaaauugcaaaaucagagaacaucucaaccaagaaaagacaggggcagucacagguuggacaaccgagucagaaaugccacauccuccgaugaagggagaugucaaggaagaggguaugaucccuugcuauaaaaugaccagaggaugagagcgagaucaaggacuccuagcuuucaaaagcagaaaauuuacgugcagacuccuugaaaacagaguucuaagagacuggggaagggaagagccaaauggcaaaggucaagaugcagaagcugccagggagaugagaucagccaggacaaggaagcaaaggcagcgaccgggggccgggggcagggugaggaaagggaggguccuccaacaggggguucuauccacagguucuaggaaagauacggggagagaacaagagagcaaagauaaagaaaacgagacacaaauccaagaaaaguagaacauauagggccagaaauagaggauaugaauaaagaaaauacguccugaaugagaaaguaagggaaagagaagcguccuguggagucuaacaacgcuugugucuccaucaugccaggaauuauguacggauuuucuuuucacauuaacucuucagcaaaauauuuaacaaacuaaauuaugaaaauacuaaguuccccauauuaaaaaaaaaagcgauucaaaaucuagguucuagcugggugugguagcucaugccuuugaucccugcgugugcuggugaaggaggcuggagaaggggaucaacgaagcgucccugcuucaaaacaaacaaacaaaacccacagaaaccuaggccauuaaaaaaagaaaaagaagcaacaaugaaacaagcaaagucuuaugggaaguacaagugaaggccucuaacaaacuacucggcuggcaucaguuuuaaacucuguggauuuaagcaaaccagcuuuaucuacuaaaugaccagucuuacgagugauuuuccuaaucagugguugaguuguguuaugaccuuaugaaauuaugaauuucuaaaacuagaugaaacaaaugguagguguucccaauaacuuaaauuuaaaacaaaauccaaaacacuaagaaugccuuaugucccagacggcuccccuccaggagacucuucauuauugauuugaaaggcaacagggcugcuuacgcaccuaggcagccccuucagaauaagugcccaugggcgccaaaagguuuauaacaaauagacacaccacacauauccaugacucuauaaaagaaaguccaggcagaugggcuacacuacuucaacaugugguucucauaaauaauuaugaaguccccaagacugacaaauccaaagggguaggagagaguaguccgauugcuuaggaugcagcaaaacaggagggacccagcacuggaaaccccugccuucuuacuuccagguaaucucauggaacaaucaggacaugugagucaccgcugggcugacgggggauagagaagcccacccuaacagaaucgcucgggaagcagaugacaaaagcuacuuuccuuuccagcaugggcagcagcauuuagauuuuacuggcagacuccagcaaagagcuuucacauauuguuucucccaauccuuacaaacccaggugaaucuaucaauguguuugaagauuacagaggcuuaaucuuaaggcccaagguaguaaauccagcaagcagccgcccaggagcuucucugcugccugcgagaugagucaucacaagggaagccugggcugagaaaccagauagcacuggcuugaccccuucccccauuagugaacuagucuucagacuguacugcacguaggaaucacaguugagaguucauacaaaaucacacgguuguacuuuaggagucaguggucugacggauuuaugugcauaccuuuaagucugagauugucguccacgcacucucuuuuucagaaggugaccaaccuggcauaagcguugccagucacuuugggaucuuggcugguaaacgcuucagcucuauacuucccgggugcucuacagagacagccuggaugucuuucauagcaauucuuuuuuuuuuucccgagacaggguuucucuguguagcccuggcuguccuagaacucacucuguagaccaggcuggccuugaacucagaaauccgccugucucugccuuccgaguguugggauuaaaggcgugugccaccacacccggcuucuuucauagcauuuuuuaaaaaaaucuaaccaguguccuaauugucaaggauuaccguaggauagaacccuugcauacaucucagaggagcuucuguaccuuaggggccucagugcuuggagaccuuuuuuuuuuuuuuuuuuuuuuuuuuuggauguaagaggaaacccagcuuuucuuuuaaagugugcgugugugugugugugugugugugugugugugugugauaugugcauggggacugagcaugucauguuauccauacagaggggucagaggaaaguuuauuaagucagucagucccuuccacuuuauaucgguccuagggacaugacucaggucuuuggauuucauggaacagcgccuuuccguggggcuacuucacugauccaugcacacucacuuuaaucaaguucauauuaauucauauaauagcugacugaccucagaaaacugaagcccgacgacucuaaauaaaaggauaaguaccguggcucaguucaccaggcaagaguuauagaaggcgagacacuguaaaccacacacugaccaaaaaaaagaaaaaaaaaagguuacucucugcuggggauguggggagcuaacguuugguagcuuuauuuucauuagaagaccaaugugagaaaaaaaaauucuuuuaaaaaacuaucauucaaauaccuuuccugcacaccacuuuucaagacuagaucuaauguguaaaauaaugucaaccucuauagacagguuauuggaugaacuccagaggcaacgcacugucuucagaaaucauuaaaggaagcgguuccugaucauuugucacaauuacaccuacaaugcugcuuucucuaacgggaaaacacaaaggcagagagcgccaugaguccugcaguuaugcgcguacaguaagaaacuguucgcauaauuugcuggacccuccauguccacagcauagccaagucuucaaugcguccccuccaagagucaaagcugaaugaaucugaagguggcuggcuuguccucccguucccgagaaaccguacaaggcuuaaaaguuugucuuaagauguucucaaucauuuggaggcuuguagcagcauaaagaguuuucaucuagucgggggcaagcagucucugaagagagaauauugcucuuucccaaccuggguaauuugcagacuaggggaggagggaguugcucuuuaauacaagcaauugaagagcuaugaauagugacugauugcugaugggcuaaucagaaugacaagaaacagaaauaauaaauaauaacuugcucagacaucacuguccaaguaaacagcaggauaugccaaaugaaauuuaaucugauuagcacacucaccuuacaaaugaacuaucaaaccuuaucacacuucucucuggguucugcuucccuuauuucuuuacauauuauucuacucuaaggcuuugcugaaguugucuguagaguucacaucuuccauagcucuucccuucuaugacagccuucaaaaccuuuuucuuuucccuuuuuaaaaaaucaaaaaaaauuuagcaucaugucugugugaaugugugucucugugugugugugugugucugugugaguguguguaugugucugugugugugugugagucucugugugugugucacugugugugugucugugugagugugugugucuccgugugugugugugugugugugucugugugaguguguguguaugugucugugugugugucugugugucugugugaguguguguguaugugucugugugugugucugugugugugucugugugugugugugagucucugugugugcguaugugucuguguguauguguguguaugugaguguagguguguuugugugagugucuguguuugccugugugugugugucuaugugaguguaggucuguguguuugugugagugucuguguuugccugugugugagugugugugugugugugucugugugaguguaggucugugugugugugugugagucucugugugugugucucugcgugugugucugugugagugugugugucuccguguguguguguguguguguguguuugugucugugugaguguaggucuguguguuugugugagugucuguguuugccugugugugugucuccgugugugugugugugugugugugugugucugugugaguguaggucuguguguuugugugagugucuguguuugccucugugugugugugugugugugugugugugugugcgcgcgcgcgcgugcaggcgugagugugucugaugucugugggugcgugcccaugccacaguguauguuuggagaucaacagaaaaucuuguggaaucacuucucucuucucaccugggcaugggguccagggagugagcauaggcuuucauuaucuggcaacaaucaacuuuacccgcugggccauccacagggccaucuucccucuccuuuccuuaugccacuuucuuuacuacuuauaaaacuacucauuaagcuguuuuuuuuauuauuauuacuauuauuuauuuauuuauuuuggucucccuugguacaaaacacuaacuuauuagcacccaagucuccagagccaugccagccagacccugcacuguuaaugugcuuacacauauuaacuggcucgauccuuacacaaacgauguuaaauagguagcucgauuucgcaacaaggauaagacaucuuaggaaacagugucacuugccaccagucacaugcuucugaagucgcaggauuggauuuugaacccgcucuguggcucugugugcaaagucacuguucccaacucaaccaacagcccuaacuccaaacaguuuuuaaaagaaugugaugugugagcaguacggccucuucucggacacccuuauuuuuagcauagcgacuacuuuuuuuuuuuuuuucuucuggggggaaaugcauugcuggaucccugcaugagaaaccgcaacaaguaacgccucagcucugugguagacgugcuggcacuuuugcaucagaaucgauacaugacacaaaacaaugcaucgccagaagaaaauccacaugucccugagacucuaggagugaaaaggcuuuucugagacugucuccuaaggcucuaacaggugccagagggugcgcuccucagagaagugcuugauggcgcagggcuuucaaacuucaaacuuuaaagacagacaaacaaacaaacaaaaaccuagcagaauaugagcagauauuuaauauaauuuaaguugauuuuuuuuuuuuuuuuuuuuuuuuuuuuuuuggguuuucgagacaggguuucucuauauagcccuggcuuuccuggaacucacuuuguagagcaggcuggccucgaacucagaauuguaucauuuuuaagcaaagcagauuauaagacauaaugaaacaaaauagaauaaaaucaaauaaaacggaccuaaagaaaggcgcugcucggugugagaaccucugaagggacgucauuugaacccaaguguuucugugccucugcuucugccucuucuuuuuuuccuacaaccaugauggacaaaauaaaaucacauuucuauggcgagcuauagaacauucuggagacaucucgaaaacagacuuaaaacccagugccuccaguccugucaaaucccaccccauugccuccuggggcuaagaagguaucugggcagguccuccagcaugacucagggucagggacuucuggcgacuugcuggcgacugagagucgccuuuuaccucuuugaagagaccagcugcaaugugaauuccauuuagauucaucuucccugggaucucaugaacucguagguauuuauccuuaggaaagaaugcaaucaaagggggcaaagucugcccgugugcauacggcuccauuuugcacuaagcacuguuucaagacuaggugaaaauuaaauugcgauuuuuuuuuuuuugaaggaguaagagagaccagagauuacuuuuuucuccagcuaagguuucuuguuugcucaaauaacuuagaaggagaauuguucuuuugcuacacaguucugucuucugugggugaaauugugggugaaaaagugaaacacggggaccuccaacaaaaggcauccacagcggcuauaaacaucauuacugucuaauguccucaucugaaagagggaggauuguuucccaaugaagacggugggugaaaagcagaccacaaaacaccgugcacuaaaugaaauccagagugcuagugcgaucuaguggaaagggauuaaaaaacagagggucccugugagccacugggguaggggcaugaagcagcaggaaagauuccuaugcaaauuugaaaauucaguaacacuacacucguucccauuaggaagugucuaaaggagucucacaucacaugcuugccuuaaacggccauuaauugucuauguuauagaugucaugcuuucuagcuggaaugcacccuaacacuuuaaucaggaagcuguauuuuacaaaguaccuucucacaucccuauugucaccuuaucaaggccacucacuggcuacagcuuggacucuuaauugucuuggcaucuuuccauauuuuauucacguggaacauacacagacauacaugcgccaugcucugccuuacacgugauucucuccacuucucauuuagggcacacuugcacaugauuacauguuaaaacugcagcgcuuucaguccugugacucagucauaguuuauugaccaucuccgugaauucaaccgcaccacacucagacuggagaucgucccuuuccaaugugauccccuuccagcguuacacaggccaugaggcagaggacagaaaaauagcaaacauaaccuccuggcuaacagccucaaauucaauccaauagccuccgucugauuucaccccucaaaaaguuccuucucuucucuuuccccuaccuccucgguuccauuagccuacaaggucacuaucuccaaccuggauuuaaaccccuccaguagcaaaccauucagaccuuuucuucacacagcaguuagaguacucuuuuugaaaugcaaaucuggucuuguccugcuuaaccccccucugagaguucccauugguguuaguacaaagaugaaccucuuuaagguggucuacuagguuggggaagauuggcuccuugacccugcuggcagcuuccuucccugucucuuucuucucucagcacuuuuuauuuagcaagcucuggcugcccugggaucucugcagaccuccagggucacaagcaccuuuccugauucaccucccugcccuuuauuccccuucccuccuccgugcuuccuugggagaaaccuccaccuuucuucaagucuagauaaauucuuuacuaguauuugcgguauuuagcuucguuccgggagaguacaaucuuauguguaauuauuugauuaaucuucacacuguauaauccugaaaagagaaaaaacuugauucaucuuugucaacucaauaugguuaaagaaaaaaaaaagugggauagcucagaccaccuauuacccagcaucuguuagugucucaaaaacaccuaacacaccccuaaaaguauaaaguaauucuucauucuuaaaguuaccagguuuuuuuucuucugguuuuucauuauuauuauuaucaacaacacaguaaacacccuugucuguaucuuugaacacucccaccaacuuacacguaggcuaaacauucagaagaaaaaccgcuagacaaaaaaaaaaaaaaggaagaaagaaagaaaaaaaaaguauaauucaaauucugauaagcuauccagcagccuacuguggcacaggccuuugauuagaaucaacuguguaacgacugaaaauaaaagaugucagaggagcuacauugauuaacuguugcaugggagaaaaaagccgccgguaucauuuuaccgccuagugagaaacaccgauuuguuaaagagagaaaacaaaaauccuuagagcccguguuuccuuugcuuuugcauucagagguaaaagagaagcuuuauuucuuggcauacugcugaaaaagacagggaagggaaacacccccgauauaacugcccuaggaaaauuaacugugaucucuuucaaauucagagugaaccccaaucuccauaauaaucaaagugguggccagaugaaugaguaaaagggcaaagaaugggaaggaauucacgccaaagcugccuaucucccaaacaguuuugaaaccagccguuccauuuaucugaaaagaaagucuguccuuccuugucacaacagaugcugggugauucccgagguauaggcugccaaagagcuauucuaaaugucugauuagccuaagguaauuagguagaaagugagccguguuaaagaugauucuuaaauaaugaaauacauuuaagucacugacauaaauguuauauuaaaauuccuaagugaagauuuaaaagacaaaaacaaaucaacaacaaggacaaaaauuugaccagagugaccaaagaagaaaaugguauagccuuuccuaauacaucauuaaugucucagagcauagcaguggucaugccagcaacaaauauccauucagaagcugcacagucauuucccaagauaaccagguuuuaaagauuaaacauugggauaauuacuuugugguuuagggacaugaguaagcccugcacucaaggaauugcaaguagccgccugcggaucaggugagcuuugacaagccagaaccucacuuuggagaguuucucuccugaaaauaggagccgagccaaagaaugucuguggcauccccagcaacugggaagagagccacggcaagcggcuguguguauuauuacaaccucacagaagugcauggcacuguuacaaaacgaauaaaaacagugagugagagagagagaagaaaguuauuuaagaguaaaaauccacuucuuguagucagaaugacuguggcucuccugcugacuucuaaccacuggaguagagaagaaaguuccaggucuuuggcaggagggaaagcaguaggccagagugggucagcaaagacagcagacuugccucccuuuucuucacaucucugacagagccccucaauaguuugcaagguucccaauuauuugaugcaaauucuaugaagucagaagugcugcucagaaaaagagguccuggauccauuuugaacaaacacgucucccaaguuagauauggcuaucaacauaaacgaucaaugggcaggugcacagauaaagaagaaaaaucucuuccaggucauguuugccaucguaagaauguguucccaaggcaggcagaaaccaggcucauccuaacaagcugccaacgugcacaggcuggaagcuacuuuguugguuaagguuuuagggguuagugaaaagacaaaagucuucaacuguauuauaaagugauagauucggggugggguggggaagaggggcuacugcagugagaucugucucacauucuucugaggaagaggaaggcaagcaccaagcuaucuuggggaccagggacaggcaucuugccugccagguaacccuggaguccccagccuucaccaccauuaggcaggagaaaccugcaagacacccuugacaagaagguggcucugggaagacaguuaagacuaaggggcaugucagggaggaaaugaucuugccuuuuucucagauuuucaaguuugcagugcagaggagagaaauauaaacuuacaauucauaggaccauucguuuuagagaguuuaucaaaggagagagagagaaaaaaaaagcaugacauguuuuguauaucgguuacacuaauauguuccuauggucuucaaauccuccacugcaaaagaggugaauguuucugcucgucuagaagaauagcugaaguugauuuuccuguuggccugaacugguagagaggucuccucgagcugagucuaucugcacguuugcccacucacucugauucugcccucugaagcaaacaaaagagaguuuacuucaaacuaaacauuuccagacccuuugagaauacccacugugauagaguugcuagacacucaccaaccccacagacuguuuugcaaguugucuaauuugucaacuacucucuccaaacugacgaccagaaaugagcaugaugcuacagaugggguugaacagagcaaggucuaucauuuuuauguuaacaucacagucuaaccugcauguuuauuuuuauaaggcacaucuugccauaacuucucccugaucuuccuaaagaacaagaacaacacacaagucacucugcuucucuucaugucagugaauuauaguucccugauugcuauauuuuguacuugcagcuaagcacuaaacucaaaugguauuuaauccuaaauucuguuaucuguuuguaacagucacccaugaauuguaaagcaagcccucuagaucuuugucaaaaaucaugugugccaacauuaaacaagaagugacccauuguaaagaucugugaccuuacccagaucucucccuucuucaaacccaguaaccuauacacaccuggccagcacaggucccagccagucuccagcuuaugcaacaauccugcuaauuaauuugcagacccucugaacaucauccgccuacagcccaccaacugcuucccugaaagcaagacucacuuaucuuucaaaauaagacguaaaggacccacacggcuuagagguacaagucuauggaaauauacauauacacagagcaaagcccaggaaggcaagagcagcagugcaaaugucuguggcaggcugugagacuguuuggguuuugcuguuaucguuguuuaauucauugcuaucuuuacuacaguuacacaucuuuaaaaaaaauuaacaaugaaaaucaugugcagagaauuuggcuuggacacaguugaugucaaauggcuuuagaccauugagaaucucuuuccaaccagaaaacgcuaagcagaaaaauagucucugauaggacuuguugaucccugggagaaucagccuugcuuucuuuccauuagcauugucuucuuucucuuuccccacucuuuccuuuuuuucaacgccaaauugcuauuuagacuuaauaagcugauaacauaguuaagaguagacuagaaaacaagauacggcauuuuagaaaaagaagucuggaugaugugcccgcgcacccaugugugugugugugugugugugugugugugugugugugugcaguucaucucucuaucugucugccuuucucuguuugacagguuaggaacauauggaaaacaggggauaggaaccaaaaacagagcaaaguacaaagguucccuucuagcccaaguacagaacagacaaacccaacccgugucaucugauuagaugggguccuuuuucacacugagacucugaaauaaaauaaauaauaaacaggauguauauuuagauguuuagaauagagacuaugaaaauguaaagaugaaaaaaaaaaaagaucagguaggauagacuguguggacaaacaggacaaauagaaaagaaacggaguguggacuaauuguggagggaaagaagcaucauguguaagcacugugcuuaucagauccacaaacaaucugaguauuuaacuugaaacauuuuuaaaaacccagcaugucuuugcugcuuuagccuuuucuuuaagggugauuuucauccaugggaaacuaguguuugaagcugaacucgggcuaucugucacacucagguuaucucuagcccguuuuuaugguguguucauugccgucuguaaagucugugagacaagugaaaauuccagcuggcugagagacauaauuuacuccacaaaugaaguuaugcuauauauacacaagauaaaccaauagcugcuagauuuauggcaagcuguuauaauaacagauuaaaaaaaaaaaaacccaauucaaaccuuaguuacucuuucaaaagugaaaucuuuaucuuguuuagaaaugauuuacuccuaguacccuagaagcuaagccaacuacaggcagaaaauaagcacauucauauccauaucaauaucaauuucucauuaaaaaaggauaaaaugcccaaauagguagucuauuauuugucuugugaaaucucuaccuuagcuuugaacuauaaaccuucuuacuccucuagaacuuauccuaaauauaagagauaaaucaacagcuucauagauacggggcaaauugccacaaaauagguaaaauguauaaacagaagaugugcgaugucaaaauccugcuuaguguuaauacagaguucugucacuccacucugaacuaaaaauggugguaaagcaagagaugauagcuccugagcacucuucaaaaauggauaaaauguuccaauacaaagagcagcuaguuaccuagugaagugaacgaugcauaguaacacggcguagcuucacucacccuugugaaaagccggcacaaaauaauccacacgggggaaaaaaaucuuaaaagucaccuggauaguaaauaccauaagugcuuaagaucuuaucuaucaaucuaucaguauuaggacauauugguauuuaauguuaguuaaaugcucaagugucaauuaauuuugucuauucacuuaaauauuguuuguucuuucagcuagcaagaaaguuuuaccuaaacagcugcuauugccuuuucccuaggagaacuauaauuugaauaaaguuaaaaaaaaaaaagguguaucaagcauuaaaaagcaucaaggauauugaucagaauuauaucuccaugugauaauccugaggcggggagccacggcucagcucguugguuugaaauacuuagguguuguugcuguucauauaccucaaucaggaaauauuaauuuaauguugcuuauuuuuaaagaaaauuguaaaauuaguauuauuugaugcucaaaauccacuacuuggaaagaaaacaggggaagaaauuaauuugauucaauauuuaauuuugagaaaaaaaaguauauacaacccuauaaaaacccauauucuuuagaucccucuguaagcauagagggaagucuggaagggcaaaccgcacuuugccgacaccagagcaagccaaggaugucacaggugaucuugguugccuuaguaagguaccuucuggaacuuggaccaugagagagaauuacuauuauuacacaaguaccaacaaagccauaucuauuuuuuaggccgucaaucaaucaaaaaauaaaaauacuggcuaacauuuugaaaugaaaaagucaaauaaauuuaagcucugaaagaugggugauuuuuaaaacuugaauuuuccuuacuuuuuagauccauguuuucuguaagugucaguuuuuuaaaagugaacucuuaaaaagcucucagugaacagcuuggugaauuaacuuugagggugaaagaaauugcucguaagcauaugagagucccgcagucaccggaacagggacuguuaaauaaacauuguuuuaaaauccuggaaucagucugucuugcagaaaaggauaaacacuuuuaaauuaaaaguaaugauuauguucgcccaauuuccuagauaaauguccuuugcucuuggaaaucugcacuuauuuauuucuggaggucaacauuuaauuucuaauaaguagauucccaggaaaugaaugaguuuugcuuagugcuaaaaagcuuaaugcuuuguacagcgcaggguccugucguucacaaugggucaaagucuuguuuuuccuuuaaggaaaaaaaaugcugcagaaguauugcugaaauaugcucaguuuuagucuuuaaaaaacaaauauguuucaucugugauuuauaaaucuaacucaguuguagacaauuugauuuuccuuuuaaccuuaacuuuuuugacaaagauuagcaacagauuguuaauuuucucagcaccuaagacuuugagcagcuuaggugggaauccgaauuaagguuuuauuuaacauccuuucccagucaguauuugaaugccuuguuccuuugcaaauuucucuaacaaaacaacaacaacaaacaaacaaacaaaaaaaauuuacagguuuauguuucaagccaaggaaaugcuuggagcugagucucggugaccuguuucaaagguuugaaccuacaguuacugcuccccaaaacauucauucacccacaagauuuagaaacauaaaacggcgcgggguggggggggaagcugaggucuccguguaaaccucacaaaguccguagcugaaggcuuccaaagcccgccaagaacauuggaagcauccacagcuguuuucaauuguucuugcuuucccuucguaacguauuuaguagggcaaugggugcuguuugcagcaucucuggcccccagccaugguugacccugaccugcacaccgccguuuggcucccagaauuucaugauccugcuuccguguucgguaaaaccuaaggaaaaaucagguucgcgccaccaggaaauaugcuuuaaaaaaaaaaaaaaaaaaaaagcgcgcgggggggggggggcuucgaucuuuuaaaugucacauuuugguggucuuuuucucucucaaccagaucccagaaaaugagaaaagauguacaucuuuguguaagagagaaagcagcuggccagacauguccuuugguucacaucuaggccagggagucucaauugugggauaaaacccccauccccaccccgaggggcaacgaccccccaagucuguuucagggaucagaagauguccaccacuaggcugggggggcgaggaggggcgcccuucuuaauggaaacuggagcugaauuccugcccugcuggacagggaggggccgugggggugcagagagaaagagaaggccaggggucaagccuggggagggacccacuuggcccaaaaggugggcugcaggguguccugaaagaggggugcugugagggggaggcauugggcauagagcgggacuagcacccuuugggcacgcccugguaccccggaacccgagugggggagugugaggcggcggccugugggccccugaaccuccaugucgcgcgcaggccacuaaccugucaguaagaaugugccaguggucgcggggcucaucuugagugucccccgacccuuucccguccaagcacaagggucucccagcucccaccaccagaauaauagcauucuuggccugccuaagccaaccguccucgauccuccccuccccucccuuucuuuuuuuccucccagcuuggccaguucagcaucgcgcacccccccuuccugagcccaugcugccccuagcggcgggccaaagcagugcaugccgcgcccccaccccaucccccaaggcgcccgcccacgcgccccccuccgcccccgcugcucgcgaagcacgcugggauuuggcgcccccccuccuaggaucucucuauauaaggcaagcaguccggacucccgauacacgcguuuccaacuugaguuggugugugucgaagaauccugaccaacuacgaccuggggagagcagccaaccgagaagguccaccgagccucgccuaggucugcugcgcgggcugcgguccggagccuucuccggaccgcggucacccaguggaccgggccgucgcgggaccccucauccuucguggcaucgcagaggaauccucguguggugaguaugguuaggauuuuuuuuuuuuuuuuaacuccaagaaaacggucacacgcaauccccguuuuacaucgggagcugcgggagauaaaaguagcgccccccaaaauaucuccucgcaaauuuugucaagccuucaguggccagauccugagacgagagcguggaaagcaagucuucacggcuucggguccgcgaauucgguuuccacgacucgcguccagaaauggucgguagacacaugagcugcggacagcgaugagcugcagacgcacaugagcuacugaccgaauugugaugagcuccccaaauacgcugcaaagugacuggcucugcacucuuaagugccgcgcuacgaacggauugcacugcagacggccgcgucuugcgcugugauaaacuaacgggcgcuucaugcgcuacaaaauccuaauaggcgcuucaugcgcuacaaaauacucauaggcgcuucaugcgcuacaaaauacucauaggcgcuucaugcgcuacaaaauacucauaggcgcuucaugcgcuacaaaauacucauaggcacuucacacgcuacgaacugaugggcgcuucaugcgcuucgcuguacuaaugggcgcuucaugugcuacgauguacuaaugagcgcuuaaugcgcuucgcuguacuaaugggcgcgccaugcgcuucacuguacuaaugggcgcuucaugcgcuucagcguacgaacgagcaaaugaaacgggcgaacaggcgaaccugugaacggggcgaacggggcgcuucaugcgccacaaaccagcccgaacuacggugauacccaaaaccgauucguguuucacguauucaauuuggaaagcugcaggagaguaaccaaacgcaaaagcgcaacaagagugaauuuagaaaaugcgcuacaaacugcggcacaggcauaagaccugcagccucuuaagugacacagaaaguagcguugggaagacgagagaacguaucucuccuuggugaggggacaacacaguucaccuuucgggucaaaacuggcuccguuuuccugucggacggcuaucugcaugauggugguggugcuggugguaaacaaaauggagcccugggaggccaaaauugguuuuaacauucugcccacguaacuccugcuuauggcaguggaguggaggggugcuggauuuuggagauggcggaauggccugccuugucuaguggugauugauugaggugacggugacggugcacuggacuuggggacacgaauggguguccagcaacaguuuguggaaacuguccgguuuucugggugggcacgaagccaaggugggaggugggagaugaugggaggugggagaugaugggaggugggagaugaugggacggugggaggugggggauucacucuugcugcacggaagggaucuggugguugggagcuggugggaggggucuggggagguaggggggcggggggaggcaugcagucauucugcagcccuguuguagccagucucagaccugccccgcccaucuagccuugccucaucugcagagaggccgcgcgccucgccugucgcgcgcuuuuccagaacaugcuuccacaggcccaaccucccaagugcugacgccuuagagccagccuaccugguccccacccccaaggcccgccuccucugagguggccugccuagcccccgcccccaaggccccgccucucuuacuguucagcuccucccagagcuccuccaagguggcccagagccccgccuucccccagccugcuugcgccugcgcaaugcgggcugcaaccccucccuucagguuugccuccagugcgcaugugcgccucugccugucugagccuggcugcacagccccgccucccugcgguuucucuguugcgcgguuuuauuuuuuguccacaggugucuaguaaauagaagaauaauaagaauaauuaacaacaauaauaauaaguauaccuaacaugcauaagcacuuuuaauaagugcauugcauuauuaaauaaaaagaucccacaauuaaaacuccugauagugggggauaugggaacuuuuaaaaaggccuaacugaugccuugaagcaaugaaggcaauuacuuauuuuaaauuaaaaauuaaauuuaaaaauauuuucauauuuaauuauuugaucaagacaccauuggacuuccuggaauuaaaugcuuuggaaaauacaaagccagaggugacuagcacuguguuucuuaggaguuuucaggggcuuuagugucauggcuuggcuucugagagagauguuuguuagaauagaaaagguuugucauuguuguuguuguuguuuuuguuauuucuuaaacauucuaggugauuagcccuggcugaccugccuacauauaguaaagugugcuuggcacauaguaaggauuuauuaaauguguguuaaauggccagaauaaauuaauuauucauugucuugcugcgggacuucaaguuuuuugaaauuuuguuccuuuuucuuaaggagcuuugcuguccugaguugaguugcuggcccuuuugaaaacacauuuaaaaguuucuuuuuaaaaaaguaugguuuugaacuucaguauuguaagcuguaauuauaauaugaaccaacuaaauuauauuccaaauaacuagcuuuuuucauaaaaagcuaauuauuuguuaucccaaguaauuagcuuuuuucauaaaaagcuaauuauuuggugucccaaguaauuagcuuuuuucauaaaaagcuaauuuaaauuuggggcaaguggguuauuaaugcuacauauugacauuucaaauucaugugauauaacagggugguuacauugcaggacagaaaugguuacaacuggcuuaauuaaacaucuguguaauuuacagagaagccaaauagaaauguuucuaaauuaaugaagaaauuaaaaaaaaaaaaucugguuccauauuauuuacuaugagccagaguuuuguuaaagagagaaauagggggcuuuugcucccccaaucuccugccuuccuagugccccucccuaguguauaacuaucugugggaaauauaugcuuauaauuacagcuugaaaugcaugcuuugcuuugggaauuuuaucugcauauuaaagagauucaaaacauuggaaaauauaugcaaauuacauuucacagauaauucacauaauauuaagaaaaugagauauauaaaauuucaaagcaacuaaaaguuccuuaaugguguuucauuucauaaugagacauuuacauaugauuuacuguuguugcucuuuguguugggggaauuaaaaauacuuugaagaagucauuguaaaggguuaauaauuaaucagauguauuuauuuauuuauucuuaacugauuaaaacuuaaugaucauauaugaagaugguccucucucaagcagcuggcuuauacagugugaacuuucaguucucaggaaugagaucucagcagccucauccccacacccaguccagcccuuuaagagggguuuugaggagccccaauuuuuaaaucaaauuaaaaugaaggcaaagugcuccuugccugucaucaaccuguccuucccuacaguaaacauugucauuacuuguuuaugguuacuguuaaccaguuugcccaauaccuuauaacuucuuacugguuaaacuacuuugggguaguagaguccuaccccaaaauuucaagcccacccccacaggccuaagccugaggccuagaaguggugaaggucacagaucuucaacuggugaccucacaagcuaaauaaggcacuuaauuuguuuaacuagcauuauauuauuaaaaaccaaaagcaaagccccuugaauagcuuggugggaggggcacaggccgaguauaguccccccgccccccaucaccuuaacuccaagcucaccuuaaaugaucuuacugagcauagugauuguuugcagcuuucccucgcaguuucggaccuauaguuaggggucuuuuauaggugauaauguccaccagaccuggcuucaauaaaucucaccccaguagggcaugcaccuuccugaccugagucaggcuguaccaggccaugcugagaccaucuuaaggaagguuuuaauuuuuauuuugaaguugucauucuuuucuagaugacagaagucacacuuuagucaccuguguguucugcuuauuggaaaggccauaggaacaacuuaggacaaaaggaaaaugucugcagaugguuauggcaggggaggggccuaaaggauggggcggggguggggguggggccuguacuuauuaagaaagcagggggaugggacaaaggugaugaacaggugucaugugggaugucaguuuuccucuauuuuuuaaaauauucaacagguuaaaauauuaucuaacuuugcuaauuaacaauuuuuuaucuuuuuguuucauggaauuuaacuagugcccauuuugccuugauugguaaaagaaaaaaauuauuuuaaaacuuauguuuguucaaaaguuuaaagcuuuauguccuuaaacuuuuauugagcuuuuuaaauuaaaaguuuguaacuauuaaaaaguuuuaaacuuuuugaaggaaaacaacuuuuaaaaguuucuaaagcuuuaagcuuuaaacuuaaaaguuguaaguucaauaaacuuuuaaauucuuuaaaaaguuucuagacuguccaauuacaaaguuuauacuuucuaaagauuuaagcuuuaaacuuaaaaguuguaaguucaaacuucuuaaaaguuuuuaaaagccuucaauaaacuuuguuaaacuuuuuaaaaaguuugcuagaccgaccaauuacaaaguuuuuaaaacuuuaaaguuuuaagcuuuaagugggaacuugcuuuuuuuuuuaauuuaauaaacuuuguuaaacuuuuuaaaaaguuugcugggcugucuaauuauaaagauuuuaaauuuuuuguucuuuacuauaauuauuuaaauuuugcuauuuugcgauccuuacaaauacauaaguauuaaucacucuuaauugcaccuaacccuauuucucaggaaguacauagguagucacugugcugugauugcacuauaaucauaaugaaaacauuuaaacuacucuuccccccccccacacacacacacaguuaccuucuuagaguucaugcucaguccaccuuaauuuuacaagccuuuggguggggccauaaaggcuacauacugucaaccuuuaaugcugaugacguucuguauuucuuuuacugauaaaguaaaaauuuaaaguaucuuuagauucaggaugcccaaguugcaauaguuauagcuccuccccacuuauacagaaaguagcuuucuguuauguauguaauaaccuuauuaguuaacaguugugauugagugauuucuaccuauguuaucuuuuuuaggguucuuuuuuucuuuauuaaauauuuuauuuguuuacauuucaaauguuuccccccuuccuggucccccaccccagaguucuucaccccaucccccuuccccuuugccucugagaaagugcucccccccacccucccacccaccacccccuacccuuuucucucacucccuacccucccacccccuuaccuauguuauguaauuaaaacaugaagaauuuaaauugugcuauuaucgggcauuuuuuuaaaaaagauguccuaguguauagcccauuucuuccuaguaggcaucaauuaauauuuguuuaauaauuuccuaauaaaguaaacugacauccccaugagcuguucaaugcuuuuuuaucccauagagaauucuccugaggaaguuaauuuguggucauaaaagcaauuagauaaucuugugguuuuugugauagugguuguugugacuuaauauucaggcuucauuguugagggugugccucugaugugacauuuggccaacugcuuugauuuuucggagcugaugaguacaggcauugugguuuuaauaccuaccucucaugugugugguuucuuauugauuaggguguuauuuucuccuaagguucuuauuaguaaaagguaugauguuggaaucaauuugcaugauuuugaaguuauuuugcauaauuuguuuucuacuuaucugccuuggaaguuucuugcugugugaccucuauacccaaacaaacaaauaaaacccaaacuuacuuaaagguguaugaaaucugagaaaucucuggugcucuuuuccaugaagagcuggcacugauacaugaaaggacccagcgugccaggguugccaucgaacuucucaggaaggucuucaaggcagcauaaagguguggcgcugcugaaggguuauauuauuaauuauaaagagcaagugaaggaguauguguuccacuauuuugugaaugaucaccucauccucuugaggguguguauucuguugacuaauuaucaggggcuauuugaacaccuaaaucccugcuaauagcgacugcucugaaugaauauguugaauguaugcuucuguugucauuuacaggaacaggcggguuuuaagaaccaaaagacgccaaccacgagggucccaggauccagggcucccuccccaggggagugaagccccucucaccgcagccauggcugcugcgggugguuccuccaacugcccgcccccucccccucccccuccucccaacaacaacaacaacaacaacaccccaaagagcccaggcgugccugacgccgaagaugaugaugaacgcagacacgaugagcucccugaagacaucaacaacuuugacgaagacaugaacaggcaguuugagaauaugaaccugcuggaucagguggaguugcuugcacagagcuacagucugcuggaucauuuagaugacuuugaugaugaugaugaagacgaugacuuugauccagaaccugaccaggaugagcucccugaguacagugacgaugaugaccuggagcuucagggugcugcagcagccccuaucccaaacuuuuucuccgaugaugacugccuugaagaccuuccugagaaguucgauggcaacccugacaugcuggguccuuucauguaucagugccagcucuucauggaaaagagcaccagagauuucucaguugaccgcauccgugugugcuucgugacaagcaugcugaucggccgugccgcccgcugggcuacugccaagcugcaaagauguacuuaccugaugcacaacuacacugccuuuaugauggagcugaagcaugucuuugaagacccucagagacgugaagcugccaaacgcaagaucagacgucugcgccagggcccugggccuguuguggacuacuccaaugcauuccagaugauugcccaggaccuggauuggacugagccugcccugauggaucaguuccaggaaggucucaacccagacauucgcgcagagcugucucgccaggaggcccccaagacccuggcugcucugauuacugccuguauucacaucgagagaaggcuggcucgugacgcugcugcaaagcccgauccuucacccagagccuuggugaugccuccaaacagccagaccgaucccaccgagccugugggaggugcccgcaugcgccuguccaaggaagaaaaggagagacgccgcaaaaugaauuugugucucuacuguggcaauggaggccauuucgccgacacguguccagcgaaagccuccaagaauucgccgccgggaaacuccccggccccgcuguagggggaccuucagcgacagggccagaacgaauaagguccccacccuccgaggcuucgacucagcaccugcaagugaugcuccagauucauaugccgggcagacccacccuguuuguccgagcuaugauugauucuggugcaucuggcaacuucauugaucaagacuuugucauacaaaaugcaauuccucucagaaucaaagacuggccagugaugguggaagcuauugaugggcauccaauugccucgggcccaaucauuuuggaaacccaccaccugauaguugaucugggagaccaccgugagauacugucauuugaugugacucagucuccauucuuuccuauuguccuaggaauucguuggcugagcacgcaugacccucacauuaccuggaguacccgcuccauugucuucaacucugauuacugccgacuucgcugccggauguuugcacagauaccuucuaacuuacuguuuacagugccacaaccgaauuugcauccguaucuacuucaucaugugcauccgcauguccauccgcauaugcaucagcaucugcaucagcaucugcaucaguuucugcauccagauccgcaucaguauccgcauccggauccgcauuaucaucaucaucagcaggcggauaugcagcaccaacugcagcaguaucuauaucaguauuuguauuaccaucuguauccgguuaugcaccaccaucugccuccagaucagcaugagcaucugcaugaguaucugcaucaguaucugcaucaguaucugcaucaguuucugcaucaccaucugcauccggaucugcaucaguaucuguaucaguaucugcauaaccauaugaauccggauccacaucaccauccucauccagaucccccucaggauccacaucacccuccacaucaggauccacaucagcauccggauccccaucaggauccuccacaucaggauccacaucagcauccggauccccaucaggauccuccacaucaggauccacaucagcauccggauccccaucaggauccuccacaucaggauccacaucaggaugcacaucagcaucaggauccccaucaggaugcacaucaggauccacaucaggaugcacaucaggauccccauauggauccacaccugcaucagcaccagcauccgcagccgcagccgcauccacaacagcauccuaaccauccucagcagccaccauucuucuaccacauggcuggauucagaauuuaccacccuguaagguauuacuauauucagaauguguauacaccuguugaugagcaugucuauccgggucaccgggugguugacccuaacauugagaugauuccuggagcgcacagccugcccaguggacauuuguacucaaugucugagucugaaaugaaugcucugcgaaauuucguggacaggaauguuaaagaugggcucaugacucccacuguggcgcccaauggagcccaaguccugcaagugaaaagaggguggaaacuccaagucacuuacaauugccgagcuccacagaguggcaccauccaaaaucaguaccuacgcaugucucuuccaaauaugggagacccugcacaccuggcaagcuauggugaauuuguccaaguuccuggcuacccauauccagccuauguuuacuauacaagcccgcauaugaugacugcgugguacccaguaggacgagauguacauggacgaauaaucguugu

SEQ ID NO: 10 - RNA, 33097 nt, Mus musculus
cucuucuuuuuuuccuacaaccaugauggacaaaauaaaaucacauuucuauggcgagcuauagaacauucuggagacaucucgaaaacagacuuaaaacccagugccuccaguccugucaaaucccaccccauugccuccuggggcuaagaagguaucugggcagguccuccagcaugacucagggucagggacuucuggcgacuugcuggcgacugagagucgccuuuuaccucuuugaagagaccagcugcaaugugaauuccauuuagauucaucuucccugggaucucaugaacucguagguauuuauccuuaggaaagaaugcaaucaaagggggcaaagucugcccgugugcauacggcuccauuuugcacuaagcacuguuucaagacuaggugaaaauuaaauugcgauuuuuuuuuuuuugaaggaguaagagagaccagagauuacuuuuuucuccagcuaagguuucuuguuugcucaaauaacuuagaaggagaauuguucuuuugcuacacaguucugucuucugugggugaaauugugggugaaaaagugaaacacggggaccuccaacaaaaggcauccacagcggcuauaaacaucauuacugucuaauguccucaucugaaagagggaggauuguuucccaaugaagacggugggugaaaagcagaccacaaaacaccgugcacuaaaugaaauccagagugcuagugcgaucuaguggaaagggauuaaaaaacagagggucccugugagccacugggguaggggcaugaagcagcaggaaagauuccuaugcaaauuugaaaauucaguaacacuacacucguucccauuaggaagugucuaaaggagucucacaucacaugcuugccuuaaacggccauuaauugucuauguuauagaugucaugcuuucuagcuggaaugcacccuaacacuuuaaucaggaagcuguauuuuacaaaguaccuucucacaucccuauugucaccuuaucaaggccacucacuggcuacagcuuggacucuuaauugucuuggcaucuuuccauauuuuauucacguggaacauacacagacauacaugcgccaugcucugccuuacacgugauucucuccacuucucauuuagggcacacuugcacaugauuacauguuaaaacugcagcgcuuucaguccugugacucagucauaguuuauugaccaucuccgugaauucaaccgcaccacacucagacuggagaucgucccuuuccaaugugauccccuuccagcguuacacaggccaugaggcagaggacagaaaaauagcaaacauaaccuccuggcuaacagccucaaauucaauccaauagccuccgucugauuucaccccucaaaaaguuccuucucuucucuuuccccuaccuccucgguuccauuagccuacaaggucacuaucuccaaccuggauuuaaaccccuccaguagcaaaccauucagaccuuuucuucacacagcaguuagaguacucuuuuugaaaugcaaaucuggucuuguccugcuuaaccccccucugagaguucccauugguguuaguacaaagaugaaccucuuuaagguggucuacuagguuggggaagauuggcuccuugacccugcuggcagcuuccuucccugucucuuucuucucucagcacuuuuuauuuagcaagcucuggcugcccugggaucucugcagaccuccagggucacaagcaccuuuccugauucaccucccugcccuuuauuccccuucccuccuccgugcuuccuugggagaaaccuccaccuuucuucaagucuagauaaauucuuuacuaguauuugcgguauuuagcuucguuccgggagaguacaaucuuauguguaauuauuugauuaaucuucacacuguauaauccugaaaagagaaaaaacuugauucaucuuugucaacucaauaugguuaaagaaaaaaaaaagugggauagcucagaccaccuauuacccagcaucuguuagugucucaaaaacaccuaacacaccccuaaaaguauaaaguaauucuucauucuuaaaguuaccagguuuuuuuucuucugguuuuucauuauuauuauuaucaacaacacaguaaacacccuugucuguaucuuugaacacucccaccaacuuacacguaggcuaaacauucagaagaaaaaccgcuagacaaaaaaaaaaaaaaggaagaaagaaagaaaaaaaaaguauaauucaaauucugauaagcuauccagcagccuacuguggcacaggccuuugauuagaaucaacuguguaacgacugaaaauaaaagaugucagaggagcuacauugauuaacuguugcaugggagaaaaaagccgccgguaucauuuuaccgccuagugagaaacaccgauuuguuaaagagagaaaacaaaaauccuuagagcccguguuuccuuugcuuuugcauucagagguaaaagagaagcuuuauuucuuggcauacugcugaaaaagacagggaagggaaacacccccgauauaacugcccuaggaaaauuaacugugaucucuuucaaauucagagugaaccccaaucuccauaauaaucaaagugguggccagaugaaugaguaaaagggcaaagaaugggaaggaauucacgccaaagcugccuaucucccaaacaguuuugaaaccagccguuccauuuaucugaaaagaaagucuguccuuccuugucacaacagaugcugggugauucccgagguauaggcugccaaagagcuauucuaaaugucugauuagccuaagguaauuagguagaaagugagccguguuaaagaugauucuuaaauaaugaaauacauuuaagucacugacauaaauguuauauuaaaauuccuaagugaagauuuaaaagacaaaaacaaaucaacaacaaggacaaaaauuugaccagagugaccaaagaagaaaaugguauagccuuuccuaauacaucauuaaugucucagagcauagcaguggucaugccagcaacaaauauccauucagaagcugcacagucauuucccaagauaaccagguuuuaaagauuaaacauugggauaauuacuuugugguuuagggacaugaguaagcccugcacucaaggaauugcaaguagccgccugcggaucaggugagcuuugacaagccagaaccucacuuuggagaguuucucuccugaaaauaggagccgagccaaagaaugucuguggcauccccagcaacugggaagagagccacggcaagcggcuguguguauuauuacaaccucacagaagugcauggcacuguuacaaaacgaauaaaaacagugagugagagagagagaagaaaguuauuuaagaguaaaaauccacuucuuguagucagaaugacuguggcucuccugcugacuucuaaccacuggaguagagaagaaaguuccaggucuuuggcaggagggaaagcaguaggccagagugggucagcaaagacagcagacuugccucccuuuucuucacaucucugacagagccccucaauaguuugcaagguucccaauuauuugaugcaaauucuaugaagucagaagugcugcucagaaaaagagguccuggauccauuuugaacaaacacgucucccaaguuagauauggcuaucaacauaaacgaucaaugggcaggugcacagauaaagaagaaaaaucucuuccaggucauguuugccaucguaagaauguguucccaaggcaggcagaaaccaggcucauccuaacaagcugccaacgugcacaggcuggaagcuacuuuguugguuaagguuuuagggguuagugaaaagacaaaagucuucaacuguauuauaaagugauagauucggggugggguggggaagaggggcuacugcagugagaucugucucacauucuucugaggaagaggaaggcaagcaccaagcuaucuuggggaccagggacaggcaucuugccugccagguaacccuggaguccccagccuucaccaccauuaggcaggagaaaccugcaagacacccuugacaagaagguggcucugggaagacaguuaagacuaaggggcaugucagggaggaaaugaucuugccuuuuucucagauuuucaaguuugcagugcagaggagagaaauauaaacuuacaauucauaggaccauucguuuuagagaguuuaucaaaggagagagagagaaaaaaaaagcaugacauguuuuguauaucgguuacacuaauauguuccuauggucuucaaauccuccacugcaaaagaggugaauguuucugcucgucuagaagaauagcugaaguugauuuuccuguuggccugaacugguagagaggucuccucgagcugagucuaucugcacguuugcccacucacucugauucugcccucugaagcaaacaaaagagaguuuacuucaaacuaaacauuuccagacccuuugagaauacccacugugauagaguugcuagacacucaccaaccccacagacuguuuugcaaguugucuaauuugucaacuacucucuccaaacugacgaccagaaaugagcaugaugcuacagaugggguugaacagagcaaggucuaucauuuuuauguuaacaucacagucuaaccugcauguuuauuuuuauaaggcacaucuugccauaacuucucccugaucuuccuaaagaacaagaacaacacacaagucacucugcuucucuucaugucagugaauuauaguucccugauugcuauauuuuguacuugcagcuaagcacuaaacucaaaugguauuuaauccuaaauucuguuaucuguuuguaacagucacccaugaauuguaaagcaagcccucuagaucuuugucaaaaaucaugugugccaacauuaaacaagaagugacccauuguaaagaucugugaccuuacccagaucucucccuucuucaaacccaguaaccuauacacaccuggccagcacaggucccagccagucuccagcuuaugcaacaauccugcuaauuaauuugcagacccucugaacaucauccgccuacagcccaccaacugcuucccugaaagcaagacucacuuaucuuucaaaauaagacguaaaggacccacacggcuuagagguacaagucuauggaaauauacauauacacagagcaaagcccaggaaggcaagagcagcagugcaaaugucuguggcaggcugugagacuguuuggguuuugcuguuaucguuguuuaauucauugcuaucuuuacuacaguuacacaucuuuaaaaaaaauuaacaaugaaaaucaugugcagagaauuuggcuuggacacaguugaugucaaauggcuuuagaccauugagaaucucuuuccaaccagaaaacgcuaagcagaaaaauagucucugauaggacuuguugaucccugggagaaucagccuugcuuucuuuccauuagcauugucuucuuucucuuuccccacucuuuccuuuuuuucaacgccaaauugcuauuuagacuuaauaagcugauaacauaguuaagaguagacuagaaaacaagauacggcauuuuagaaaaagaagucuggaugaugugcccgcgcacccaugugugugugugugugugugugugugugugugugugugugcaguucaucucucuaucugucugccuuucucuguuugacagguuaggaacauauggaaaacaggggauaggaaccaaaaacagagcaaaguacaaagguucccuucuagcccaaguacagaacagacaaacccaacccgugucaucugauuagaugggguccuuuuucacacugagacucugaaauaaaauaaauaauaaacaggauguauauuuagauguuuagaauagagacuaugaaaauguaaagaugaaaaaaaaaaaagaucagguaggauagacuguguggacaaacaggacaaauagaaaagaaacggaguguggacuaauuguggagggaaagaagcaucauguguaagcacugugcuuaucagauccacaaacaaucugaguauuuaacuugaaacauuuuuaaaaacccagcaugucuuugcugcuuuagccuuuucuuuaagggugauuuucauccaugggaaacuaguguuugaagcugaacucgggcuaucugucacacucagguuaucucuagcccguuuuuaugguguguucauugccgucuguaaagucugugagacaagugaaaauuccagcuggcugagagacauaauuuacuccacaaaugaaguuaugcuauauauacacaagauaaaccaauagcugcuagauuuauggcaagcuguuauaauaacagauuaaaaaaaaaaaaacccaauucaaaccuuaguuacucuuucaaaagugaaaucuuuaucuuguuuagaaaugauuuacuccuaguacccuagaagcuaagccaacuacaggcagaaaauaagcacauucauauccauaucaauaucaauuucucauuaaaaaaggauaaaaugcccaaauagguagucuauuauuugucuugugaaaucucuaccuuagcuuugaacuauaaaccuucuuacuccucuagaacuuauccuaaauauaagagauaaaucaacagcuucauagauacggggcaaauugccacaaaauagguaaaauguauaaacagaagaugugcgaugucaaaauccugcuuaguguuaauacagaguucugucacuccacucugaacuaaaaauggugguaaagcaagagaugauagcuccugagcacucuucaaaaauggauaaaauguuccaauacaaagagcagcuaguuaccuagugaagugaacgaugcauaguaacacggcguagcuucacucacccuugugaaaagccggcacaaaauaauccacacgggggaaaaaaaucuuaaaagucaccuggauaguaaauaccauaagugcuuaagaucuuaucuaucaaucuaucaguauuaggacauauugguauuuaauguuaguuaaaugcucaagugucaauuaauuuugucuauucacuuaaauauuguuuguucuuucagcuagcaagaaaguuuuaccuaaacagcugcuauugccuuuucccuaggagaacuauaauuugaauaaaguuaaaaaaaaaaaagguguaucaagcauuaaaaagcaucaaggauauugaucagaauuauaucuccaugugauaauccugaggcggggagccacggcucagcucguugguuugaaauacuuagguguuguugcuguucauauaccucaaucaggaaauauuaauuuaauguugcuuauuuuuaaagaaaauuguaaaauuaguauuauuugaugcucaaaauccacuacuuggaaagaaaacaggggaagaaauuaauuugauucaauauuuaauuuugagaaaaaaaaguauauacaacccuauaaaaacccauauucuuuagaucccucuguaagcauagagggaagucuggaagggcaaaccgcacuuugccgacaccagagcaagccaaggaugucacaggugaucuugguugccuuaguaagguaccuucuggaacuuggaccaugagagagaauuacuauuauuacacaaguaccaacaaagccauaucuauuuuuuaggccgucaaucaaucaaaaaauaaaaauacuggcuaacauuuugaaaugaaaaagucaaauaaauuuaagcucugaaagaugggugauuuuuaaaacuugaauuuuccuuacuuuuuagauccauguuuucuguaagugucaguuuuuuaaaagugaacucuuaaaaagcucucagugaacagcuuggugaauuaacuuugagggugaaagaaauugcucguaagcauaugagagucccgcagucaccggaacagggacuguuaaauaaacauuguuuuaaaauccuggaaucagucugucuugcagaaaaggauaaacacuuuuaaauuaaaaguaaugauuauguucgcccaauuuccuagauaaauguccuuugcucuuggaaaucugcacuuauuuauuucuggaggucaacauuuaauuucuaauaaguagauucccaggaaaugaaugaguuuugcuuagugcuaaaaagcuuaaugcuuuguacagcgcaggguccugucguucacaaugggucaaagucuuguuuuuccuuuaaggaaaaaaaaugcugcagaaguauugcugaaauaugcucaguuuuagucuuuaaaaaacaaauauguuucaucugugauuuauaaaucuaacucaguuguagacaauuugauuuuccuuuuaaccuuaacuuuuuugacaaagauuagcaacagauuguuaauuuucucagcaccuaagacuuugagcagcuuaggugggaauccgaauuaagguuuuauuuaacauccuuucccagucaguauuugaaugccuuguuccuuugcaaauuucucuaacaaaacaacaacaacaaacaaacaaacaaaaaaaauuuacagguuuauguuucaagccaaggaaaugcuuggagcugagucucggugaccuguuucaaagguuugaaccuacaguuacugcuccccaaaacauucauucacccacaagauuuagaaacauaaaacggcgcgggguggggggggaagcugaggucuccguguaaaccucacaaaguccguagcugaaggcuuccaaagcccgccaagaacauuggaagcauccacagcuguuuucaauuguucuugcuuucccuucguaacguauuuaguagggcaaugggugcuguuugcagcaucucuggcccccagccaugguugacccugaccugcacaccgccguuuggcucccagaauuucaugauccugcuuccguguucgguaaaaccuaaggaaaaaucagguucgcgccaccaggaaauaugcuuuaaaaaaaaaaaaaaaaaaaaagcgcgcgggggggggggggcuucgaucuuuuaaaugucacauuuugguggucuuuuucucucucaaccagaucccagaaaaugagaaaagauguacaucuuuguguaagagagaaagcagcuggccagacauguccuuugguucacaucuaggccagggagucucaauugugggauaaaacccccauccccaccccgaggggcaacgaccccccaagucuguuucagggaucagaagauguccaccacuaggcugggggggcgaggaggggcgcccuucuuaauggaaacuggagcugaauuccugcccugcuggacagggaggggccgugggggugcagagagaaagagaaggccaggggucaagccuggggagggacccacuuggcccaaaaggugggcugcaggguguccugaaagaggggugcugugagggggaggcauugggcauagagcgggacuagcacccuuugggcacgcccugguaccccggaacccgagugggggagugugaggcggcggccugugggccccugaaccuccaugucgcgcgcaggccacuaaccugucaguaagaaugugccaguggucgcggggcucaucuugagugucccccgacccuuucccguccaagcacaagggucucccagcucccaccaccagaauaauagcauucuuggccugccuaagccaaccguccucgauccuccccuccccucccuuucuuuuuuuccucccagcuuggccaguucagcaucgcgcacccccccuuccugagcccaugcugccccuagcggcgggccaaagcagugcaugccgcgcccccaccccaucccccaaggcgcccgcccacgcgccccccuccgcccccgcugcucgcgaagcacgcugggauuuggcgcccccccuccuaggaucucucuauauaaggcaagcaguccggacucccgauacacgcguuuccaacuugaguuggugugugucgaagaauccugaccaacuacgaccuggggagagcagccaaccgagaagguccaccgagccucgccuaggucugcugcgcgggcugcgguccggagccuucuccggaccgcggucacccaguggaccgggccgucgcgggaccccucauccuucguggcaucgcagaggaauccucguguggugaguaugguuaggauuuuuuuuuuuuuuuuaacuccaagaaaacggucacacgcaauccccguuuuacaucgggagcugcgggagauaaaaguagcgccccccaaaauaucuccucgcaaauuuugucaagccuucaguggccagauccugagacgagagcguggaaagcaagucuucacggcuucggguccgcgaauucgguuuccacgacucgcguccagaaauggucgguagacacaugagcugcggacagcgaugagcugcagacgcacaugagcuacugaccgaauugugaugagcuccccaaauacgcugcaaagugacuggcucugcacucuuaagugccgcgcuacgaacggauugcacugcagacggccgcgucuugcgcugugauaaacuaacgggcgcuucaugcgcuacaaaauccuaauaggcgcuucaugcgcuacaaaauacucauaggcgcuucaugcgcuacaaaauacucauaggcgcuucaugcgcuacaaaauacucauaggcgcuucaugcgcuacaaaauacucauaggcacuucacacgcuacgaacugaugggcgcuucaugcgcuucgcuguacuaaugggcgcuucaugugcuacgauguacuaaugagcgcuuaaugcgcuucgcuguacuaaugggcgcgccaugcgcuucacuguacuaaugggcgcuucaugcgcuucagcguacgaacgagcaaaugaaacgggcgaacaggcgaaccugugaacggggcgaacggggcgcuucaugcgccacaaaccagcccgaacuacggugauacccaaaaccgauucguguuucacguauucaauuuggaaagcugcaggagaguaaccaaacgcaaaagcgcaacaagagugaauuuagaaaaugcgcuacaaacugcggcacaggcauaagaccugcagccucuuaagugacacagaaaguagcguugggaagacgagagaacguaucucuccuuggugaggggacaacacaguucaccuuucgggucaaaacuggcuccguuuuccugucggacggcuaucugcaugauggugguggugcuggugguaaacaaaauggagcccugggaggccaaaauugguuuuaacauucugcccacguaacuccugcuuauggcaguggaguggaggggugcuggauuuuggagauggcggaauggccugccuugucuaguggugauugauugaggugacggugacggugcacuggacuuggggacacgaauggguguccagcaacaguuuguggaaacuguccgguuuucugggugggcacgaagccaaggugggaggugggagaugaugggaggugggagaugaugggaggugggagaugaugggacggugggaggugggggauucacucuugcugcacggaagggaucuggugguugggagcuggugggaggggucuggggagguaggggggcggggggaggcaugcagucauucugcagcccuguuguagccagucucagaccugccccgcccaucuagccuugccucaucugcagagaggccgcgcgccucgccugucgcgcgcuuuuccagaacaugcuuccacaggcccaaccucccaagugcugacgccuuagagccagccuaccugguccccacccccaaggcccgccuccucugagguggccugccuagcccccgcccccaaggccccgccucucuuacuguucagcuccucccagagcuccuccaagguggcccagagccccgccuucccccagccugcuugcgccugcgcaaugcgggcugcaaccccucccuucagguuugccuccagugcgcaugugcgccucugccugucugagccuggcugcacagccccgccucccugcgguuucucuguugcgcgguuuuauuuuuuguccacaggugucuaguaaauagaagaauaauaagaauaauuaacaacaauaauaauaaguauaccuaacaugcauaagcacuuuuaauaagugcauugcauuauuaaauaaaaagaucccacaauuaaaacuccugauagugggggauaugggaacuuuuaaaaaggccuaacugaugccuugaagcaaugaaggcaauuacuuauuuuaaauuaaaaauuaaauuuaaaaauauuuucauauuuaauuauuugaucaagacaccauuggacuuccuggaauuaaaugcuuuggaaaauacaaagccagaggugacuagcacuguguuucuuaggaguuuucaggggcuuuagugucauggcuuggcuucugagagagauguuuguuagaauagaaaagguuugucauuguuguuguuguuguuuuuguuauuucuuaaacauucuaggugauuagcccuggcugaccugccuacauauaguaaagugugcuuggcacauaguaaggauuuauuaaauguguguuaaauggccagaauaaauuaauuauucauugucuugcugcgggacuucaaguuuuuugaaauuuuguuccuuuuucuuaaggagcuuugcuguccugaguugaguugcuggcccuuuugaaaacacauuuaaaaguuucuuuuuaaaaaaguaugguuuugaacuucaguauuguaagcuguaauuauaauaugaaccaacuaaauuauauuccaaauaacuagcuuuuuucauaaaaagcuaauuauuuguuaucccaaguaauuagcuuuuuucauaaaaagcuaauuauuuggugucccaaguaauuagcuuuuuucauaaaaagcuaauuuaaauuuggggcaaguggguuauuaaugcuacauauugacauuucaaauucaugugauauaacagggugguuacauugcaggacagaaaugguuacaacuggcuuaauuaaacaucuguguaauuuacagagaagccaaauagaaauguuucuaaauuaaugaagaaauuaaaaaaaaaaaaucugguuccauauuauuuacuaugagccagaguuuuguuaaagagagaaauagggggcuuuugcucccccaaucuccugccuuccuagugccccucccuaguguauaacuaucugugggaaauauaugcuuauaauuacagcuugaaaugcaugcuuugcuuugggaauuuuaucugcauauuaaagagauucaaaacauuggaaaauauaugcaaauuacauuucacagauaauucacauaauauuaagaaaaugagauauauaaaauuucaaagcaacuaaaaguuccuuaaugguguuucauuucauaaugagacauuuacauaugauuuacuguuguugcucuuuguguugggggaauuaaaaauacuuugaagaagucauuguaaaggguuaauaauuaaucagauguauuuauuuauuuauucuuaacugauuaaaacuuaaugaucauauaugaagaugguccucucucaagcagcuggcuuauacagugugaacuuucaguucucaggaaugagaucucagcagccucauccccacacccaguccagcccuuuaagagggguuuugaggagccccaauuuuuaaaucaaauuaaaaugaaggcaaagugcuccuugccugucaucaaccuguccuucccuacaguaaacauugucauuacuuguuuaugguuacuguuaaccaguuugcccaauaccuuauaacuucuuacugguuaaacuacuuugggguaguagaguccuaccccaaaauuucaagcccacccccacaggccuaagccugaggccuagaaguggugaaggucacagaucuucaacuggugaccucacaagcuaaauaaggcacuuaauuuguuuaacuagcauuauauuauuaaaaaccaaaagcaaagccccuugaauagcuuggugggaggggcacaggccgaguauaguccccccgccccccaucaccuuaacuccaagcucaccuuaaaugaucuuacugagcauagugauuguuugcagcuuucccucgcaguuucggaccuauaguuaggggucuuuuauaggugauaauguccaccagaccuggcuucaauaaaucucaccccaguagggcaugcaccuuccugaccugagucaggcuguaccaggccaugcugagaccaucuuaaggaagguuuuaauuuuuauuuugaaguugucauucuuuucuagaugacagaagucacacuuuagucaccuguguguucugcuuauuggaaaggccauaggaacaacuuaggacaaaaggaaaaugucugcagaugguuauggcaggggaggggccuaaaggauggggcggggguggggguggggccuguacuuauuaagaaagcagggggaugggacaaaggugaugaacaggugucaugugggaugucaguuuuccucuauuuuuuaaaauauucaacagguuaaaauauuaucuaacuuugcuaauuaacaauuuuuuaucuuuuuguuucauggaauuuaacuagugcccauuuugccuugauugguaaaagaaaaaaauuauuuuaaaacuuauguuuguucaaaaguuuaaagcuuuauguccuuaaacuuuuauugagcuuuuuaaauuaaaaguuuguaacuauuaaaaaguuuuaaacuuuuugaaggaaaacaacuuuuaaaaguuucuaaagcuuuaagcuuuaaacuuaaaaguuguaaguucaauaaacuuuuaaauucuuuaaaaaguuucuagacuguccaauuacaaaguuuauacuuucuaaagauuuaagcuuuaaacuuaaaaguuguaaguucaaacuucuuaaaaguuuuuaaaagccuucaauaaacuuuguuaaacuuuuuaaaaaguuugcuagaccgaccaauuacaaaguuuuuaaaacuuuaaaguuuuaagcuuuaagugggaacuugcuuuuuuuuuuaauuuaauaaacuuuguuaaacuuuuuaaaaaguuugcugggcugucuaauuauaaagauuuuaaauuuuuuguucuuuacuauaauuauuuaaauuuugcuauuuugcgauccuuacaaauacauaaguauuaaucacucuuaauugcaccuaacccuauuucucaggaaguacauagguagucacugugcugugauugcacuauaaucauaaugaaaacauuuaaacuacucuuccccccccccacacacacacacaguuaccuucuuagaguucaugcucaguccaccuuaauuuuacaagccuuuggguggggccauaaaggcuacauacugucaaccuuuaaugcugaugacguucuguauuucuuuuacugauaaaguaaaaauuuaaaguaucuuuagauucaggaugcccaaguugcaauaguuauagcuccuccccacuuauacagaaaguagcuuucuguuauguauguaauaaccuuauuaguuaacaguugugauugagugauuucuaccuauguuaucuuuuuuaggguucuuuuuuucuuuauuaaauauuuuauuuguuuacauuucaaauguuuccccccuuccuggucccccaccccagaguucuucaccccaucccccuuccccuuugccucugagaaagugcucccccccacccucccacccaccacccccuacccuuuucucucacucccuacccucccacccccuuaccuauguuauguaauuaaaacaugaagaauuuaaauugugcuauuaucgggcauuuuuuuaaaaaagauguccuaguguauagcccauuucuuccuaguaggcaucaauuaauauuuguuuaauaauuuccuaauaaaguaaacugacauccccaugagcuguucaaugcuuuuuuaucccauagagaauucuccugaggaaguuaauuuguggucauaaaagcaauuagauaaucuugugguuuuugugauagugguuguugugacuuaauauucaggcuucauuguugagggugugccucugaugugacauuuggccaacugcuuugauuuuucggagcugaugaguacaggcauugugguuuuaauaccuaccucucaugugugugguuucuuauugauuaggguguuauuuucuccuaagguucuuauuaguaaaagguaugauguuggaaucaauuugcaugauuuugaaguuauuuugcauaauuuguuuucuacuuaucugccuuggaaguuucuugcugugugaccucuauacccaaacaaacaaauaaaacccaaacuuacuuaaagguguaugaaaucugagaaaucucuggugcucuuuuccaugaagagcuggcacugauacaugaaaggacccagcgugccaggguugccaucgaacuucucaggaaggucuucaaggcagcauaaagguguggcgcugcugaaggguuauauuauuaauuauaaagagcaagugaaggaguauguguuccacuauuuugugaaugaucaccucauccucuugaggguguguauucuguugacuaauuaucaggggcuauuugaacaccuaaaucccugcuaauagcgacugcucugaaugaauauguugaauguaugcuucuguugucauuuacaggaacaggcggguuuuaagaaccaaaagacgccaaccacgagggucccaggauccagggcucccuccccaggggagugaagccccucucaccgcagccauggcugcugcgggugguuccuccaacugcccgcccccucccccucccccuccucccaacaacaacaacaacaacaacaccccaaagagcccaggcgugccugacgccgaagaugaugaugaacgcagacacgaugagcucccugaagacaucaacaacuuugacgaagacaugaacaggcaguuugagaauaugaaccugcuggaucagguggaguugcuugcacagagcuacagucugcuggaucauuuagaugacuuugaugaugaugaugaagacgaugacuuugauccagaaccugaccaggaugagcucccugaguacagugacgaugaugaccuggagcuucagggugcugcagcagccccuaucccaaacuuuuucuccgaugaugacugccuugaagaccuuccugagaaguucgauggcaacccugacaugcuggguccuuucauguaucagugccagcucuucauggaaaagagcaccagagauuucucaguugaccgcauccgugugugcuucgugacaagcaugcugaucggccgugccgcccgcugggcuacugccaagcugcaaagauguacuuaccugaugcacaacuacacugccuuuaugauggagcugaagcaugucuuugaagacccucagagacgugaagcugccaaacgcaagaucagacgucugcgccagggcccugggccuguuguggacuacuccaaugcauuccagaugauugcccaggaccuggauuggacugagccugcccugauggaucaguuccaggaaggucucaacccagacauucgcgcagagcugucucgccaggaggcccccaagacccuggcugcucugauuacugccuguauucacaucgagagaaggcuggcucgugacgcugcugcaaagcccgauccuucacccagagccuuggugaugccuccaaacagccagaccgaucccaccgagccugugggaggugcccgcaugcgccuguccaaggaagaaaaggagagacgccgcaaaaugaauuugugucucuacuguggcaauggaggccauuucgccgacacguguccagcgaaagccuccaagaauucgccgccgggaaacuccccggccccgcuguagggggaccuucagcgacagggccagaacgaauaagguccccacccuccgaggcuucgacucagcaccugcaagugaugcuccagauucauaugccgggcagacccacccuguuuguccgagcuaugauugauucuggugcaucuggcaacuucauugaucaagacuuugucauacaaaaugcaauuccucucagaaucaaagacuggccagugaugguggaagcuauugaugggcauccaauugccucgggcccaaucauuuuggaaacccaccaccugauaguugaucugggagaccaccgugagauacugucauuugaugugacucagucuccauucuuuccuauuguccuaggaauucguuggcugagcacgcaugacccucacauuaccuggaguacccgcuccauugucuucaacucugauuacugccgacuucgcugccggauguuugcacagauaccuucuaacuuacuguuuacagugccacaaccgaauuugcauccguaucuacuucaucaugugcauccgcauguccauccgcauaugcaucagcaucugcaucagcaucugcaucaguuucugcauccagauccgcaucaguauccgcauccggauccgcauuaucaucaucaucagcaggcggauaugcagcaccaacugcagcaguaucuauaucaguauuuguauuaccaucuguauccgguuaugcaccaccaucugccuccagaucagcaugagcaucugcaugaguaucugcaucaguaucugcaucaguaucugcaucaguuucugcaucaccaucugcauccggaucugcaucaguaucuguaucaguaucugcauaaccauaugaauccggauccacaucaccauccucauccagaucccccucaggauccacaucacccuccacaucaggauccacaucagcauccggauccccaucaggauccuccacaucaggauccacaucagcauccggauccccaucaggauccuccacaucaggauccacaucagcauccggauccccaucaggauccuccacaucaggauccacaucaggaugcacaucagcaucaggauccccaucaggaugcacaucaggauccacaucaggaugcacaucaggauccccauauggauccacaccugcaucagcaccagcauccgcagccgcagccgcauccacaacagcauccuaaccauccucagcagccaccauucuucuaccacauggcuggauucagaauuuaccacccuguaagguauuacuauauucagaauguguauacaccuguugaugagcaugucuauccgggucaccgggugguugacccuaacauugagaugauuccuggagcgcacagccugcccaguggacauuuguacucaaugucugagucugaaaugaaugcucugcgaaauuucguggacaggaauguuaaagaugggcucaugacucccacuguggcgcccaauggagcccaaguccugcaagugaaaagaggguggaaacuccaagucacuuacaauugccgagcuccacagaguggcaccauccaaaaucaguaccuacgcaugucucuuccaaauaugggagacccugcacaccuggcaagcuauggugaauuuguccaaguuccuggcuacccauauccagccuauguuuacuauacaagcccgcauaugaugacugcgugguacccaguaggacgagauguacauggacgaauaaucguugugccuguuguaaucaccuggucucaaaauacgaaccgccagccuccggugccccaguauccuccuccgcagccaccuccaccaccaccaccaccuccaccgccaccaccaccuccaccagcaucauccugcagugcugcguagaaccugucauguccuuuguagucucugcccucaacuugauccugugcagcuucucaaucuaugacugugugguacuggaccuucagaggcgcacagagcucaagucaguuuucgucuugacugccacuuuauaaguugacaggccuggguuuuacuuguuaaaaccucucaccaucucaaucacaggcugccaagugucuuuacaaagaagcugauacaaacacaggccaugcugauuucuuacagagggagagaagaggaagagaagaagaaagaggaggaagaggacaugacuugcccauaugcugggcaccuuauaaaggaagccagacuuuucggugcaguauggaaaggcuuccgugauucucuugcugcaccccacgaaacuucaccaccuucaaacuccauuuucacgguuccguuaauuuucaaggagcagcaacucgacugguucucugcuacaugaaacaccucagcuugaaaaggaagugcucucucagacugacuugugagugugccuucacauucuggugcaaaucauguguacccaagaacucugacauagcaucuuaccaucaucaugccaggaauugguuuccuuaaagugugacacuuggcaaccagaagcgucugguggcuucagguguguuaggguuuuguagaaaguuguaaccaccucucagucaugcaagaggguacaucaaaaagacuucuaaauuugguacccagacuuugacaagagccugugaguuaguucauuguaaccaacuugucaggaacuucagcaagaauuuucaugaauguuguuaauuggcuggagaaauaccagcaaaguuuugcaaucauccacccauuugucugccauugugcaucuggacauccaucaaccgcccacucaguggcaucuaccaugaagauguuuagagacgggaaaugauuuugcacccagauccacacuccucucaugucagauauuuggaauuagagcaccgggaaucgucuugaagauaugaacuucuaagaauggagucucuugcuacuaccuugaaacauuuguuuauccucucuuucuguuugauucuacuacuaccauuaacccugcugcaggauuugucaccauucugccugacugcugagacuccauuuugcugcuaugcaaggagaugaaagaggcaggccuaaaggagcaguaggacauaacaugguuuuuauuucuaucugucaugaucuuaauggugaaguuuccuuuuucgucagcauuuaucucuuuguuauccugacauguuuuaauuaguuuaguggguuuuuuuuuucuauugguggugguguucuuuuguuguuguuuuuuguggucgucauuuugauuuuggaucacuucguguuuuacaguaauuacuuuuaaauggugcauuugcuucugauuuuuuuuuuuuaugaagcaucacaucaguuuaccucauaucucaauuccauccuucaugcauuuuuuuuuuaacucauuugaucuucaagcugcagagggccuagcaaugggucaucaccugcagcccuggcauguacacacggacauuugccaccacugaaagcaaacaguuggagaaguuggccaccugagucaaggagguggugcuggugugaguucacagcucacaggggacggugaacguugacauugacuuuggcaguguguacuaugcucuacuccuauauauacucuauagauguuaggcauuaaggauaagugaucuuaaauuuacugaaauuuuguuaaguugauuagauuuacauuaauuguuuauauuguguuuuuucuuuuauuuuagcacuuccaacaaaaaugccuuuauucauuuauuaggaagaaauuggaguggcgaacacaaacuagcaaaauuaauuaauuggcugugggcccaaauuugaauuccuuauuaauucaaagugaaggaagugugagaguuucuauugcuggucaugaaguucaccacgaagagucaguuuaguuuguaccgagaggcauuuagcugagagugauuugaguugggcaucucuaugaugcaguccagacuuguguuuaaguuuacagguaccucuuggacuccugaauugaucucgaugucacacaucaucgacaucccgcaucccacacaguuccaagauuggcgacagagagcauccuguuggagagaccugaccagucacgaaggaccgccugcagacucuucugcaggaccaugcuacauauucagcuggagagggaacacgcaucugaugggaauggauuguuuuugcuuguuucagaauuuugcuguugagauguuguuaaacuuugcauuguuuuucuuuuuucuuuuuuuuucccuauagucaauuaagaauaagggguagauaaucauaaguauuuugggcugggagggauuguuaaguaaucuuagguggguggguaauuuaggaaauuaaguuaggauaagauaggauaagauaagauaagcuaggauaaguuagauaaauuaggauaaguuagauaaguuaggauaaauuccauaagauaggauaaguuccauaagauaggauaaguuaguucacauaggauaagcauaggauaaguuagaucacauaggauaaguuagaucacauaggauaaguuagaucaaauaccucaacaaguggacgaguguacuuauuggucccuuaccccuaccaacuuuaccuuuaaggccgagcucagagggaacuacagggaaaucaguguuaggagugaauuggacauggaugacauucuagugaagguuaggacgauuagaguaaucuaauacaggcucugggaauuaacucaagggauuuuaggaaugccagaugacagucaucauuugauaaaacuguugcuggaauaaaguuuagaauguugaaugguaaauguuaauggaaauuguacgaaaaugaauaaaagcucuuuccauaccccucccccucccuaccccacucuuucuuuccucccccccuccauaaccuaccccuucucccaaacacaccccuccauuuccuaacucaccacgucuccccuuccacucccuaacccaccccuucuucccucccucccuccagaacccgcccccaucuucccccucccuaacacaccccuucuuccuuucccccuccaaccccacccuucaaacuauauuacuguauucucuuuauuauauuucuuuguauuaauaaaacuguauugauguuacaauaaaaauucaauaaauaaagacuuagugguuaaggcaaauuguguccugaucauuucagcgcccgcuggcaucaagaauggagggaggagaggugggauggguguggagugacaaggggugggagcuaggaagauaagggguuggcgaggggcuaaauggaaaagaagaugguggggaaggguggguaugggaacacguuuggccugggggugguguauaaacaacacaucagucacacaguacaucaucaaugauaauacccaggauaccccaggaaauggacuaacucauuuaaguuuugaaguuaacaaagucaucaccucacaacaaauccaaugacauauugauuauuaaucccauuauuauuuggaacacuugaaauucauuaauauauuggagagggacauaggagaaugaaaagcaaugguagaagccugggagauggggccggaggcugagcugagaucaggaguguggucggcauggugguauuaaacauaccacucacauagauucuuaucaaugacaucccagacuagaauaccccaugacgccaauuuauaaaacccauguguaagaaagccaccaauuaauagugauuacuaacacaaugaucuuaauaucaggauuccuuggaaaugcugagacgaaugggcgauggggaaggcuagcaauagggcagagugggagaugggaaguaguggcaagaaagguauaaguugaguaaguuuggaauggaguuuuauaucauacaaucaaauaacaauacacaauaccccagaacauaaguauauccuggccacagaauacaaacauucaaauccaccaacuaauggcaaaaacauugacaucacacuggguauaauucaauacaauugggauucuugauaugaguugagaugggggaagaagacagaguaaaguugugggguuaggaaucuagugggaaggggugguauauaaauggagggaugguguauaaggggagggugguauauaaagggaggagugguaaaaaaggaaggaaggguauaugaagggagggugguaaagaaaaggaaggauguguagaacaggaggggugguguagaaaaggaggggugguguagaagaggaggggugguguauaaggggaaguguagguuauaaggggaagggaggagcauaaagggaaggguagugucuaaggagaggggugcuguauaaagggagaggugguguauaaggggagggguggaauguaaggggaggggugcuauauaagaagaggggugguguagaagaggaggggugguauauaaggggagggguaagguauaaguggcagggugguguauaaagagaaggguaguguauaaggaaaggggugguguauaaacggagaggugggguauaaggggaggagugguguacaaggagaggggugggguauaagaggaggagugcuguauaaagagagggguagugcagaaagggagagggggaguauaaggagaggggugguguauaacgagagggguaaaguauaaguggcagggugguguauaaagagaaggguaguguauaaggaaaggggugguguauaaacggagaggugggguauaaggggaggagugguguacaaggagaggggugggguauaagaggaggagugcuguauaaagagagggguagugcagaaagggagagguggaguauaaggagaggggugguguauaacgggagggguaagguauaaguggcagggugguguauaaagagaaggguaguguauaaggaaaggggugguguguaaacggagaggugggguauaaggggaggagugguguacaaggagaggggcgggguauaagaggagggguggaguauaaggagaggggugguguauaaggggagugguaagguauaaaggaaaggguggugaauaaggagaggggugguacagaaagagaggggugguauauaaggggaggggugguguauaaggagaggggugguguauaagaagaggggugguguauaaggagaggggugguguauaaggggaggggugguguauauggaacaaauuaaucauacacucuuguagcaauaauaugcucaggcuaucccaggaaaucaacuaauacauuucagauggaaaacauuacuauccuuaguaauaagguuaccaaauaauaggaaccccacaaaaaucauaaaucccaacaccaacacuacuugagauaauuaggauuacuaauuuaaguggaguuggggccagcaagauggcucagcagauaagugcuugcugacaaugugaguuggucucuggaacccaccuggugggaggugaagacggugccuacaaguugaccuuugaccaccauaaacccacaaugguaccacagugcguuccucuccccacacacaaaauaagugggggggggggaguaagggaacauuuugaggggcaggaagcagagcuaauagggagauugaagggcaagaagagaggugguaguuagguguggcuuugaaugggaugguccauaagggauuucaaucacauaacucaccaucagccauaugcccagaacacacaaggggaucaacuguauuccagaugcaaaauauuugcaaauaaaauaaacacagcaaucaauagugacuucaauagucauacuacacuauuacauggaguacucaagacuaauuagauuccacauggagggacacuaaggagaaaagggaagagugauuauauauauauauauauauauaauuuuaaaugguauucccuuucucaguuuccccucuguaacccccuaucccauucccccucccccuguuucuaugagggugucccccacccacuccugccuccccacccugguauuccccuacacuguacauuauuauacaccacuccuccccuuuauacaccaccccucuccuuauacaccaccucuuucuuucuauaccaccccucuccacacacacacacacacacacacacacacacacacacacauacacauauacauacuaagguauuaauugauuagaauuacacacauccaacaucaaucaaugccaugaauagcagagacucaguaucuccugugagauaauaaaggcuuauuuuuacuagaacuauuuuuuggaaucacugaagcuuauugauuagagugaagaaggcaauauaauuaauauaauugggagaagggaggagagaagggggaggggaagaaagagaauggagaaaauaagggaugcgacugguuggaaaugaugggaguggauauagcauucaaaugugagugaauauaaagaacacaucaaucacagucuaggaucaguuauguauucacaaccuccaagaaaauaaguauuucguacuaguaaaauauuaacauauuuaaugguaaagccauuaaugauaacuucauuacuauauuuuauauuacuaagacacuuuuaaauuauuaguaaguggaagagugaaagaaagaagggaguguaggcuaggaagaaagagaauuagaaaggugggcuauggcaagaggauggagaugcauaaaagaaugucauucauacaaccaaggaccagugauauaaaaagaaacccccuaggaucaauauacuacaucugaaaaacagcacacaauaauaaaucuauuuaucugcagaugcucgcagccaacaguuggacugagcaugggaccacaauggaggaguuagggaaaggucuguaggagcugaagggguuugcaaccccauaggaagaacagcaauauccagacauccccagaaaucauaaggacuaaaccaucaaccaaagaguacacauggagggacccauggcuacagcugcauaaguagcagaggauagccuuguagggcaucagugagaggggaggcccuucguucucugaaggcuuaaugccccagugccaggguggggaggcaggaguggguggggggaacaaccucauagaagcagggggagaggggaugggauaagggauugcagaggggaaacugggaaagggaauaacauuugaaauguaauaaauaaaauauccaauaaaaaugaauaaaucuauuaauaauaggaaauaauaaaauauuaaauuacuuuuaauauccauuuucuuugaauccuucagauuucucaauaggaguaaaggaaagcaggagauuggagaauguggugggcagggucaagacacacaguauggggaugagaauucuaguaggagaggagucugagaugaagggcugcauauaaagaagauaucacacacaaggcaguaucaauuauguacacagaaugcaccagaaaucaauuaacauaguccaacugcaaaacauaaacacagaauaauuaaccuagcaacaaacaucagugauguaaggaaagggaacaauuaauguaaguauuacauagaauuauucaccuucuuuucacuacagagacaagaaguggagggcaacacaaaacacgagagugguagugggguaaauuggggguaggguaauguacaaagggcacaucagccauacacagcaaaacacucaggauaacacaugauggcucauauauuccaaagcuaagaaacacagcgacuagggagaugguguagaggguaaagaucuugugcugcaagcgugagucccuaaguucugauccccagaaugucugugccaaaacucacacacaaacacuucucucagagacacacccuagaguuuuaaaaauaaauuuaacguaaaauuuauuaacacugacuucaggaugugacauaaaauuuuuaauauaaauauuuaauauauaacuauuucuuggagguuuaguaacaaguugagaaggaaggguaguggaaaguguagaaggugagggguaagaacuuggggaagaaggaaugguuaaagauaguggguggguggggagaauuugaaaugggguugauuuauaaauaugccaaucauacagccuauucuagcagucagaauuuuaacauaaauguuaaggucucaugugacucuaaugacauaauuaaacaaaauucguuucacaaugccaauuuuggaugaaauuuuaaagauuuaauuaauagaagaugguacaauaaguucauggacugucggaaacauaggcgaauaaggauguacagaaacaggcagagcgagaagggucagggauugaggugaacuuggaauccugaagaugugacugggucaguuacaaccugauauagauaccauccccaaacugauuuauccaagcuucaaaauguccucauguaaaguaaaucauccaugaguagugauucuagccauauacagggcuuuauuuuuauuuuuuuauuuuuuuuuuuuccauuuuuuauuagguauuuagcucauuuacauuuccaaugcuauaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguuugcuaggccccggcauagucucauaagagacagcuacgucuggguccuuucaguaaaaucuugcuaguguaugcaauggugucagcauuuggaagcugauuaugggguggaucccuggauauggcagucucuaccugauccauccuuucaucucagcuccauacuuuguuucuguaacuccuuccauggguguuuuuuaauaugaauuuuacuuagaauacuucaaauuugugaacuacaaucaacacagugaggcaaugaagagaaagugagagacagggagauaguagcccuccaugucgggugaaucagugggugagaagauaggugggguauuuuaaugaggacuucugucuuagguucucuauugccaugaagagacaccaugaccauggcaacucuuauaaaagaaaacauuuaauuggcacuggcuuauaguucagagguuuaguucauuaucaugguggaaugccugguggcaugcaggcagacauggugauggagaggaugcugagaguucuacaucugaaucugcaggcaacaggaagacgcacugagcuacuaggccugaaaccucaaagccuguccacagugacacaguucuuccaacaugaccacaccuaguucaacaaagccacaccuccuaauaguuccacuccuuaugggucuauggggcuauuuucauucaaaccaccacaaauacccaucacuaaaccagaggugugcccccaaaacauccccccaaaaucaucugcagugauugguuuguuuguuuaccuacuuauucacuuuacugcccaguaucagcccucuuucuccuccuagucccccaugcacacaccucuuccccccauuuccuauuuccaucuccuuugaaaagaggcagcccugcucccugggugucaccccauccuagcacaucaggucauugaggaacggguacguucuuucucacaucaaggcacugcaaaauuaggcacauucucuaccacugaggccagacaagguggcccaguuagggguauagaauccacaggccagcaacaugcacagggucauccccacuccaguuguugggagacccauaugaagaccaagcugcacaucugcuauguaugugcagggggccuaaauccaguucaugcuuguucuuugguuggugguucagucucugggagcccgcaaggguccaggguuaagugguucugcuggucuuccucuggaguccuaauccucuugggucccucaaucuuucccccaacucuuccgcaagacccccugaacuccacuuaaaguguagcugugggucucugcauccauuucuauuggcuccuggguggaaccucuuagaggauaguuaugccagguuccuaucugcaagcauaagagaauaucauuaauagugucagggauugguucuugcccaugggaugggucucaauuugggcuauucccuguuucugcuccaucuuuguccucguacaucuuguagguaggacacauuuuagguggaaaauuuugugaguggguugcuguccuuaucccuccacugggaguccugucugggaacaggaaauggccacuucaggcacaauaucccccacugauagaagucucagcuagagucacccccauagacacccuggggccuccuccuguuccaggugucuagcacuuccuauuaaugcuuccccugccuaccccgaucuucccacaccugacaccccuguccugauccccuccccauccccucccccacccaguuuccucccucccuccaucuccaauauuuacucuauauuuccuucugagaaagauucaagcaucuucccuugagcccuccuuguuauuuagcuucuuugggucuguagaguuuaaugugcauauccuauauuuuauggcuaauauccacuuaugaagaaguauauuccaugccuguucuuuugagucuauguuaccucacucagggugauguuuucuaguuccauucauuugccugaaaaggucaagauauuuuuuguuuuuaacaacugaauaguauugcauugugugaaucagcuacauugucuuuauuccuucuuccauugagggacauaugguuuguuucuaauuucuggcuauuaugaauaacacugauaugaacauaguugcagcuguaacacuuaaacacagaaaguagccaccaacuaauagucacuucucuguuacaacuuuugucuuugguaucaauuuuaccuggaaauuuguaauuuauuaacaaaaguuaauuagugaggucuaguacacuaauguaguggagguauggcagaguaacaaggaaacuacuuuuuaugccagucaauaacuuuaagaguuuucuuuuaaaacaacuuuucacugucauucacaccaugauuuuugcucaugauggggagcauggcagcuggcaggugggcaugacauuggacuaguaguugagaagaccuuacaucagauccauaagcaggaggcagagagcaagacugggucuggcauggccuuuggaaaccucaaagcucauccucaguggcaucucccuccacaagaccacaccuucuaauccuucccaaacaguuccaccaucugcaggccaagcauuucuguauugagcauaugggagccauucuccuucaaacuaccaaacccagcuucagaaguuucacugagaaugauauuaguaaaugggcuggagagcauucuggugauacuuuggcuaguguauggcugcuuuuugcccucaugauaugaaucugacugaaggcaaauugaaaguuuuagacuuauuuuauugguuaaaggagauuuuaauauaauccuacgcugagucugucccacaguuauuaguaauauuaguuaucgugcaggucuacaaagaaaaaggguccagugggacaaaaagaaacacaaaauuuacaguuagacauggaaaagaauaccaggaaauuuaauguugaagcucaggcuugagcugaaagagauaaagagaugccuguugugaaauggacuaagaaggguggccucaaggcaagaccccaaaucagcacagcuucuaacuaguaaaaaggaaaugccuaagagauuuuaugcuacuaaagagccgcaaggaagaaaaguuuaugcaaaugugauucaaggagcagggcagaccccaccucaagcaggcacagaaacuugguacauuguccaugugggucuggauuaagagcaaugguucucaaccuaugggucacaaccucucugggguuaccucucagauacccuguguaucagauauuuacaauaugauucauaacaguaguaagguuacaguuaugaaguagcaaugaaauaauuuuaugguugggugauuaccacaacaugaggaaguuguuucaaagggucucagaguuaggaagggugagaaucacugcuuuagagucaugaagggaucacaaguaaagagguuguggaaucuuuuuccccaguuaagugucuuaguuaggguuuuacugcugugagcagacaccaugaccaaggcaacucuuauaaggacaacauuuaacuggggcuggcuuacagguucagagguucaguccauaaucaucaacgugggaacauggcagcauccaggcaggcaugauacaggagaugcugagaguucuacaucuuuaucugaagacugcuagcagaauacuaacuuccaggcagcuaggaugagggucuuaaagccaacacccacagugacacaccuaugcuaacaaggcuacaccuacuccaacagggccacaccuucuaauagugccacucccuaagccaagcauauacaagccaucauaguuaaggaaagcugcugaggcccagcaaguggcagaggacuuacugaauggagacucuaagaggcuauugcaugaagcugugaaagggaagccuggauuguguuggagauccccaagauauuaaaaguaccaaagccauaggauaccugccaaauagaugggaaguuaaaccagcccaaaagcuagaggugcauuucaagggcugaaccaucuaaucccugacaucagacagggagcuaaagaauucagucuucccuacuuuggauuuaggucuugccuuggucuaguauuuucuccuuaugccaaaugguaacauauauucuguaccauguguguuggaaguauggaaauugcuuuuuuuuauuuuauaggggcuuacaauaaagagauugucuugagucucagaagaaacuuggaauuuuaaacugucuuaagac

SEQ ID NO: 11 - RNA, 55382 nt, Mus musculus
guugggcacgcugguggacaauuuaucuauugauccuuccucgggcgacaucugggucggcugucacccuaauggacagaggcucuucguguaccacccgaaccauccuccugcaucagagguucuuauauuuugaguuuuuccaccuuaauuguucaaguccuuugcacuaauaauggaauaaacugucacggggaugauuuguuaguucuuuuaaaccaauaauacaauaaaccugggagguaguuuuauaauugcuuuaagccaauaauuggcagaauguuacauugcucaaaugcuuucagaaaaguaaucuuuugauguauuaaauuauagugggaacuagucaaaaguaauuuuuacaaagacacagguccuguucacuuucaugugguaugcuggcaaucuuaaaacgaccuuguuuauugucagcucagcacaugacaugagcuuugugcccagugaaauagugucaaagcgggcacaguggugggagcccauuucuauuaauguugaauugcuguaaucacacaaaauccuguguuggcauggcugacuaguugcuuuaaaaaguccguuuuuuuuugaauguuggaggaaguacuuuaauuuaagcauuaaggagauugguaacugcuguuuguagcagcaugccuucuuaaucaugugucauuggugagcgcaagggauuauuggugcuugagugguauggguguguggguucuuuauuaauauguuguaucuccuggguagguccuccgcauucagaacauucuauccgagaagccaucagugacaacgguguauaucaacaacgggucuguccuccagggaaguucuguggcgaccauauaugauaggaaacuucucguaggcacuuuauaccagaaagccuuguacugugaacucuaaauuguauuuuuggcaugcaagugcacuagguuguaacaaaauaaucuuuugauuaagggccaauucugagggaauuuaaccaucaguacugaccuaguaauauaccacauuuguagcuccuuuuauuucaauaaggaaaggccuugcaauucugaugcgcuuuuagcaucaaaagaaaaugaacuauauuauuggcugugugugugugugugugugugugugugugugugugugugugugugugugucuguuuucugcugauccagcgagaaagaagaaagcugcuuuucuaugaagugaaugcaguuugcacagaggggcuucccccuccgugccuccaccacguaagaguccacugaagcagggagugugguaaacaggucugcggccucggucuccaggcugcgccugcugggcuugugcaggacuacugauagauaacacuuggauguuuucuacauccagcuuuguuuacugauuuacaagguaggaguguauucaagacuaaucaaaauccggggaguuguuuguguuuaauucccaagggaaauccucuggagagggugaggcgggaagugacuccuagggcauucgguuggacaggaaucaauggccauguuaauuucucaugaaagcucuauguaaaggggcucuuuauuggaaaaauaaaauaaaacaaccgaauacuguagcucaacuuauuuguuuguuuguuuauucuuucauuugaaacagaaccucaguauauaccucugacuggccuggaacuugcucuaaccacagaggccucccuaccuaugucacagucagccuuccaguguucagcucuuaagguaucuuucauagguucuguuccuaaauacaauucaguuuuugacacaaagaggcgauaaaggcuuagagcuggugucuuacuucuuaccugcucagugaauagaauuauguccagaaguggucagaugucuagaccugucugauuugcagccacuacaguaagacagggucaagaugccaaaaucacuggaagaacauugaagaacauuucuuuccacccugcauccaaaagccuccuuggguccugaagagagacauuaauguauuucuuucugcgucacuguguauuuuucuaauuaaaauuuuauuguaaaggacuuccccaucagucaucucucaaccaccgucuucucgaagccuuuuguuucauuuucccucaucuuccuccuucccuuuaagaugccuggauguuaguuaucaaauguccagcaauugagaagugguacccucauuauuucacuuaaucuuaauugcagccuggcgggaguacgugucaauauuguauuguuguuaacauuucacagccggucaaggucacacaccuccuaagggugaauaucaaucuguuucuaaugccagaccccgugccauuagcaauuccaggaagccacugcaauagagacaguucuucauagcuacccuuucccuaugguacauaguguguucugggggugugugugguguguguguguucauaguuacccuuucccuaugguacauaguguguucugggggugugugugguguguguguguugaagauacuaauuugaguuuuacauuuugcuguauaauuuaauggauuucagauggaaacuucggaaguauucuuaagcccgggcuccgguucauuuauauauuuacauauuucuguuacuuauuauuuuugauuuuucaguuuauucaguuaagaaugaauagggacuauauuucaggccagggaauuaaugcuucuugcugcuuccauaucuaaggagaacauguuaggucacagaugaauaaggcaggauuaaauaguguuuaccuaaagauacaauccaagaaggggaugguuucguuuuagaggaagauaacaauggcuaucuaaaaagacacaugcacaggaaauggcagaguacaauagguaucaagugaaguugcuuucuguuauuacauucguucagaauuuccuuuguggaaaaggggguaugaauuaauaaacacuuauuauuuuugcuuaucuuauuauaugaauuaauaaacacuuauuguaugaauuaauaaacauuauuauugcuuaucuuaggcaagcaggagagguuuuuuaguaaauccugacuuggggguacuaauggguaugagagauuguuuuuaucaacuguaaauauaauguguguuuauuuaugacgaccuuuuuacgaucaaaugcggacagaaaggauugggugauuaagucaucauugcccaaaacaacagaaaccacagaugggacuuggcacuccuaagggauggacuugagcgcucucucucucucucucucucucucucucucucucucucugcguguguguguguguguguguguguguguguguguguguguguguguguguuuauauauacaugugcccacagacagcagagguuagggaaagacauucaagugucuuccucgauugcucuucacuguauugccuuaagagcuuucugaguacuggggucacagguuccugcagucacucccagcuuuuaagugggguuggagauuucaacucagaaccucuugcaaacacucuggcccacccagccauuucuccagcccuuaguuuucuuccucuuuccuuucaucaaaccucggcugcuuuaugguucgugaguacuucagagggaacaggaaaaucaagucaucuaugugguauuacuuucacauuucuuguuuguuugucuuggcauggguuaagcauuucugauaacuacucuaaagaugacccuuccgcuagauuuucauuugcucaaucaguccugucuugaaacaagcaccugcugaacacugcacaaaaaaagcaguggggaaguuauggccccucccccaccucaccugcuuuccuauagcuucuuacacuuuucauuacugauacgauuuuagguaagaaucuaucuguacaugggagaagaggaugcaugugugucuguucacauucauacccucuugcuuuuugcucuuaauuuucaaaagauuucuuccaauguguuuaaguuucacucucuuauuacaagugauuuuaaacacucuuaguuggggugugggguggggugcacucuuuacuuucagcacucuggagucagaggcagggggcuuucugugaguuccaggcuagucagggauauacaaugagacauuaucugaauuaaucaauuauaaaauauccucuuagauauauaaggggaguugauugaugauucauugaauuuucuggucuuuaguuuuucuuaaagauguaagccccuuuguccauugguugggugcaaauaucugccucugacucuuacagcugcuuguugggucugucgggggcagucaugcuaggucccucuuugugagcgcuccuuagccucaguaauagugucaggccuuagaacuuacccuugagcgggaccccacuuugcaccugucucugaaccauuuuuuccucaggcuccucuccauuuccaucccugcaguucuuucagacaggaacaauuaugggucaaagaugugacuaugggaugacaacuccaucccucacuugauguccugccuuccuccuggaccccugauguugaauuagggaagguugaaagaaguugaggagaagggagauccuguaggaggaccagcagucucaauuaaucuggacccccaagaucucucaaacacuguacuacaaaguagacagcauacaccagcugauaugaggcccccaacacacauacaguagaggacuuccgggucuguguucauucagagaugaugcaccuaacccucaagagccuggaggccccagggaguuuagaggucugguggaguggggggguggggguauccacguggagauggggugggguggggugggguggaggugugguauguggaguaguuggagaguggauggggcagggagcagggaaugaauauggaguauaaauaauaaauuaaaaauaaaauaaaauuuaaaaaaacauuaugggcccuuuucuuaugaauaggaauuauuuucuuuuaggguauuauuauauucuaguaggauacuguauacauggagauaaaauaacaacaacagcaacaacaaaacaaacaaacaaacaaaagacaaaccccaucagauccccuggccugccuggaguuacagaggguuguaagcugcuguuuggugcugggaaucaaaccuggguccugugcaguagcacucaguauucuugacugcugaaccaucauugcagccuugggauucuguacaugaaaaaaauauaaauuuuuuccauugcuaacuuuuaauaauaaaauuuucagguguuuuaguuuuauaguuugcaguauuagacagcggaacucaggaacccaugcaugcaggaagcacuccauuuguggcccgugcucccagaucuguaauucuuaguagaguuugcuaacucaaggaauugugccgcucaguggguagguggggggagcacccucagggaggaagaggggaggaaggagagggcagauuugggauggggugguuaacagggaagugggauaucauuugagauguaaacgaauagaaugauuaauaaaauaaaaagagagagaaaggaaggaaggaagggaugaaggaaggaaggaagcucacuacaacagaaaagaacagaaaguaaaaccaaacuuucagacauucaaagucuuaagagaauggaaccccagggaaauguuguugcuccccucaaguccagaagcuucccuuaaaaaacaacccagcaucucccuagaguaucuaacccgggucuggcuuuggacauucggucuuccuguccuaaccuacuucgugcucagcugcuuucuacaaggugaugcuacaaauccauaacauugaaaagcaugcaggggcauacuggccucccaguaauacuuuuguaggugacaccucugaugagugggucaugaaaaagugucagacauuucugggaguugagucagaacuucuggcauagggagcucuacccucugcccucagauccugcuaaaggccgcaugaucccguguuccacagagauggauaaauucacugacuauugacuguuuuacuuccaagucgcuuucacuugcuucuuucuccuauaaacaucucauguccuagccucagagagguggguucaagaccugggucaggcguuucuagguuucacuaacuugagaauaaauucuugaaagauuuacgagauuggcacacugaagaauaggcaaaaugagguuugccugaugccaagauauuucuugaggaacaacuaauauaauauuuucugaaaccuagguccuacugcaagagcuguaauauguuuuaccuaugucaaaucauuugcccaucacccaauauuuuacuuagguauauucuauacaccaagggcuaccuucuucuuaauauccuuagugugaggagcggguguggcagcagucccaagaaggcgccagggacugcagcugucuuaugacuugcaccugacuuccucauacaccugaaaauaagccacaaccaucaugagagcugcgcaggugcaccaggauacugacaaauccauuuugguggagacaugccccugccgcccugauuagcugaagcugcgugccuggugaggugccguggccugcugugaguggaugagggcugagaguauauaagagugagaggccugggucagagaaggaaaaaagaugagagggaaaguugaagugagagagaugaagacggaaguuugcugaauaaacuguuguuagaaggacugguggucgugucguucuugcuggucaagagcagaugcgacaauugguggcccguacagggaaccaacucccccaccaacgaguucagaacuuucagcagucaguguuugccagcaggguaaguucucgguaaguguaacuuacgaccccaggaguuugggaaagaccucggauaaaauagaggugaauauaagguugccaggaagcaggcacaaaguaaaagugaaaccauggggacaaguuaggguucacgguucugggacaaguuaaggcucccguuuuugggacaaauuaagguucacggguuugggacaaguugcaccaagcaccauugggacuugagguuugcagaggaacaggggguuuuaccaaaagggguuuugccagucuggaaguuagugagaaauugcauagaagauaaagauguggcacagaacuccagagagguaaugaggcacugaaucaggugagagaggagcgcucucaauugguuugagagagagggucuguuuguguguuuccccaggauaaccaacaacagcugugggucccagaacgacugaccagagcaauucaaaacaagcggagcuaugaggacguggauguuccuguggcugggaaugcucccacuagugagaacugaagagcuacauuggggaauuagucuguguuccugaggcccaugccauugacgcauucaaguguuuccucaguucuuuacaucuaaugcuucacuacaauugccuuuuuucuaugcugcuucagcuaaagggauuguuguguuuucagaugauucaaauuguguucagcuguaucuacuaaagcuaaugcuaccuggauucgagggguguggccugccaguauauccaagggcauuggcacuauacccucccaaccuagaugggcccccuuccuuuuuguaggaguguuccugauucccuuccaccuugggcagugccccuuuuauguaugguuguuauguggggugaaugguaguugcacugaucuuucccccuuacuccaggugacaggaggggccugagauaaugcaaauuuuauuggaaugguucuaauguguuugaaacuucuguauuucaauuugcuggaggaaggaauguuucuuuucaggcuacaccuguuuguauguggccuccuuuuguguuuauuguuuauaagaucccuugccucagggcugaugggagcccugggauguaugcuuguaauaguguguguguguuguguguuugguguauguguugggugcagcgugugcaggcccgcacuuucgccaugguagugcaggcuuuugccgcaguggaggcgggacaaucuccucagauucgguuugccgcucuaaagaaauaaugcugcguuaugccauggguugcgaggcuaagcacugcacagaggauagcuugcuguuggcuuccuguggaaggcaugucugauugcaugaagguucaguguccuaguucccuucccccaggaaaaacgacacaggagcuggccaagaccucucugggugaugagcccaagggaugguuuuguguagggccccuaugcuugcacacuggggaucagaccucuaccuucacccaagaggcuugcuugcagcaaucaaaaucgggccauagauuaaucagcauccuggccuucugaugcaccugcugcaugcaaacaggacaaucuccccaagugugacuuggcaugauagagaaguagucagugacggauaagacucccugggcaugucaccaaccuaagacagggaucaaaccaaugcuguuugucucccaaggacggguaaggggcauugcugcagggggcaaucuaagacagacauucucucugccaaacaagaaaaaagggggaaaugugaggaguggguguggcagcagucccaagaaggcgccagggacugcagcuaagucuuaugucuugcaccugacuuccucauacaucugaaaauaagccacaaccaucaugagagcugcgcaggugcaccaggauacuggcgaauccauuuugguggagacaugccccugcugcccugauuagcugaagcugcgugccuggugaggugacguggccugcugugaguggaugagggcugagaguauauaagagugagaggccugggucagagaaggaaaaaagaugagagagaaaguugaagugagagagaugaagacggaaguuugcugaauaaacuguuguuagaaggacugguggucguguuguucuugcuggucaagagcggacgcuacaccuuaguccuauaaaaucuaccuauuucaaaaaaaagcucucuuuuuaaacugaauucugcugcugcuaccuccuauuaguaacuaaaaagagaugauccuugaaggugcgauguucccuaaacucaagugucuggccaucuucagucucuccaacaguauuguuuaucugaaaggaaaguuugcucuucauuggaaagaccugaaauucacagaagaguaagacucucccauaaaaacgauauauuguuguugauguuauuaucauuauuauuauuaauauuauuacauucugcucaucuuccagauugccagacagauggacuugucuaccaccaugaaggcaccaggaaguucugagccaaaguucagagcucugguuccucgagaaggaugagccaaagggcucgucuuucaggauuuucuucuucaggguguauauggagcaauuucuccucuuacaugcagccugccagaacucugaagcuuuagucuaugaacucuggcuucccaggcagcucucucacaucacuccacuggagaagcugagguuaauugaguucugugacuuuaagaaacaaauuuuccacaccgugaggauuccagcuugugaguucaaaccugaaugguccagaguuuagcugaccuuagccuaggcagaaauauguucuuggaccgcuugccuggagagccagccuuagaaucugcacauuaaaguggccuugaaccaucgcuaauaaagguggacuugaaucagaagaacaaaaauccccuugaaacucaaguagacaaguggcuuugagcccuccauguggagguggcuuugagccuuggcgcaggagagagcaaaacucccaagacugcuagaaaggaucagcacaacugccaggaggugcaggcaggcggggcacaagggacugaucagugggcgggacccugaguccgcgccccagagcggcaccagucuuccugcuuuuugccuaaggcacccagacaccauggggaagcuuguggcgcugaccuugcugggagccugucuggccuuaauaggggaaaggcugcugaauuuuaggugagugggcaucuccauggagauggcuucagcucuuuccuuucuaguccacaucagggaacuccugcuuccaacuuccuagcguuuccuuccggaaaggagcaguuuuggaaccucaguucuuagugaccuucuccuugagacucguucacuagcaaaggggacagcugcgugccuuucuaggcugccaggguaggaaagcccacguuugauuucugaagguuggguaccuuuuccaggucuucugcuacauugccuuugugaaagaccaagucauuuggaaguguuggacuugggggaggggaucagacuagcagcuggguguuuauagcugacucagacacugaaagugcgggccguuccagaacccaugccacauuggaagaugagccaggaaacagggaagagagcugaaccccgcggacaggaacugacuugaaggguaguugacuuuuugaaguagaagauccggcagggaaacccucccggaauuacugucucaagcaaacucaguuugaucugaaagauuuuuuuuuuuaaagguggguucuucuccucccuccccuuauugcuacuuggggcuaaggccucugcuugucaucuaguuguuuuuauucuuucucugaggagugacuagucucagagguucgcugcugcaaucuguucagacacugaugucuguuggcaacgcuuucuaguccagcuugagagggcucguugucccgccugcuccccaaacaacaaauggcagaaucuucaaauaguaaauuuaagagugguacagcuaggaagacuaacacuugccuccccacccucacccccaaguguuaaaaccauaccucuaaaggauaauuuuuauaaaugaucaaaagauaaaucuaccuucagucuucuugaauacaguucaauuaauauuuuaauuucuaccuaguauuuagaagucuauuucagugcaagguaagagcgcugugcugaaaagcacuuuggcuaacuaaugccuuuaguagugucagguccauaagguaccuuugcuaagauaagucagcauaagcuuaguugaaaugaggaaguuagagcuaaaguuaucaguucagcuccuuggagaccucagagaaauuuggaauuuuuuucucccuacuggaggaaggagguccaaagaaaacaagaaaauaugaaauggguaaguacagauucauauuagguaauaguuaagaauaugauguaaugcuguuuguuuguuuuuuguaaugcuguuuuguuccuuuaaaugaagaauaguguucgguucugccuagcauuaaguggggucuuauauuucguauagaauucuacuuuauucuuucagcaauaacugugaaguuagcuucuguaggcacagugguuacgugagacauauuauguaacuauaaaccagaggcguuguuacggccuccaugaaaggcagugccauaauugucacaucaggaaagugacugaaagaccucccugccuguuccaggugucuacuugggaugagugcuuugaccuccauguugcuuucuuccuguugauuuuuaucuucuacagagaacgaguuaguacaacucgagaaauaaaggccacagaaccacaaaacugccaccugauugagggccucgguaaguacagggcaggaccaagaagagggagcagaauuucuuggucaucauuucccugagucuacuaaauuauuuuauucucuauuacuucuugguguggcuuccgcacaaacaggauucuuuuucagaauaccccgauguauagucucaacagagcauccacagaccagcgucuagauggcuuuucucaguaugucuccuuaagggcauuucuccaucaugugaugaauuucaguuacuauuucuucuuugccaacucccucucccucuuuccccucucccucucuccccucuccucccccacccuccccuuucccccucuccccucuucccuguccacacucuccucucccccuuccccucucccuguuuccucucccccucccccucucccuguaucuucucccccucccucuuucccccucuccucucucuacccaccccucucuacccucccuucuuccucucccuccuccucucuuuaucucuccccucuuccucucucccccuccucuuucucucuccccucuuuaucucuccccucuuuccccccucucccccaucuuccccucuucccuucuuccccucuuccccucuucuccucuuccccucuuccccucucuccucuccacccuccccucuccccucuucuuggcaauguuggauucaaguauccucuccaucauuuucugguaggcacuucuucagacuuucaaccuaccuagcugucucucaaaacuacuaaucucaacucugcagucagaccuccagccucaccaacuggagguccccucucccgguccacgaggccaguuuugauuauuuagauucaggcuuaacuggaguggaccucacaccccugacacuccuucucugguuccuccgcccucagcuuggcccaccauccucuggaggcgcagcucccucuuugccccucccuccugcucccacaggagacuggugggcagcagucuccucugugcccacagaccucaccuacucggcccugcaacccuguuuacuuggguugcaagccuccaguuuuacuacuagaagauaaaauggcaauccagccagagucugcacacuguccauccgaggacuaggaaugcgcuucuccgucuuucucaucuucgcuaugacauuuucuccccucuguugagcacugcagucagccucagauuccucucguguccaaaauagucccuucauuuugguuuucuauucuuuuaccuccuaccauguuuguuuguuuguuuguuuguuuguuuuuuuccguuuguauacuuugauuucugaggcagucucucaaguaucucaggcuggcuuugaaccuauuaccuaccccaaaaugaacuugagcuucucuucuaagugcugaggacaaaggggugcucuauagcguccuugagugguggggguggguaggaccucuggcuuagguucuaccaaccgagcuacauccgcagcccuguuccaggaacguagaaaugguuugugagucgggcgugguagcgcacaccuuuaaucccagaggcagaggcaggcagauuucugaguucgagcccagccuggucuacagagucaggacagccaaagcuacacagagaaacccugucucaaaaaaacaaaaaacaaaacaaaaaaaaaaagguuuguguugccgggcaugguggcacacaccuuuauucguagaacuagggaggaagaggcagguggauuucugaguuugaggccagccuggucuacagagugaguuccaggauagccagggcuauacagaaaaaccaugucucaaaaaaccuaaauaaauaaauaaaauaaaauaaaaaauaaaugguuugugcugccaggaagagacuggaagaagggaaggaaacaauucccuagggaaccuugguguuucagaaaccaaaguguuaaaagggauucugcggggaaggaaggcaugaacauacgcagcauauguggauuucugaaguuagcgggcacuuccaccaccucacagcaguuugggauggagcaagcaucagaaggaggcucacaugguaucuucagagaagcugcaccaguagucuguguguuccagcccaaacagaggucucaggucagaagugacagaaucuucaggauucaaaggguuccagggaauugucacgaggguuacauucugcuugguuuuaagacccuuccccuggggucacaguacaagucuuaacagacaauagacuauagagacucgaguucacuuucuuauaaaaaugaggcccucgguucaagucccaauaaagacccaaaggccaaaggcacacacacacacauacacagucacucacacacauggcaacaauaaacaaaaccaaagacaucuuuuaaaugggucaggcuuacuguaauaugaaaaauaaggcaacaggacauucaccuacuugcucacucucuagagcgcugguucucagccuuccucacgcugcagcccuuuaauacaguuucucguguuauggugacccccaucauuaaaucauuuuuuuugcuauuucauaacuaauuuugcuacuguuguuaaucguaauaugaauauuuuugacaauggagguugugacccacagguugagacccacugaucuagagaguagcagccacacacauugcaugcuuaugucucaaggcaugagccugccaagcuguuuagggaaauaauuacauuacaggauuuuuugaugucuacuguaauucucaaauuauauaaguuagcuaaauuugagaaacuaaagcuauaguuaauacuguaagccauaggucaaugucuuuauuacucaaauaguuuaauaggcuuaaacgagauggaaaaaaaaaacccauguuuugcaucugucacauguuuguauuuuauguuugaagaacugaagauguuagaaugacugcaguccauuaguuaauaaaacaaugcugaugauuacguaaaaacaagacacaacuacaacuacaaccaaaccaucaaguucucgugucaaaggugugggcccacaagugugaugcuaacuucuuugcaagcuccuguucuagcuucacagaucuauaaagcucaugugauucucugugcuuugcauggaggacacugauugcgugagcugccuugaugguccagauguucaccugcauuagggauuggggucguuuucuuccaugccucugcagucucuauuguauaauguuaauauauguuuuuaguauagauguuccagaaaagucuuauuguaacagaagaugcaaauagcuagaauauuacuaaaugaaagcugaccaaaaggugacuagauauguaaauggagauagcuaagaagacauuagucauaagcccuaaguauuugauggucgaggguuuuauguagcaauggagcagcacugaaggacuguaaguggaguacagcagacacauagccaaagaaaguucuuuuuguuucuuuacaaugagacaggcgagcaugugcgugugugugcauguguguguguauguguguaugugugugugugcgcgcgugcguguguguguaugugugugugcauguguauguguguguguauguguguguauguguguguguaugugcguguguguguguguguguguguguguguguguguguguguguguucgguuuacuggagcucugggugugagcuuacuuaggcaagcacccuagaccuaagcuguaaguguagcuuuuucuuuucaacucgugguuuuguuccguugcucaggcuaguccuggaaggaagccuugaacucaggcauguccugauuuuaucuucuugcccaggcccuggaugauccugggauugcaggccuaaccuuccagcccccgcugaaaucaaacuuuugaaguuaauucaucaguggggaaaaaaaccucuuccuuuuuguauguuuauuuuucuuucccccucucaucuucuccuccaaugauuguauccacauacagucuugcuauauagccauggcuggcccucacggcauggcagcccuccugccuuguguucccaaggcugagauguuaacugugcaccccagguuccuuacaggaagaacugacagguacaaccauucuucucccuuccuugcuuucuuccuucucuacuaacuuuuccuuccccaagccuaugugcauugagaauuacauaacaaggacgucguguggcaucucuuggcauccaggcagagcuacacuugaaauaaugugugggcccgcugaaugagggauuucugcaggcaggguuaucaaguuagcaguguuggauuugguaguuuucagcuuuuccuucuuccugcaccuucccagucucuaagaugcacugcugcuccauaguaaaguccauuuauuuacucagcugacagucagaaacuuccucccaagguaugaaauaauaauaauaauaauaauaauaauaauaauaauaauaauaauaauaauaauagcagcauauagaaguuucuggagugacacugucuugagguauuuacagggaaugauuggagaaaggaggacauuauugaacugauguccuaguaggcuugauuagauggaacauuauaagcucugagagaaagagagggagcugagaguuuugaccauagcuggguauagacuggcaggauggagaaaagggagaacucagaaaacaggaccccggacaucucacuuccacugcuuucccuacuguugagaugccugggacuuguccuguagauuccguguagucgagaguguggguggugggguggaaugcugucaguccuguugaugcuuuuacaccucagagagcaaagcaccaacuucuaugugcucuggugcaguggcguggugggagggagggcaauaagaaaacacaggaccccggaacacugcauguuagggcagggugaugcuguuaugggagcuaugcaaaaauggcauuuggagagaaaaggagacaaaucagagaucucacgacucagaauaucuuguauagagguuaauugagaagcuaaaccacaguguguguuaugacaugauuaauauccuuucaguuggaaauacuguaagucaaaacuacguuucauacuccuaacucacagagcguuccuaggaacaucucuguagggaggacaucuuucuuccccaagacagggagcagccccugcucacauggcucaggccccauggagaacuguggagaucggaagucagaaccaagggugauguuucuccugaaugcauuuucauuuuccugucauuggaaaggugaaaccuccuaaucacgucacugucaacuggacaucuguacucagagauuauguucauagcauuuauuucuuaaaugagacaacacucaaauugcuaacaugguuaccucuuaaguuaaacagguugcaucaggauugucuacaaugaaaagccagauaauguguccaguacauagauacaacaugaaauaaaaccacaccuuguucccaggaaguuuucaggcuaauagccaauuaacaagcaagauacagagcacugugaaaaaaugucauguuggaguuacccaaaggcaacaauauuugcauauaaagaugaaugcuaaauccaugaaagcuuugacaagcugaagcaauggccucaugcuguguguguauaucuguguguguauugugcucucucucucucucucucauucucucucuauguguguguauauauaaaugaauaaaucuagcagacuuccacuacucaaggaagcaccaauacauagcuagaauguauccaggagggcaggauaaaaaggaacugagccugggccaaaauaugaauagauuuggaacuacacaaggagcgugagauuuguacaacuaucucuagccggccuuuagcggccuuuaaagucaggguggggggaaugauagggucggcuuagcaggucagaaagacguaagcacagaccauggccuauggaagaagcuggacuauuaggaaccuguuguagaaacccaggagaacauagaagacaaauaagggaaaguuugggggaugaaagaauagggggguggcaaagauagcuccauguuccuugcucugagaaccugaggauagaaguugccauucauugucguugaaagauggaaaggauaaaauaaggaaauguccagaucuguuuggagccuguugaacaugagaaaccaggugggguguucagcccuggaugaucguaggagucugaacuugcaagaaggacuugaugcagaucagagaauugagagcaaguggauggcaacugaaagcacaggaccgacugggcuguuugcucugccuugagauacaaggugagggcagacagacuuuauucuauauucagagcagagugagagauaaaggcaacaggaaaccaagaaggggugaucagagaggugggagaaauaucaaacggguagccacccugugaugcggaaugacuauuucaccuguggguuuucccagcguguauuucacuccauauggaaauagcaucaagcuuuucaagccaucugggcaucaaauauagguaaagcuugaugaacaaaacugcccaggggaugggaagcuccgguugauuguaguuuucacauuacuaguugggcauuaguuucucucccaucuccugccuucagcaccucuugcucacccuucuauugguucaaacuuagcuuuucuuuggcuuuuguccugauuuucuuuuccacaucuacccauauucucucccaguugcuuagugacaaccuggcaauccauuuccccagguaaccauuucccauguguuccaauuauuguggcucuguaacagacagccccacaccuagugacacugaacaguaaguuaggacguagugacacacagcuguaauucuagcauucauggggcugaggcaggaggaucaagaguccaagguccuucuaggcuaccuagggaaacccugucucacaucaaacaagaaaauccuaguuguuuuucuuacaauguuggcugggcuuagugaagaaaguccaguuguuccauucacacuaucaaagaugacucacaguuugggaauaagccaccugggagccccuaucuuuucuccccaucuuuuguguucuuuacaucccucacucuguagcguugaauaacccaucuucuguauuuuacuucagggcacauccuugagagaguggaggagggagagagaggaggagguagaggaggaaagaaggaacacaaaaaggaagagacagagagacuacaucagagcagcuauggcuaugacauuuagccucuaaagucacauggcauuguguuuaccccacuucauugucaagacaauaucaaaguucccucaggcuuuugggaagagaauucaguccuugccucacuguggaagaguguggaaaaucgcaucagcugcugggguggagcauggggcugggcucugauguuuauuuagccauauucgauaaccaucgccuccagaaucagccccacucccacgucuuaccauaauuuaucucuauuagaaacuguccucuggcccaucccgcucacgcacuguauacuucuuuccacagaaaaaaugcucaaggaucuuaaggaggugauuggacccaacgcuuucuauuuaaacuguucuccacagccugucccuagcaugacuaucacccacugaacgcuuauucaauaacuucucaguguaauugugcgugcuuaggucuggcagguuguagaaugaagaacccuuggcagagagguuucucaggaauugacucgguguugacuaaacagucccauucaguaagugaggagcggucuuuugggaggaauaucacagacuuucucaguauacgcccagcaaguugucauuuaaagaauaaaacuaggauaugauuuuauuuuuauagaguaguuugcuuugcacuuuucuccuugaaaaaagggaauuuuaaggaagaauuuaaugcuuguagagacagacguuaaguguuccaagagcagguaugccugugggauuucugaaaguuaccauaauuuuccaagucaaugauugaaacagucggugcauuuuccaaaagaacucaaaaguuugggcuauugaacuucuuugaaggcuccacauaugcaucuuugugauuauuuucugcuuuguguuuugcagagaauggcucugaagauauugauauacuuccuagcgggcuggcuuuuaucuccacugugaguauuugccaaccgcucugacgcucacaucaauagcuguagaggccgugcauuaaaguuuccagcccaagaugccagauggaccccuacaugcucuugccaccucuggguagaccagucaacuacaaaagccaaauugcaaucuggaggccuaauuagagcaccacaggcaugccuaacucuggccgccucaugugggcugcuucccauggucagcugcaugcucgguuagugucuccauaaauguguauugaugugcauuuggcugacagucuggucuccaaacugcuuuguugcuucucagcuccaucacugacuuauugggggguacuuuggugucugguagucaucuucucacuagccaguauucuugccaugccugcuuaugugggcagcucuuuaaaugguagugaguuuaaaaaucaauaguuggacucucagcuauuccuucaauguguuuccaugaguuagagaagaaacuacuuaguucucuauaccaccuugacacguuuuaaaagaccaggacuuuaugcuugagaacaacaacaacaaaaaaaaauagcaaagaaagaaaaaaggaaagaaagaaggaagggagaaaggaagaaaggaagaaagaacaauguauuuauugcauguugaagguuuucaugcauuuaucaagccaauagcacacugggauaggguuugggauuuacugguuuuguuuuugugguauuuaacaauaugaacuaaccaguaccccggagcucuugucuuuagcugcauauguaucaaaagauggccuagucggccaucacugcaaagagaggcccauuggacuugcaaacuuuauaugccccaguacaggggaacgccagggccaaaaagggggaguggguggguaggggauugggggggguggguaugggggacuuuugguauagcauuggaaauguaaacgaggaaaauaccuaaugaaaaaaaauuaaauuaaaaaaaaaaaaaaagauugaaaccagagguuugugcauaucaggaacccugccaccucacuaaguccagagcuugggauccaacacuuugaaaaaguggauuuaccacauuuucagugugaauuuugugguuguaguuguugcuagaauugcaugugaaauauuucauuuuuucccacaccacuaacucacauaaauuuuaagucuaaauauuuuuggcucaaagaaagacauucuucaggugcggcgaucugagugugcagguucuuaaguaagcagagucuaguacagaggucucgguuggauuuuaaauacugagaggcaagauugucuuucuuuacuuuuccuucuagcucaaaaauaaaacagagcugucuggaaaagucucuuuuuuccuugaccucaauuuucuauugucaaguuugauuuucugggcugugccaaacagacccacaaacaugauuauucugugugguuaggagaugccaucacuguuaggaagcauuuguuguucugacucugugcuucccccuggcagcagagaaggauccauuaucaccacaagcacugugugagagaugccugcaccccugcucuuuccauccagcugugaacuggcaacuccugcuuggagugagcucagcacuauccaugcucuuugcucuguuucuaaucuuccugcguucauuaucuuguucuccuuggccucuccuaugaccuuccugcuuuucucaacaauguuuagaaguugcagauuuagaaagggauucuaugcagauagauacucuuagcauuuauaaagugaccaagaggguauuucccccuagccuugagaugggcuugcuugcugcucacaagauuacucucacccucccacuuugccaguuuaacuucugguucucagugaagccuccuugugaagguacucagauuccucagcaagccuucccugguucugcuguuggagauggauggacuauccuagguaccacccuaagcugauauguucuuguugcaaugucaagcaacuaaguuccuugagcuggggacuuggauguguucauuaaugcuccaggcacccagccuaggacugaacauaugaaauccgaggacgagugaggaccguggagagguucaaugaagguaugugcacacaugccuacaaugugcaggagaaaaucagaaccucaaagcgacugaguggcauggaugaauuugcaugcuguuacuggcauccaauacgauugcucccagcaauucuaacccaacagaacgccaugaagaagagaaaccuaaaucuucuuccagaaguauuuccuuggugcucuuaaucaaaugucuuacucuugcuucugucaaaucuuguuuguuuagagcaucugguuucuuuguuugaugacagugucuccaugacaccauaggacuuguagaaauaugcugccuucacacacacacacacacacacacacacacacacacauacacacacacacagagggagagagagagagagagagagagagagagagagagacccuuuuuaaugauguguguggauucaaugcagcauaucccuauuuauuguguggccauacaaugaaugauucaggcaaauaccuugaugucccuaacauuuacuucuucgguauugcuagucuuugauucaaacacauuacugacaaguuagcuguagagagaugaacuggguauugaauuuuauggcccaguggaauaguggcacucuuaauggagaagaauaaauaugcacgagagggagggucuggagggacguguuuuggacaaaucuccaugaagcuaaccuuaggaagaaauaagggauggaggcuacaguaccagagagagguucugaguaaucauggguaugugaggaucauugcaggcugugaaauagcuaaagcuuucugaaugaaaucuguaggaaagagcacaaggaggaaaggggggucuaaggacagaugaaagaaaaacccaagaggcagaaauaaagacagaaguucuaucuuagaccucuacuccugacuuuuugaaaugaaugaaggaggcacacguccagagaccaacagcuguagacagagaagggcugucaaggaagacacucugagacuguugccaugacgaggugguuggguuuccacaaaauacuggaggcacaguguggaucccagagaaagaagagucggggcaaaucagguaauaagacugggggauaucuaugagaaauuucaggagaaacaaaaagguaaacacauauuugaaggaaguaagaaaaagaaugauuauuuugaggaaugagaaaugaacgaaauugcaggagaagucauuaaugaaaaauaaggaauaaagcaagauggagguugggggucauacggaacaggaggucaaggaaagaggugacagacuuaagcgagcagcagacagugucuucaucaagagaagagggagaagagaagaacugaagggucauucacagaaaggaguccgagacaauucauaccagaugccaugguguuucuagagaggaaggaggcaaacgaucauucggggugaagcaguguggcacguggacuuucugaaaugaaacacacuuaggauacaugugugaagaacagaaugcagucucuaugacaaugaacaggaaauccaaugguccguggugacuuccagaugaugcuggcaccugugcugacuuguggcuggcguuguuuaugacuacacacuauaaccgcuggagggauaggaucaauagaguuaauuaaaccacacacuccuucucuauucuuuggaaauggaaacugucacuaucaagauugaaaagaaucuuagccaucauacguuucaguugcuuuauuuuaugaaacagcuucucaaggccuaggaagaccaaaggacucuaaguaaguaacacagcuuggucccuugcacuguaauuugugccuuaauucuuucuaagauaaaaaugcuuccuuuuucucaaaagugguuuuuccuguauucacaaacaaagaaugguguugcagaaagaggaacacuccuccauuguuggugggauugcaagcuuguacaaccacucuggaaaucagucuggcgguuucucagaaaauuggacaugguacuaccggaggaucccacaauaccucuccugggcauauauccagaagauguuccaacuaguaagagagacacaugcuccacuauguucauagcagccuuauuuauaauagccagaagcuggaaagaacccaggugccccucaacagaggaauggauacaaaaaaugugcuacauuuacacaauggaguacuacucagcuauuaaaaagaaugaauuuaugaaguuucuaggcaaaugguuggaccuggagggcauuauccugagugaggcaacccaaucaccaaagaacucacacaauauguacucacugauaaguggauauuagcccagaaacuuagaauacccaagguauaagauacaauuugcaaaacacaugaaacucaagaagaaugaagaccaaaguguggacacuuugccccuucuuagaauugggaacaaaacacccauggaaggaguuacagagacaaaguuuggagcugagacaaaaggauggaccaucuagagacugccauauccagggauccaucccauaaucagccucuauacgcugacaccauugcauacacuagcaagacuuugcugaaaggaccaugauauagcugucucuuaugagacuaugcuggggccuggcaaacacagaaguggaugcucacauucagcuauuggauggaucacaggacccccaauggaggagcuagagaaaguacccaagaagcuaaagggaucuguaacccuauagguggaucaacauuaugaacuaaccaguaccccggagcucuugacucuagcugcauauguaucaaaagauggccuagucggccaucacuggaaagagaggcccauuggacuugcaaacuuuaucugccccaguacaggggaacgccagggccaaaaagggggauuggguagguaggggagugggguggaggguaugggggacuuuugggauagcauuggaaauguaaaugaggaaaauaccuaauuaaaaaaaaaaaaaaaaagaauggcguugcuggcugugcuccuuccccagaucagacaacggcuguaggugacagagagaaaauucaccaagucaaaaugaaaugcagaaccugggacauuuuuguuuggcuuugagauuuuggcuuccauaugauaauagcguuuaaauaugcauauguguguacacugguucucuguuucugcagggauuaaaauauccgggcaugccagcguuugcaccggacaaaccaggaagaaucuuucugauggaucugaaugagcaaaacccagaggcgcaagcacuggaaaucaguggugggcuugaccaggagucacuaaauccucacgggaucagcacuuucaucgacaaagguacaagacaaaugacuaagagaaagggaagcuggagggaagagaugccauagacccccuacaacucagcauucaugcuaaagcuauagggcaggcgcuauuccaccaaagaaauguauggaauaauugcaaaaguuuuaauguucacagggaacauuuuuuaaaacagugaaggaugugaaggauggcugaccugagagacccgagugggcuccuuugauccacuuugcuucuuauuugacucccauaaccuguuuaaauaagaaaucaaacauauaacgugaaaauaauaauauaacaggaaaaaucauaccauaagggaaaaagagauaaauuggaaucuuggaaacugaaaccccaguuuugugccuaauaauaccaccaagaaagugaaaaaaugcucgaagaaugauagauaauaucugcaaauaauaugucugauucagagcuuguagagacaauaucaguguuacaacuugucuuaauuacugcucuauuacugcgaagagaccccgugacccaaguaaguuggggaaggaagggauuauguggcuuguaccaaauaauaaaguaagucagagcuggaauucaaacaaggcaggaaucuggaggcaggagcugaugcagaggccauggaggugcugcuuacuggauugcucauuacugcuugcucaaucugcuuucuuauagaaccuagaaccaccaauccaugaauggcacuacccacaauggccuggguccuucuccaucaaucacuaauuaagaaaauauccaacaguucgaucauauggaaacauuuucucaacugagguucccuccuuuccaaugacuccagcuugaagcaaguugacauuaaacuaucuagcaugccccuuaacauccaaaagacaaaugaaccuguuuaaauguggacagguaucugaauagauauuucucuuaugaaaguauacaaaugccaauuaagguguuaagagacauuugacaauuucagcaaccugugaaaaugcagaugaaguaaaaaucagucacuucuucauauauucaaggaugagaauaauagaagggacaugaggcuagguacagggcaaugggucaccguaccuacccauuauucuugaaacuccgauauugagaguggagaccaguggauccucagaguucaccaaccauccaguuaagacccuaccccccccccaaaauaaucagugaguuuccaggucagugagagaccuugucucaaggcaguaaggcagaaaguaauagaggaagacauacucacugaugugcauguagcacauauaaauacauuacuauuacuacuacuaccacuaccaccaccacuacaacuauuacuacaacuacugcucucucucucucucucacacacacacacacacgcacacacacacacagagugagagagagagagaaaacaaguaacaacaaauauaagcaaagauguggagaaauugggcuccuucacuggcaauauugugagaggugcauccacuuuaggaaacagucugucaguucaaaauauuguguuaccaugugauacaguagcuuugcucucuggugugugaucagcaggacuggcaacacuucuacacaaauacucccacaugaaugguccuaucagccuuuuuccuaguacucacaugcccauuaacugaugagcauggaacauaguuuauacaauagacuacaauacaauacaauacaguaucauuuggcaauagaaagaaugagcugggauagugugcuaugacccugggcagaugcugggaagaaggggaaguagaaaggaacaucuaaacaguggggcauuuacauggggccugauguaagcauuccggagcuaaguagugguuauuacuacacaacucuaagaauauacuaaaacgcacuaacguuuacauuuugcaagacuggauuuaauggcaugugacucacaucucaagaaacuaccucagaaacaaaucuuauauuauucacuuugaaaauagcaaucuuuaguacauuuugcuuguuuauaucccauaauuccaaacuaauuuaaauauaauuuauuugugaauccauugaacacacagaugccauuguauaaaugaaggggguaucucucugccccaguauuuguuucuacuuacuaguuuuuacuauuguuuucuuaucuaaauauauucaccauaaaaaauguaugcaacacauucauuauggaaucugagaguccagaacaaugacugagacagaauaggaacugagcaaacagguaucuggugcgcgagggacuauggaugugauggcaucagacaaguuacaguaauacuccauuuaauaagauggagaagcuggaguugccaggaaugugauacaggguugacuucucugaguaacucuggcugcuucagaguuagaagguaggugcuuucauuuaucgcgugucucuuacucgguaaaacucgggaagcucauuauacuuagucccuuacagccacaacuuguuugccugacacugcccuggcuaacgcauuccagugagagccgaguagucagauuaacggagacuauuucacuguauaggauguuagaguuagggauaucaggagcugaauguucuaagauaggaucagcuuauggauuaucugucagccauacacugaagcuuccagacauucaauguucugugauugacaaccuauuuuauuuauuccuaaauuaagggauuaauucacagaccaaaaugucccacagagaacugucaggcuguagaacaaaguuuaucuucauuaagcaccucuuccaccuaauuugccuggaacagcuaaauguggucaagggcccugaauguaaauuucauaugucaggccucagaccugcuccauuacauguucaguaauuacauggaggaagugaacaggaacaagagauacagaacaaauuucacagugagaggacaggaccagaccagucccucaaaaccucagacacacagcuucuaauaagucuaugaaggccacuacccucaauccucuucagggcacucuacauuccagagugaaagcagguaucugggagcauucuugagguuggugaugccuaggauuagcuggcuuguuuccauuggcguguuuacuuuacaaguccacugaguucaguaaauauaguuacucuacucagguauuucacuuguguuagaaguucguuguccaucugggaaagggcuuauuugaaagcauucgcaugcccugagguuucuugaacuucugucgaaauguagaccuuugugacacaccccaaaauuucucagcagacaugauuuguuugcugacaaaccauccaggagagugacauacauguuugccuaccacugaaguuccaucucuucucuuuagagagggcgugcuagugaggcuguggagaccauugcacaaacacccaugcuuugcaccauugcuugguaaacuugcuauguugauaaaauugcugggauauccccuacuggaguuucaauuucuccaaaaauagaagcaucuagcauugguguuaaugaccugacaggcaggcaguaccauaaaagcagccguugcacaguaguaccugccuauaaaaugccagcaacucacaacuggaaccuugaagcucaagauaagcuugggaacauagcaagaccccaucucaaggcaaaacuaaagaccugggagaugauuggguuuuuaaagaugccuaauaacgguuucaagaagcucgcuuaaacuuccuggaaauuguaucuuucuuugaaaugaucucuccccuccccucucccauucagacaacacugcuuaucuuuaugucgugaaucaccccaacauggacuccacuguggagauauuuaaguuugaagaacaacaacgcucucucauccaccugaaaacucuaaaacaugaacuucucaagagguauggaguuaaaaccacgcgucuucggucuauuucuucgggcccuccacugugcaccuugcuuucuucccuucagcaggcguucuccagcuuuuguuucgcaagcggaagauuuuucucuuucucuaaagcuuucuaaagcucccuguggugggacugcccagcgccucaguagacauugcuguguucaggauugaaugucucuauauuuuccaacuuucugaaagcucuuuaauccuauaaaggugcucaauuagauucccagcuccaauuccaaccucuuugccacagcaacucaauccugugcucuccuuaaacaccuacucccccugccaaucaucgugguagauuguguuuucugagucuuacccacuggguauuauaaccaaccgccagauggguuauuucuuuauguccaacucuuuaaagaagaagcugauaaaaaauuaauaaaaauaaauaaaaacaacuggugggaacuuauaaagauuaccuuaagugugcugacucugugccaagucaaaauaguuuaacuuauuuucacauagcauuuaguaacaagcauaaguaaacugagucucauagaaguugugggccacuuggcccugugaagguucuaugccccaguauaggagaaugccaggaucaggaagugggaguggguggguugggagcagggggaaggaaaaggggauaguggguuuuuagaagggaaacuaggaaaggggauaacauuugaaauauaaauaaagaaaauaccuaauaaaaaaagagaaaccauaacauuacucuuugaugauauaaauauugguagagugcaauauuuaaguugauuuaguacuugacacccaaggaaaagaaaauucugcaaacauugcauuccgugucuuuaauauggacaaguuaaauuuugcaaaggaugaucuuuuuuuccaagaucaacucauuuuuucugacuuucuauaauaaaauguaguauaucuuauacuuuucuuggaauuacuauaaauacauugggcauugcgaaggggcaaaauaaaaacggaaaauguauaagugaagaagaagaagaagaagaagaagaagaaaaaaaguugugggccagguagguggcccgagucagcuugugacuaaaucaccacguaaucccagguccaucaaaagugagcucuuaauuugcaaugaucagcaucauucuuauugaauuuagacgauuauuauuccuuaaucaaugucaggguuuaagcaguaagagauauuuuccccucuuaugaacuaaaagcaucacuagguucuugaggccacaguggaucugaacuucacaggauugcuagggaauggaaaguaaagaaaagggauuguuaugaguugaaugauguccuaaaaacugcaaaauagccgggcggugguggcacaugccuuuaaucccagcacuugggaggcagaggcaagcgaacuucugaguucgaggccagccuggucuacaaagugaguuccaggacagccacggcuacagagaaauccugucgaaaaaaaaacaaaaacacaaaacaaaacaaaacaaaaaaaaaaacaaaaaaaaaaaaacaaaaagaacaaaacaaaacaaaaaaccugcaaaauauuucccaagucauccaaacuccacuuuuuaaaaauuuuguauuaaaaccuguguuugaauuucuuccacacauaccucagaaugugaucuugcuuauaaauacccaguuaaagaugaagccuuaguggauuaagauauauccuuaaucaguaagaaggcagacaagugcagagauugccacacaaugaugaauacucucccaaaccuggagcgagagaucuacaggucagggagcgggaccugaugguggaaaagccacgaacagaucuuuccaccaagacuuuagugggaucauggcucugcuaacucccugcuucaauaugcuuacucuguugaaccauuuagaauaacuuuuguuuuuuaaucccuacaguugauggcaguuuauuauaacagacccagggaacauacaugaggaaguuguagaggugcccugucaaguuacccauuacuaaaugcaguugacacugcuugaaaucagguuaccucgaagaggcaacauaagccuuguuucacaaugaucugaccacgauaagaaagacaaaagagcccugauguagcugucucuugugagacuauggaggggccuagcaaacacagaagugggugcucacagucggcuauuggauggaucacagggcccccaaugaaggagcuagagaaaguauccaaggaacuaaagggaucugcaacccuauagguggaacaacaauaugaacuaaccaguaccccggagcucgugucucuagcugcauauguaucagaagauggacuagucagccaucaguggaaagagaagcccauuggucuugcaaacuuuaucugccucaguacaggggaacgccagggccaagaagugggagugggugggugggugagugggggagggaggguaugggggacuuuugggauagcauuggaaaugaagaaaauaccuaauuaaaaaaaaagacaaaggaguuuaucuugugacaucauuucuccuuagucaaaggugccucaaggaacuucucacucuugcccugucaacuuguucauguuugagucacaccagugcuauccugugcuuugagaccugacaaaucugcagugggaggcaagaggucauagcugugaccuuuugugaagugacaccugugggaaaccuccccagaacugguugaauuuguuccuacuugacaguggaaagagcccagugagacugcaggaucuaaguaggaguuugagaagggcucuaagacacacauugagcaacaaguacuaagggcaaaacagagccucauaggaggaaacugugaggcaacuuaauguagggugccaggcaagacuugaauacaauuuaugaugucauucaaggucuuuuggcagaggggccacuuaggccaagucacgaaagauggauaggcuagcaacagggcaaacugcacaaaauugcaaaacauuuucugauucauccaaacuucccuuucuuaaaauuguauuuguuuaaaacaaaacaaaaaacaacagcaaaggcuuucagcucaugagauggcuuaguagguauagaugcuugccagcaagccugacaaccugugguugaucucugggacauacaugguagaaagaagagaacagacuucugcaggcuguccucggaccucugcaaugcacuguuacagauauccuagagaacucaugagugugcauaugcgcacacacguucaugcucgugcaguguguacccacaaacacacacagacacacacacagacacacacauaauaaauacaaaucuuucaucugucuucuuaauuuucaagucacauuuucaugcuuucuuuucuaaaaaugggcaugcauucacaacacugguuguauuacaaauucaaagcuuucuuaagaggaagaacagaagaaagaguaccacccauuaucuuacuugcuuagagaaaacauaaaugccaagguagacuugguuaagagauaaugacaggaaggaaugccaauggcucaaaguugugccaguuucuuugauuuccucauugaagcugcacaugguaauuaagggaccuagugucucauuguccucacuuagguuccuaggaggacagaauaguauacucucaggaaaaaaugguucuaugaaaauacaauagaucacucuuugguuuuccagcucuuucauuaaggccuggggagauggcucagucaguaaaguucuuauaagcaugaggacucaaguuugauccucagaacucaaguacaaacacauggcuaggcaugguagcacauguuuguaaucacagugauguggagacagacauagggaaacccuuggggcuuauaggucaaccagucuagccuacaugggaaguuccgggccaacaaaaaaacccucaagaaucaagguagauaccacuugaggaacuacaccugaagaugaccucugaccugcucuccccugacacacauaugaauaugcacacuaauacacacaaagaaaagaagccacauugguuuuggucaaaauaaguuauaugacagugcuuaucuuuuaaaauuaaggcuaauucuagagggaacaugaagauacuauauguaccacagaaaacuaucauugacaucuauaaguccagauuuuguuuguggguaaacacauuuaucuagguagauguuaguagcuuugucaauaaucaagauacucaaauaccuaauggauuucuccacuuuuuucuuucuagugugaaugacauugugguucuugggccagagcaguucuaugccacaagagaccauuacuuuaccaguuauuucuugguacuucuggagaugaucuuggacccucacuggacuuccgucguuuucuacagcccaaaagaggucaaaguuguggcccaaggauucaguucugccaacggaaucacagucucacuagaccagaaguaugguuuuuauuuucuguccuuugcccuugauacuuugaagagcuccuuaccuuaagaguucccuuagguucaaguaguuagcaugugaauaaaguucucagguguguccacaguucauacuaaauuugugauccuuaaaggucuuuguuuucuugaguuucaaguccccuccaguagaaagagaaugacucaaaaauauggcccuuguuccaaauucuuacauaacuaaauauacuccuccccgacacucuuucugaaagcaggaugaguauucccuaucucugcacuuuaugaacccaaauguuauuuaaccacaugaauaaggucaggcuaaccaaaagcucuuuuuuuuuuuuaaagauuuauuuauuuguuuauuuauuuauuuauuuauuuauuuaauguaaguacaccguagcugucuucagacacaccagaagagggcaucagaucucauuacaggugguugcugggauuugaacuucagaccuucggaagagcagucaggugcucuuacccacugagccaucuugccagccccuuuuguuuguuuguuuguuugcuuuuguuguuguuguuguuguuuuguuuuguuuuucaaggcaggguuucucuguauugcccuggcuguccuggaaugcacucuguagaccaggcuggccucgaacucagaaauccgccugccucugccucccaagugcugggauuaaaggcaugcgccaccacgccuagcuccaaaagcucuuauuagagaaggaagccugccuuugacaugugaugguauagucgucagacuuacgauuauuccauggcuguuuuuaagaaaucaugaaauuuuaagagcaaacauucuugacaaaugauuaagaaguaaagguuuucaaaccagaaauauacuuugaauaacaacauuuagauuugagaucaugaacagagaugauccuuguagagcaugccuuugggcuggauguagugcugcaugucuuuaacgccaguacuuagguuauauuugugauuuugaggccagucuguucuaccuagucaguuccaggacagucaaagcuacagugggaccauucucaacaaaacaaaacaaaacaaaaacaacuacagaaaagaaauugccucgaaauauucuuuguguuuuaaaaacaugaaugugauugagcuucguugccaccccauuguuuucccaaguacuaaguuugggaguguggacucuaucauuggaaggaugcucuuuccucagucuacucagcaaugacauugagucuguaugucaucugcaauacuaguugucacuuuauggucacauuucacaucagaugccuauaaaaccuuucaauaguauuaaaaauaccacucgguuaucuacuuuuauaauguuauagagagacaucacggggguucuucaagcuagcaugaauuuuauauaagacacagugucauacugcauuaagacuugcuuaaguguacguguuacuuuacagguuugucuauguagcugauguaacagcuaagaacauucacauaaugaaaaaacaugauaauugggauuuaacuccagugaagguaaggaugccccagccaacccacacaacaaggucccacacauuagucucauacuugacgcagggaugcuuuuaaggaugcacaucuauuuacacuuuuagagggcuaucaccaagccccuagaaaugcuagugcccagugcuggaagagcuggccagaggcagggagggcagagaagaacauugagaugguguccuuacuacuucauauuuguugaaggucauucagcugggaaccuuaguggauaacuugaccguugauccagccacgggagauauuuuggcaggcugccacccuaaccccaugaagcuguugaucuauaacccugaggauccuccagggucagaaguaaguaucgcuaucuccuugaacuaacauggaaagcuacaugggugaaaauuucacugaagugauguugaggggauucacgugggucacauuuauauuccagaaccaaacaaaaucuuuacgcaaaaauguagauauauuggcaguuagagagauggggcuccaacauuuuuaaagucacccaccaggggccaauauaauaucaucgccagacagcagguucuaacuucucagggguuuuugugcuauugagagugaugaggaaagaugaccuugaucauucauaucgauauagauucguccuacuguauuuuagcuagaaggcaagcucuuagaagcuccgucagggggucggagagggagaacuguguagaaccaucuucauuuguuaagcacagccgcauagagggguuaaacgacuacagccucugccgcaaauggacuucuguucucaaauucuaauauaugauaguauuaaagacugucuuauuuuaaaauauaucuucuaacgugaaaaccauugaauuaucuguaacauuuaaaccaacugccuaagacacugcauuaaauauauuguuccguuuaaugauaauuauaagauuuuggaaauuuucauugaauuuagcuacaacuacaaauucuuucacagauccuugaaaagacuuauuacaggcaauuacauuuugcuagauauuguuuuaaggcuugggcuaugucagaaaauaaacacacguaggcaaguuagauaagaaaacccuugccacacaagccuuaugaccuguguuugaugcugggucucaccauggaaggagagaaccaacugccaaaguuucccucggacuccacaagugauauggcauguaugugccuguacggcaugcccaugugcucacagaaacacauaugcuuaguaaaacuaauaaacuauggaaugaaacuuuaaacaagcauaaaaacccauacaaggcucccauucuuaggaggcagaaggacagacucuaaaugaaaaguauagaagauaaguuguauaggacaacacagcauaguuagaugaagaaaguuaagauugcuguguagagguauggcagguacuggguuagaauagaagguguggucuggaaaauggugugaccuguuuggugaguuaagaaacugagauucaaaucuuagccugcuuauuuaccaaggugggaucauuucuuucugaaggguguggcugguuuuuaauucuuuuucuuugcaauuaacacacaagucaugauaucuaucuuuaaaagagcaucaagaaauacuugaggcaaucauauuguugagaauuuaugaguguaauuucccagucaucucuagaagacauuuaccaauaaaauccccauaaugacaacagcacuugacaugccagcaaagauggggagaaugucacaaaguaccgccucuagaugaagagcuacagccaaucaauggcugcuaagaaaagaagaauucauuuuuccccaggcacaagccuuauuauagauuauccagccccaaguggucagcccuaagcacauggucaucagacccaaacauacucagccaggguacaugugaguauauaacuaauaacuaaagaagaagagaucauggauuugagagggacugaaggauaugggaagaguuggguugcauagagugaggguagaaguguuguaaauacaguauucauauaugaaauucuugaaaaauuaaauaacauguaauaauaaguuucagcaaaggaaaccaacuuuuacucuuauacaguuaccuacagccugacauauuuuaugcaguuucauuauuaauuuuauaucuacauuuauauaaaauaaauaaaaagcaugucaaaugugaaaguaauagauuccuuuuauaaacccuuuuuuaagauguaagacaacaugauuaaaugucuuuggaugaauauaccucuuacucuacauacuaaagaaauccuagaucuaucuugcaggaguuuaaauaagagcuacaauauuuauccaaugaauaaaaauccugcagcuaacaucugucuuuuuacaaccuagaagcucucaaguggauauagaacaaucccuuggacuuugagguuuauuuagucaacauauugucacauuauccuuagauucuuuucauaauaaaauuuaaaauauauaagauauaauauuuauauuauuuauauaugcagauuuauaugaaaauguugcccauuuauacauuucuauaaauauguaauacaauaauaauguacauauauuaauuccagaagugcaccgaggccugagacgacuggaaucauuuccucagcuagugagcuacgcguccuuauucagacccacaguccgcugacuucuaguuaagacagaacuuuccugccaaagcucagccacuuagucugcuuugaaaguuagggcuaguacugcugugaugaaacaccagaacgaaaauacguuggggaggauaggguuuauucagcuuacacuuccauaauauugcuauucuucaucaaaggaagugaggacaggaacucagagagagcaggaaccuucaggcaggagcucaugcagaggccauagagagaugcucuuuccuggcuugcucacuauggcuugcucagucugcuuucuuacagaacccaggaccacgaggccaaggauggaccucccaaaggaugguccuaaaauaacuaauuaagaaaauacucuauaggggcuggagagauggcucagugguuaagagcauugacugcccuuccaaagguccugaguucaaauuccagcaaccacaugguggcucacaaccaucuguaacgagaucugacgcccucuucugguuugucugaagauagcuacaaugcacuuacauauaauaaauaaauaaaucuuuuuuuaaaaaauauuuuuauuagguauuuuccucauuuacauuuccaaugcuaucccaaaagucccccauacccuccaccccacuccccuacccacccacucccacuuuuuggcccuggcguuccccuguacuggggcauauaaaguuugcaaguccaaugggcuuuucuuuccaguaauggccgacuaggccaucuuuugauacauaugcagcuagagucaagagcuccaggauacugguuaguucauaauguuguugcauuugcagggaugcagaucccuuuagcuccuugggaacuuucucuagcuccuccauugggggcccugugauccauccaauagcugacugaacauccacuucuguguuugcuaggccccagcauagucucacaagagucagcuauaucuggguccuuucagcaaaaucuugcuaguguaugcaauggugucagcguuuggaagcugauuaugggauggauccccggauauggcaaucacuagaugguccauccuuucgucacaucuccaaacuuugucucuguaacuccuuccauggauguuuuguucccaauucuaagaaggggcaaaguguccacacuuuggucuuuguucuucuugaguuucaugcguuuagcaaauuguaucuuauaucuuggguauccuaaguuucuuggcuaauauccacuuaucauugaguacauaucauuugaguuccuuugugauuguguuaccucacuaaggaugaugcccuucagguccauccauuugccuaggaauuucauaaauucguucuuuuuaauagcugaguaguaguccauuguguaaauguaccauauuuucuguauccauuccucuguugaggggcaucuggguucuuuccagcuucuggcuauuauaaauaaggcugcuauguacauaguggugcauguguccuuauuaccgguugggacaucuucuggauauaugcccaggagagguauugugggauccuccgguaggacuauguccaauuuucugaggaauugccaggcugauuuccggagugguuuuacaagcuugcaauccuaccaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaggugcuucucugccauucgguauuccucaggugagaauucuuuguucaguccugagccccauuuuuuaaaugggguuauuugauuuucuggaguccaccuucuugaguucuuuauauauauuggauauuacuccucuaucugauuuaggauagguaaagauccuuuccaaucuguuggucgucuuuuugucuuauugauggugucuuuugccuugccgaagcuuugcaguuucaugaggucccauuuaucaauucucgaucuuacagcacaagccauuucuguucuauucaggaauuuuuuccccugugcccauaucuucacuguuuuuccccacuuucuccucuauaaguuucagugucucugguuuuauguggaguuccuuaauccacuuagauuugaccuuaguacaaggagauaggaauggauuaauucacauucuucuacaugauaaccgccaguugugccagcaccauuuguugaaaaugcugucuuuuuuccacuggauggcuuuugcucccuugucaaagaucaagugaccauagguguguggguucaucucugggucuucaauucuguuccauuggucuacuugucugucgcuauaccaguaccaugcaguuuuuaucacaauuacucuguaguacagcuuuaggucaggcauggugauuccaccagagguucuuuuauccaugauaagaguuuuugcuauccucgguuuuuuguuauuccagaugaaucugccgauuguccuuucuaauucguugaagaauugaguuggaauuuugauggggauugcauugaaucuguagauugcuuuuggcaagauagccauuuugacuauauugauccugccaauccaugagcaugggagaucuuuccaucuucugagaucuucuuuaauuucuuucuucagagacuugaaguucuuaucauacagaucuuucacuuccuuaguuggagucaugccaaggaacuuuauauuauuugugacuauugugaaggguguuguuucccuaauuucuuucucagccuguuuauccuuuguguacaggaaggucauugacuuguuugaguuaauuuuauauccagauacuucacugaagcuguuuaucaggcuuaggaguucucugguggaaauuuuagggucacuuauauauacuaucauaccaucugcaaaaagugauauuuugacuucuuccuuuccaauuuguauccccuugaucuccuuuuguugucgaauugcucuggcuaggacuucaaguacaauguugaauaaguagggagagagugacagccuugucuagucccugauuuuagugggauugcuuccagcuucucuccauuuacuuugauguuggcuacugguuugcuguagauugcuuuuaucaugguuagguaugggccuugaauuccugaucuuuccaagacuuuuaucaugaauggguauuggauuuugucaaaugcuuucuucgcaucuaaggagaugaucaugugguuuuugucuuugaguuuguuuauauacuggauuauguugauggauuuccguauauugaaccaucccugcaucccugggaugaaaccuacuuggucaggauggaugauuguuuugauguguucuuggauucgguuagcaagaacuuuauugaggauuuuugcaucgauauucauaagggaaauuggucugaaguucucuaucuuuguugggucuuuuuguggcuuagguaucagaguuauuguggcuucauagaaugaguuggguagaguaccuucugcuucuauuuuguggaauaguuugugaagaacugggauuagaucuucuuugaaggucugauagaacucugcacuaaacccaucugguccugggauuuuuuugguugggagacuauuaaugacugcuucuauuucuuuaggggauauaggacuguuuagaucauuaaccugaucuugauuuaacuuuggcaccugguaucugucuagaaacuuguccauuucauccagguucuccaguuuuguugaguauagccuuuuguagaaggaucugaugguguuuuggauuucuucaggaucuguuguuaugucucccuuuucauuucugauuuuguuaauuaggaugcuuucccugugcccucuagugagucuggcuaaggguuuaucuaucuuguugauuuucucaaagaaccaccuccucguuuaguugauucuuugaauaguucuucuuguuuccacuugguugauuucgccccugaguuugauuauuuccugccaucuacuccucuugggugaauuugcuuccuuuuguucuagagcuuuuagguguguugucaagcuaaugugugcucuuucuaguuucuuuuucgaggcacucagagcuaugaguuuuccucuuagaaaugcuuucauugugucccauaaguuuggauauguucaaagaugaucuaucuacaucaggucuuguguacuugugcaauccuagcucauggucaaaaguuacauguuuuaaaauuuuuggauauuugucaaaguguucuccaaauuauugccaaauacauuuacuaguggcuuugcccaggcugguugugaccuuuaguacuagacaucggagaagacuuuaaucuuggucucuuuuuuccuaccaaaauguccaauuaaaagcuuuuuuugacuuguuuuuuuaaaaaaaaaaaaaaaaaaguuuggguaugauguggcuucauuuucauuaaacuccaaaaaguccuuaauuucuuucuuuauuccuuccuugaccaagguaucauugagaaguguguuguuuaguuuccaugugaauguuggcuuucuauuuauuucuauuuauuuuguuauugaagaucagccuuaguccauggugaucugauaggaugcaugggacaauuucaauauuuuuguaucuguugaggccugcuuugugaccaauuauauggucaauuuuggagaagguaccaugagauccugagaagaagguauauccuuuuguuuuaggauaaaauguucuguagauaucugauaaauccauuuguuucaucacuucuguuaguuucacugugucccuguuuaguuucuguuuccaggaucugucaauuuuuuuuuuuaagauuuauuuauuuauuauauguaaguacacuguagcugucuuccgacacuccagaagagagagucagaccucauuacgggugguugugagccaccaugugguugcugggauuugaacucugaaccuucggaagagcagucgggugcucuuacccacugagccaucucaccagcccggaucugucaauuuuaaggggggaaaaaaagaggccuggagagauggcucagugggugggagcacugacuguucuucuaaaguuccuaaguucaaaucccagugaccucaugguggcucacaaccauccguagugagaucugaugcccucuucuggggugucugaagacagcuacaguguacuuacauauaauaaauaaauaaauuuuuuuuuaaugcccuauagccaaauuuuauagugacuacuuguuguuguuuuuuggaaucgagguuccuucauuuccgauaacucuaacuuguguuaauaguugacauaaaaccagccagcacaaaaugaaugcaaauaucacugugaaguaguuaacaacuuguuaaagaucauguucucuacuuuucaagguuuaacaaguuuauuucagauaagagugacuuaaccacagugacugaccccucuccacucaguaaagucuugugcuucugcuugagacccaagcuucaacguugucuuauagcaaacuggaagcagaauugcuggagcuaaaaaggaaaacaaaaaguaaaggggaaaaaauccaaagcuucauucugaugcaagagaugaauaaagaugacgggcgcuucagugauuggcuguuuuccuuugcucccucucuuugucauccccacccccacccccacccugugaacuucauccagauugcuuggaaaucugaacccuuauguguuuacugguuagcaaagcugggugugcuaauccuagcgaucaauagcagaccuaggcagcagugccuccaaacuccugcauuuccuuucuguuucucagcugccucucagauacagaguccuuaagcagugaagguggccaccuucuugaccaucagguuaggcuaacugacugacugucuuuuagucuucuuguccugagauucucucuccaugcuauaggcucagucaauggcacauucacagacgguaaccacuggcaacucaggagauagagaaguguuuauggaacccaaguuucuucucuagggauaccugcauuaucaaaccgcugaaggucucuauagaggaauuugacuaauguuaacagcuaguccauuuucguguaugauugcuguuaggacaucaguaccuuucagauguacuucagcuuuagcuuugggguuuccaaaaguauacguuaucccagaaucgguggaaagggaaauagcucuguauagcuuuuccuggacagugcaguaaugagugcucuucucuugacagguacuacgcauccaggacucuuugucagauaagcccagggugagcacacuguaugcgaacaacggcucugugcuucagggcagcaccguggcuucuguguaucauaagagaaugcucauagguacuauauuucacaaagcucuguacugugaccucuagaucuuucuaaaacgucuuuauauuuggcaaaaguaaaauuguaauuuguaugcuaaggggaacuguaauuauuuacaauuaucagugauuguauguaugguuuuucuuauggagaaaaguaaaggaguauagaaacguauauccaugaaaucaagaaucaaguuagugaguggcaaccagauacccauguguccuuuacuguaugugcccaacacccuguauacucugugaugcguaggcuguaucggcuuacauuucccauucacuugaauuugugcuccuuguuaaguguucacuaaaaccaccuccgaccgcugugauagucugaggcuucugcaguccacagagugaagaagcgaauggcuaacuauuacgauucccauucucugucugucucguauaugguaccaucuuccagucacagauccugacucucaucuuuaaacucuaaagccuuucuugaacacagauuugccauacagggagcaagauucuggaaaucugaaaaaccgcaucagcuagcuuggugcaugcuaugcucguguacuucuuugaauaaggcuuuuuauaccaauauuuccauuaugucaccaaucuuggcucugaguguaugagaaggccccgggacaguuaccuucagccauguucaucuucucuacuaguuaauaaacacuuaguaagcagccuccagcugaugggaaccaauaaauccaaaaugaaaaaaaauauaugcccaaauggcauguacuaauggacaaaucuaaauuuaauuugaugagaauaaauaaagaauuccuuucuugguuaaaacaacaaacaaacaaacaaaaaccaaugauuuguaguucauaaccaccucccuucccguagggaacauuaagaccaaguuuucugcacaaagauuuauuugccccagagggacagauaaggaacaaacacaggagauagaggaagagggagaaggaacagcaacaauggagagggggcagagacaagggagaaagggaagagguauuuaucccauaguggggguggugggggcggugggggcagugggggcgggguggggagaggacugucucugaauagggaggauacaggcauggagcacaggcaaauggugauuauaaagguaaaauggaaacccuccauauuaggaugagguguuuauuuauuaauuuuuauuuauuauuggggggaguaauacaggguuucucuguguaacaguccuggcuguccuuugaauucuucuuacagaccaggcuauccucaaacucacaggaauccgacugccucugccuccugagugcagugcugggauuaaagguguaugcuaccacacaaggugauuaauuuuaguugggcauguuaauuuggugagucaaagaggacaucugauugcuagacuucaauacuuucauaggugaaccuugguagucagcuuugggaggagaaguggccaaauaagggaauagaucuuggggacuggcuuuaggaaugugaucuaagaauuuuuagcaaggcagagggaauaggagagaagggagaggccugcuagagcuacauuugccacacuagagcuucgagaguccugucauccccucccacaagguguauuugguaauggggaauuaaggagaccuguuuauauucuaaagaacacugcuuaguuaaaaguuuuguaaauaguuuuaugccaggacaaaauaauacucuuuacuuuuaaccugugcaaucauuuuuuauucagacauuaagauuuuauaacuuucauuacuucaaggaaggaauagcccagcugaauguuagagggagaugucaccuuuuaaguuccaaaacacagccguauguugccgagagcuuagcuguucgacucuuugccuuguaagcaugaggaacaaacuuugauccccaacacccacauaaaagagcuaggugugugguuuguguuuguagugccagcaccgggcaaggagauuccugguacuuucuggcuaaaagccuagcauauuuaguauacuuuaggccagugagaagcugccucaaacaacaacaacaacaacaccacauuguaguugaugcccuacagagcaaccccagaagcugucuucuggccuucacguacauaugcaugcaagcaugcacaacuccaugcaugcacaaaauguaguuauugagaagacuccaaauaaaacuaaugauuaaaagccaugcacacuuguaacucgguccauuuugaaaaauaugauaauuucuuuuuuauccuaugcaucauaacuacuggauuacuuaacauuugacuauuaaggcuuuaacugaauaaaagaagcauaagcuaaauccaaggggagugggauagugaaccauauccuagaaaauccaagaguucaaagagcugaauucccagcuuagguuaaagucagugugaaguggccccacauuccacucccagaagccugaacagacaguugcuuuggcauugagaaaaacagaaggaagagaucagauguaggugagagaugauaaucauaugucugccgucacucaguuucccauugaauggucaaagccauucugaagccccaagaaguugagaguagauugguaguuaccagagaccaagagaguagggguuuucugggaauggaggagggguacugagggcuuaaucauugaguucuaaguuacaguuaaauagagugaaggagaugaagagaguuauuacccaaggcaacugcuauagaugacagaaaugcucucauuauuucaaaaaucuuggagaaagaaucaugaauauuuucaccaccuagaaugaccaauguuugaggagauauuuucagucugacuuaaauauuacacaaaguauaacgcuucaaaauaucacagcaauagaagauaucaaguuaugagcuuacuuaugccauguuaguaaacuaacaaacaccuccuuagcagaaccaaaugcaggcccucuuaugacuuuauacuaugcacuacaaaaacgcuuggaucucaacauccaucuuugaaucuacugagggcaaauaauuuguugccuguugagguuaugcaggcuguaagaaaauaucaggucaaagcauacucauauaaggcaauggaugacugggugagucacguggagcauaaucuagacuuguuuuuaagaaacauaugcuccgcccagggaguggcacuauuagaagguauggcccuguuggaguaggugugucacugugggugugugcuuuaagacucucauccuagcuuccuggaaggaguauucugcuaucagccaucagaugaagauguagaacucucagcuccucuuacaccaugccggccuggaugcugccauguucaugacuugaugauaauggacugaaccucugaagcuguaagccagccccaauuaaauguugucuuuauaagauuugccuuggucauggugucuguucagagcaguaaaacccuaagacacauaugguuguaucagguaguaagacuggaaaaaggagaacaaaaacaaaaacaaacaaacaggaaaggaagugggugagggacaaagagaggaagagaaagaaauggauaaacucaaccagagaugauacagagcuggagagagugaaaugagagguagcccaugggagaguauaugcaagaaaaugauauacuuaacagaaaacguagacaugcacaucugagagagagagacaugguggcuaaaguaagggauuuagcuugugacaaauugaaauccgagaagaaaggaauauagaauuuguaauaaauaaauaaauaaauaaauaaauaaauaaauaaauaaauaaauaagugaucacauugcaaauuagaaauacauaucauaucuugguaaaauugcagaauaucaaauccaaagucuuuagaaagagucagaagcgaaaagccuggcaucaucaaaaagaaaacauuaccauggucaaaagggaaaccccagaaggugccacacacuccgguugagucagcuugacaggccaagaggccuggaagcacuuaagaggcagagaguuucacggaaacucaacuucuggaguuuggcguucucauucaaccacauacucauacacuauucccgaguuagucugguguauggauccacgugcucucuuuuaguauuaucuuauuauaagugccuuuuaagauugaauucugacauagcuaagccuuugccaguguucuaauguccuagaaaguccuugagcugaccaugggcuuggaauucaguaagaauguugccuauucagugacauucagaauugccucugauauuacacuaucacuuugaauaaaaacuaagugacugcccuacacaggaauuuaccaucaucuaggaagaaggaaguuugagaccuaaggaggaaccagaguagauacuuagaacuauagauggcugaguuacacccauacacacauauuuacaauggccuagggggaagguagacuauacaauagacuaaaauaggaacuauggcaagggcaugaagcccuugacccuggcuucuaagauuaaguggaccuuagguggagcucuuuuugaucccaguuguuaacaaugaauucuaucccaggugguuccugucagaccuucuguguuugcauuccucuguuuuguguaagaauccaguaaccucuuuguaccuuguuggugugucacccaacuucccuauuuucuucuguauaaaaaguuugaugcuugauuugacaaauuacauucagauucuacacaaccucuccuguguuggucugucugucauucccucugacgcuuugcccaccugccccauagacccguucuacacagacaaugggauccagagggucugcggcaagaagguccaauaacuucagagucuucugaaguguaugcuaaguguguguggcgguaccuucagaguccagaggaagguaucagauccugugcagcuggagguacaaguagccauguacagcucagcacaggagcugggaauggaacuuggcuccucuacaaaagcaguguacauucuucaccauggaaacauucugacaagcuuccuggagagccuuaaaaaauggucacccuguuucuaaugaaaacuuugaauaaacgaugacuuauauagggagauauaagaaugaaaacacaaauaaauugucauaauagagcacugguuuuaauuauauucauuagguauuaguauauauagaaauuuuagaaauauauaaguaggauacaaauaaaagcaaacuguaucgaguagaguuaauauaauaaaaacuuguaccaaucuuuugagggcucacuuuuuuucuaacuaaugaagaucauauucaaguauugauuccauacugggcaggcaaugaagacaauaauguaugcugacugguuacaaaucaaauaaauuuugccucaauuuucuaaauauucuauaaaauuaucuuauuuggaaguuauuagaaauuuauuuugaaaguaaacagcauuucuaaauaaccuaaugggccaaaaaauuuuacaacagaagauggauggaaaugauucuagaaugggauuugaacucgaccuggugacauaucacugcaguccuuacauggagggaacagaaauaaguuuauaagucuaacaccagccugggcuacacagugggauccuguguaaaacauuauuuuaaugaaacaauaaaaauuuccuauaauuaaaauuuaaagaaagcagcagaaauucaacuuaaguuaaucuuuuauccauucauaguagaaaagaccaaugguaccaaaucaagcauuguuuagcugagagaaaagaacaguaaaccaagcccaaagaaguucaagaaagaaaacaguaagaacaaaacuaugauccuccaaaaaggcugcaucaaugcuaacauccugguguccucuccucuaucaaagaugggugaccuguguaaaaauagaauguaccagaaauguucagugacuacugaagccacaucacagaaaaucuccacaauuucugcuugcucauaaaaacugcaaauccuaaaguuuugauugguuucagaagcuauguucuggauuaauucuuuaaugauagcuuguacaacuagcgagacagaaaaaucaauaucuaauggaaauauucaacaguugcuauauguuuauuccuuagaaaaauuaacaauagcuaaaacaaaaauaaugcucauuugaugagauguacaagaaaaaaauuucaaauguauggugucagaaaugacaaauaaaaugugcagguuauaaguuggcacuagagagauagaaaaguugauaaguuaugccaauaaauuuugaaauuuuaggaaauaaaaauaacuagaaaacuauaacuuuauuaauuacugaugaaucgguuauuauaacaaacagaauagaaaaucagugccuuaaaauguauauuuauuucucuuuaagaguccuagggaaccacauuuuuuauuaauuuauucaucuuuucacuuuacaucuggaucacagccccuccauccucuccuuccaaucccagccucacacacguccuuccuccauucuccuccuggccuuuuccucagagaugggaaagccccucagggauaccaaccugcccuggcacaucaagugacagcaggacuaagcacauccucucccccugaagccagauaaggcaauccaguuaggggaaggggauccaaagucagggaacagagucauagaaagccccugcuccaacuguuaggggaaccccauaaagaacaagcgacacaucugcuacacauggguagaggaccuagguccagcccaugugugcaugcucuuugguuggugguucagucucugugagccucugggauuguugggaacuaaaaagggcgcccuguggaagagggggaagggaaaacccacacacugccagaguuuuaccuauucucuggucugucaguugugggagggcugcuaucuaccauccacucaucccagggugagcaucuaagccucugacccagucuucagggaguggccaaggggcagcccuaccugggaaccccagagcuacuuugcaaaagccaccaggguuauaggagagagggaugagggaagagguucccaacaccggcgagagugagugcagcagaucuugacuggagcacaggaaggccuucuaacaggagauuagaaauggcucauuagucucuagaugggccauccuuucaauucagaaacaaacuuugugucuguaacuccuuccauggguguuuuguucccaauucuaagaaggggcaaaguguccacacuuuggccuucguucuucuugagucucauguauuuugcaaauuguaucuuguaucuuggguauucuaaguuucugggccacuuauccacuuaucagugaguacauaucauuugaguucuuuugugauuggguuaccucacucaggaugaugcccuccagguccauccauuugccuaggaauuucauaaauucauucuuuuuaauggcugaguaguacuccacuguguaaauguacuacauuuucuauauccauuccucuguugagggauaucuaggauccaucccauaaucggccuccaaacguugacaccauugcauacaccagcaagauuuugcugaaaggacccugauauagcuaucucuugugaggcuaugccggggccuggcaaacacagaagugaaugcucacagucagcuauuggauggaacacagggcccccaauugagcagcuagagaaaguacccaaagagcuaaaggggucugcaacccuauaggucucuagcugcauauguaugagaagauggccuagucagccaucauugggacgagaggccccuuggucuugcaaacuuuauaugccucaguacaggggaauaccagggccaagaagugggaguggguggguaggggaguggggggaaaguguaugggggacuuuugggauagcauuugaaauguaaaugaagaaaauaccuaauaaaaauuauuuaaaaaagaaagaaauggcucauuaggagaaaaccugucccauccuccaagcacagugggccuugaugagcagagacauucuaugguuuuagagcuuuauuauagaaaagcagggagaaagagagaagagggggaaggcuagagagaacgagaguaagagggagagaaaagaggagaggagaagacaaagagaaaggagagaagaggaagaaagaaaggagagaagggguaagaguuagggguaagagggagacaagagagcgagaaguaagaggagcaagagagcgagguggggcugaacagcccuuuuuauggucuuuacuguugcuagguaacuggggaggcauuuagccugaaggucagaagcuugggcuauuguguacaugacuucuagccauacuucccuugugggagaguccaccacaguguaacauucacaguaaguggccuucuucaugcugcugcuaccauccauauaggugguugaaguuauguucacugugagagacacgucacucuccaucaucaagauagaagcagaaaaacaugagaaaagauguaaaggagcaauaaagcccagaaccagagucuuaguuaggguuuugcugcugugaacagacaacaugaccaaggcaacccuuauaaggacaauauuuaauuggggcuggcuuacagguucagagauuaagucuuguaucaucaaggcgggaacaugucagcauccagauaggcaugguauaggagaugcuuagaguucugcaucuucauccgaagacugcuaagaaaauacuggcuuccaggcagcuaggaccgggguauuaaagcccaugaccacagugacacacuuacuccagcaaggccacaccuccuaauagugccacucccugggucaagcauauucaaaccaucacaaccaggaaugguauccaucacuucugcucccuuuccaguacuaaaagcuaaucagaaagccauaucugacagccaagaaagauagacgccauacaacuagagagaaauaugcuuaagaggcgcagaauaaauuuuagugaauaauucaucugcgucucacacauucaauucuucauuuuccuccaagcuccgucuaauucugccccgcagcacaaaguacaaaagccacucuuuuguguucuaauguccagauuaggcccagauguagcuaaaguuacaagccuagaaggaagaaaccucgucuucaacacgugcaaauugcaauaguucagugugaccucuagaccugcaauggucaguuuuaauaauauauaaaaaugaaugcauucaacagccuacaggaccuguagaagaggcugaaaggcucccauccuagucauuaucaauucuccaagguucucugaaguuccaaaauucugaauucuuuccaguccaucaggccucaaggccaaaucugaaucaggucuuggaaaggcuguaauuuuaauuaccugcuuuucacaagugucggugugaaagucagaacauuuuuagauggaccugccuucugguugcuucugaaaugcaaguaccuuggaaacucaauacuuucuagcuuguuuacuuccuguuagugucugugccaagaauggcacccagauuucauuuccgagcacagcucugacuuaacauucugguucccaugauccauuucucacuuccucaguuaaauucugucuccuuggagacugucugaguaaaggagcaugaagaaggaagagguuugcugucauggugcacagcacuauggacccuaauuuuccuaacuggaaggcacugagaaaggcaugagcuaucacaauaguaguucauguuauuaagaugcggaauuaaaauucuacuuuggcuauuuuucucaauuuuucuauuuuuagaguuuuuuucuuuuaaauuguuuuauuuuacuguuguaugacauagcacugaggcuugcccccauagccuugcacauguuagcuaaagcuacaguccagauuucuccucucuccucaccaggucuuagcugaguccauagcuuucucacuguccucuggcaaaagcaucaggccaggcaguagucagcuugacaaccauucgcaucagucucuguaugaguggccagccgcucuagucauggcaggaaacaguuuuccugacucuuuugcaauggcaaagcgaagacucccaguuuuguaacuagguggcauaucaaagucccaacccuccuuugcucauggacuuuaagucuuacagaaucccucuuugugguuaaaucacuauauguuuaagcucacauuaaguaguugaaacugaccuccuuaaauauagagguuuaaagaauguaggcacugcuggaagaucauaauguuuuggagaaggggagauccagaaggccagcuuuuuggacuugacuccaaauucaaugcauuauuauguaacucuggccucugggucuuaaguuucuauuaauacagugguuaucacuuaucauuagugacugccaucuaauaaaacuaaaauugagccaguaauaguaacuacagccuacaguugguaagauuaaaaguauuaauaucuacguaacugaaggaacaaugcguaucacaugacaccauugaaucuuaagcaacagagauuucagggccagcucuggucaagacuauggugguuugaauaugcuugguccagggaguggcacuau

SEQ ID NO: 12 - RNA, 24264 nt, Mus musculus
cugggauucaggccccgagccuccucuuuaguacucucuauccaaaugacuuuuuuuuuuuuuuuuuuuacagacauucuccaccggcagaagaaucugcacaaacauggcagcauuuuuacuuguuuaaugaguuuaagacauuacaugauaaaaaacaaagauuuuggacuccuggauuuuuauuuaccaaucugagacugagaggaggaggaggaggaggaggaggaggaggaggaggaggaggaggaggaggaagaggaggaggaggaggaggaggaggagaagaagaagaagaagaagaagaagaagaagaagaagaagaagaagaagaagaagaagaagaaaagaaauggaagaaccccccccccaauaucucuucaagaaagaagaaaauuugguuguaaaaaguagaacauugccacaaaggaaacacugcaugucuuuucaaaaugcaaugaucaggaaugacaacucagcuaauacaaacaguaacagcaacaagaaagaugcucuuugcauaacccaccuccaaacucugaacuggaaagaagaaagaccaaggaaaacaaccaaaaucaccauucuauugcuuugacaccuuucuuaggugaauaguggcauucacuaagcuaauagggacguuuauaucaaggaacauuucuguauauauuguugaauuuuaguuguauauauacuuuguauguuuuugucuucuuucauauauggaguaaaagccacaaaauguugggaguguccucuacugcuccaggucucugucugucuauccuuccucccuuuccacuauauuuucuaucucucuuaaaauaauuuuuguuuccuaauauggugugcucuauacauacguauucagugccugaaaagaugucaguuucuaccacaagucuuugucucagguacuuuaacaugagccauggguguucucaggcuuucauuuuaauuuuguugugauucacacacacuuuuguauuuuuaaacauuagaauaaccuagacacagcuuaacuuuuagacauccagacaauuccauacuguaucugaauauucuccuuccccuuucccuagauaaaauaguacagcuauauuugccuuuggaagcauuuuuuuaaaaaaaaguaaaaagagaaaagaauaacaaacccagaaagcaaagugcacaauuuugaccacuuaauguuaaaaacccguugcaagcuagcaagguaggaaaauguucuauccugcaagaaacacauccuuccgaucucguggaaagcaaagaaauaaugaaaaugaaaaguccuuucgucauacaagcaggaagccccauacugugagaauuaauggcuacagaccugggcauccuucaaauuaugaaccuugaaaccacugagccauuuaucagaagucaauagagauacucagagugcuccauauaaugacagcgacauacagucgugcaaaaggacagucacuauaauuagacacaaagcaaagacuacuuaccaauauccccguucccuuuuuuguugagcaacuuccacgcucagucagucuucagaaugguuuaaaaccgaucagucuugucauuuucuagcauucgcauuguuacauuaggaaaaauguuuucuuuucuuuuuucccccuuccuacugugaaacuuuggguucguagcuccccaggaucaauucugaacaaagccuccagcugcagugccauccaauuugaagcagacauuggggacaauuuaagguuuuuauccacaagaagguuuuuuuccauucucuuaaaugcagccauaauuagaguaauuuuucauguagcccgcugauuacagcguuuuuaccgucaaagauaauuaccuguaauuuucuuccacuuuuaauacuaaaaagccaucuuuauuuagauucaggaacaggaaaggcgaaacaaaagagggaaauuauucuguuauucauacacaaauugcagagacguaggaccuaaaauugaaaauuaaccaaaauuauaaugcuggaaagaauggaagaggcugcagaaguacagcugguaguagggcuuugcugaauuauucaaauuauguuagagaaaaagcuaccauauaucgaaaccaacacuaauuuuuccuuaaaaaauuucaccaaauauaugccaaaccacugugaguguauagaauucugaaaccagaaaauguuuauuacuagguuggagguggggcugaugccucugcauccaucuuuaucuccuauugaacaugagcuuaguuacagagaugcugucagauaguccccuagaacucugcuuagaacugggcucccacuggauucccugaacuccaaggguuaauaguuuuuucuccuuuaaaauguauugacccccaaggaaacucguuccccgagggagggauugguaggaggagcaugggugaaagguguugccaguugaggugucuauugcgccuccccauguucaaacucccuacuagacuguagaguuugaguucccaagcccuguucugacuauacuaaagggcuggggugaggagcauagcuauuggguaggaauauaagagagagacaacuucuccuccucucuaacaaauaaacaccacauuaucuuuggacacaauuuagugcaaagguucuugccaugguagaaaagcuucucucggcagggugggcagucaaagacauugugggauccuauacuaagcacucuagcuacuuauaacauuuacagggucagggaacagcgucaucuagagacggaacagcacagcuuguugccaauaucuuccucgguacauagacuacacugguuccuuggcuucauaaguugucgauucugugucccaaccaaucaucccccucuaagcccaggaucacagaauuugggcucagcaggcaauaagcuccacggucuggauaccuuccccucccccacuccccacuccccucugcgcucucgcucucucucucucucucucucucucucucucucucucucucucucucacacacacacacacacacacacacacacacacacacacacggacagggagauacagagagacagagacuacagcucuaugcaaggcccuacggaacagccuugaaggguuucagaugccauuuauucuacaaacuuucccccagcuggagagaagaugcccaaagggcugcaaagcccagagauucaggcacaccugcuuuugcuaacauccauccccauagcugacugcaaagaagcaagccacacagccagcucuguuugaucucugaugccucaaaaccuaaaaucauggccgcauauaaaaaccucaauguauuuacuuaagaucaauuguaaguaacaauuuucagauagauuuuuagcuuggacucucgggcuccuucuacaacucgcagaaaccugguccuuucuucgucucaagucacagacuacaccaaacacaucagucgcacggaagcaagacaggcaagucagguucuuagggaucccauucucaccagaucaacucuuacuguuaaaggaaaauaaaaggucagagcccaaaccuugaaaccaaaguugcaauucaaguaaaucacaacaacauauuguauauagcuuggagagucugagaggagaaauaaaaacaguacuuagaaguuagaaguaugccaaaaauaaaaacuuaccccggugaauaucucuuaagcaaugaucagggucuagaaaucuauacugagcggagggaggcacaggagagcguuucucugagucucagggcagaggcucugucucuauauucuugguugagugagcacauccaggugugaaauuguuugcacaccccagcaccucuuauauugccagcaaaauuagcuguuauuacugucacuguuuagugaugguuagcgugauacaaaaaaaaaaaaaaaaaaaaaaaaaaaaagcugcuguaaucaagaccuggcgcaucuuugcaaauuacagauaauuguaaacguccagauuaugauaauagcauccuaauccagccugcaauauaauuauuacagaguguuacaucugaaacuguccaguagggcuaauucagccauuauuuagacccuauuuuuuguacugcaaauggguugcugaguugaaaauguacgauuguaauuucacagggcacucaaugaguaaugguauaggaagagggaaaguacaaaagugaaaugugaacaguagcgaucaaaucaaacccugaaggacaaaagacuguuugauucauauggaaaaagaagagccagaauuaagaaaauagcaaaucagcagucugaaguauuauguguccaagucuuccaccgugcagagcuggugcauucacagggccccugcugcugcugcugccucugcugcugcugcugccucugcugcugcugcugccugcaggcucaaauaguuuuuuuuuuucuuuuuuuuuucuuuuaaaaacuacucccgucuuucuucccucuaccauagcauuuuccuacucuuaaaggugcccuucccccacagccccucccccacagcaaaggauauuugucagucccuccacucucuccaccaaagccaccucagaaugugccugucacuuguuuauaaacauauucuuauaugaaucuacaauugcucuugucaucagagccaacugcccugggugcuguaaagugugucuucccucuaucccucuucucuuuuacaauaaagaagcucuacugcguccuagaggauauuagcugaacacguauuaauuaauguuaauuaaauauagccaucugggaagcuguugguuugguuaauauuuuaaauuucaucauuaacuuuauuagugaccccccccccaauaaaccauucugguugcuucuaugucacaauucgccuaacagggcaagguuccugaucauguucaaacaggaaaggacagaauggaaaagggaaagagagcucaagagagauggggagacucuuucugguccuggagucaaacucucugaggauucuauuacuugcagaaauauaagucaugcccuagcagagucuggauuaguuagccuagccucuggauuaguucugguagcgacaucccaguuagaguacaucccagucagagauaccuaaaccuuguaucccaggacuucaguuucccuguugagcacagagaauuucuucagccucuuuuccaguuucaaagccaauuguguugauuuccccuccucccaaggacaucuuaccgacccacacaagcugcccaaccaaggccacccugcaggguggcaagcaggcucccuagcuccugugaauuuaagggcaauaaugaaauguccccuguuuagugaccccuguuuauagaugaaaguugaguccauaucccgcacccccuuccacccacccuucccccccucuugcaaauggcaaguggcugaaauaguucuaggugagaauaagcguccgcuggcgguuucuguuuucacgccuuucaaggaaaagaaaugcuuuaagauaaaucauagcuuugaaccguuuaccauccuucacacccaccccaccaaaacaacaacaacaacaacaacaacaacaaaaacaacaaaaaaccaaaacaaaacaaaauaaaagcaauagacuguguaugguggauuccacagagaauuguuauugaaacugggagggaggagagaaggguggggggaucaggucaugaagccauuuucccuuccuguggugaaaggucauaaugugugguauuucacgguuucauauaaaccuugguuuaggaugcggaacagacucaauaauacgugugcuuuuggcaaagaaaugaauucagaaccacuuaaaucagaaguccgagcgagcgaacaacgcgcagaaacaucucauugcuguuaagaacaggacucgccuuuccuuuaaagagagacucgcuuaaauucgguuuguaucuucaaaguuagaacucaaaaguauaaaacagguuguuacauuacaguaggcagcccuagcugaccgcgaaggaaaggcuccuccaucccucagucauucauaccucuggcaguagacaccuuguacccuuucugccuugcaccacuuaaaaaucuaaagccugucagaagcaaaagaaaacgccagggaugcgagucuccgguacaggcugcguggaaagguuuaacuaauaccaugcgcaccaccaagauuugggcuguuuucucucggccugggauugggucaaaaaugugcaaggucugugggcaaccuggaaacaagaggguggugggagccaggagucggagaccagaguaagucaaggagcccccuccccaagcgcugggcaguguaaacccgcacccagcagacgggggugcgggggggagggggagggaggaaggugcuugagaguggaggagguggggacugcaggcugauccucgcgggugccgcacuucccaaccaccucucugagcuacugcccucagggcgugccuucuccaagagcuggagagcucuaaguuggccagaucccagcagccagugggaggcacuggauccaagagguggcggagaaggggcugggauggggugacugaguaguccuaaaggucucucuuugggaacaauaggaagcaagaagcagagggugagugcagagcaguuuccagcaggcauccagggcaauucaagcuagagagugcucgguacugaauuguggagguggcugugugcuguaacgcccaacucaggcuugcugugggucagucaggagcccgcgagccacugggcgucccgugcgaucaaaggagccaucggaggccagccggcacgccuugggucgugggauaaggggcgggggagaaaggguuguccuuaggcggggagauacugaucuggcccgugucacugggaggggaugcguguacaccuuugugugggucaaagcuuuucuaugcaaggcagagcccuaggguggauccgagggggaguggacugacucccggguaggugcggggcgagagagagagagagagagagagagagagagagagagagagagagagagauagagauagaucaagggcagcgaggucugcggguucuucagugugugugugugugugugugugugugugugugugugugugugugugugugaggcucuguggcucagcacuggagccgccuggcacccacaggaaugcagcuucccucggauccccaggccgccucuugucccacaaggagguggccgccaggaaaaaaaaggggggagaaugaggguagaaacccgccuagcccaacccaagucucaaacaaaggccaauuuaucugaucuucaacaggagggcuccggagucgggcagggcaccgaggaaaucacucaagcccugccaacaugccuugggccucugagucuuugcagggaggucucaagauggaggucgaaaguauugcguggauggggggaggucuacggugaagaaaauuaguucugaagucggcuuaauucaucuucggggcauuagacagaggacuaggcaagugaggaacagaaggggcaggcgcaagagacuucuacuugaaguccagggcuagcggggucugucagugccaaaauggaaggacaugcgcuugguacacacaggaagaaacaauggagaggugagagggagggcaagagaaacagauauuuuuagacuuugcugaggaucuguuauuuuuacauccuugggcgcaggacugcagggaguuaaauuccccagggagaauccccgcagugccaggaaagcccguugcggcucacuugccagaauauuuuuuguucaccgcuccccauccaaguugaaaaaaaaaaaaaaaacccucccaauucaagagaccucuacuagugaggcucacacaggggaugcaauccuaaaaccaggucccaaccccugccauugcugcuccaggcuuuuggcguagcaacaaaccaacuuugguguccuuaacaaccagcaaugucccaguuuggggugaaggauggugauuaaagagcaucccucuuuuuuccugagaaaaguccggacccgcccuugccuuugcuuggcugaaucugagggucggagguaguguagaaaacuacacacaccccuuccuaccagcgcagcagcagggagaugacauccacccucuccgaaugccaagacggaaagagcuuguucccagcacaguuuugacacucuugggaaaccagugggcgagaaauauugggggggggggugcgauggauguccuccgcccuugccaaccuucccaaauauacacuccuggguggggacaggccugugaccaccagaaagccagguccuggaaaucaagaccaagccuucagaaagcugugggcauuugguuaauggaaacugcugaaaucuugcaagcaaagaaagagcagaaaauagauacccucaucuccuccauucuacucccuguacacuacagaaaacaaaauggggccaggaccuccccuaacaccacugccccccacagauagaguggagugaggacaggggauaaauuucuguuuaggcaggcuguuuccaggcugcccaggcugccuggaaauauauguuggccauccccaaguccacugaguuucaaacuggugggauugguaucaccugugcaaagaaagaacaagaaaagagaaaggagaacaaauggagauagaaggcugaugggaacggaggaaugggaagagacuggagaggcagaaacugacucuguaaauggcccaagggcacacagcuugcccuuuccguucucacugcugguucucucugaaauucugagaugagaagaugcaguuuuucaugcucuaaucccccuucccaagagggcgcuuuugucacauuuauugcugccgacuucuuagcucuggaauauuucccauaaaucuaguaauuucuaacauuacauauucuuuggaaauagacuuagauggaccaaaggacagccagccacaaagaugccuauaauucaggccuuggggcacagccguggagccacgcuguagcucugggcauaggcuagauaucuacaugcagaaguguaagggacgcacaaaucagaggccagguugcugcaacucccauccuccuuccuuaaagauggcuucacaaaggaauucuagcaaacaucgcauuuccgaugacuuggaacuugccuggccccuguuuuauguaaaagcagcacaggagauccugaaagaggcaugaaguacggaugccggugaaagacaauuauaugaagaaccuuaucacaagaaaugaaaccaauauagccccccccccaccuuuuugaaaaguaauucuccccacccccauauuucuuguuuggcccaguacuucagguucacuauuguucugaaucccuaugguauuuucuuggcagaaagaaccuggccagauuuguagucauccacauuaggacuccaaggcuuaaacuacugcuugcuaugccccaaacauuucauauuuuugagaaaaaaaaacuauauauauaugaggaaugauaacaaauuuccuuuucuuccccugucucauaauugcaauacacaugcagaugggggaggggguccccaccagaaucacucugugcuuagaauaccagguuaucaagggauuucuguuggcuuuuucccucacacacgguaggagaaauguaguuaauuucaauauuccuuccuacccaaaacauuuggagcuauauuuaauaucauuuaaaugguuuugugguuagagggaaaaaaccauccuaaacacgacaguacuauaaacaggccauaugugcagacagauacaugaaauagagcauccaacacaaacacauuucugcaaccagacagcuccugacuucuguuuugcauuguuggauuucuggagaauucaucuguucuuaaccgucugcauauaaccucacuagccaguuaucagggggccaaaaaggagcaguuuccauggucgaaauaauuuuauuuauccagaauauacaguuuaauuccucuaucuacacuuauuuacacgguuaaaauaacauugaaaaaagucuuuugaaaaguugaggucauagauuucaaggcaccauugauaguguccacaguugcgcaaaaaaaaaaaaaaaaaggguucuuuucguaaaaaagggggcggggcucucugaaaugcaauaacuuacaugcaaaaaaaaaguuuacacaugaaucuuuuuuguuuccauuguucaaacauccccguaugaauuccuuucuuucugauuucuaaaccagcacaacacuguagucccaaaacugagcaagagaaaguagcccaucuaauaaagcgucccggaggccagugccagcgggugcugcaaggagcccggcgguggcaggugggaauugauugagcuggcugcgcuuggguaccaggaagccgaguucuccagguagcuggacgcgggggacugguuggaggucggagggugggcaugagggugguggcugagagagcgggaugagcccuggggcucccacaccgcuggugacuguggcgaguuacacgccauagggucgcuggagcugggacugugcuccgggggcaucuccccguuuuucaugaucuucuugaucuuggaucuuuuguucugaaaccagauuuucaccuggguggggaacaaaggcacacguuaccgggacacucagagguugcacgcgccuuucccugagcgacgaaugaaggcucuccuggcccuagacuauccugcccugauaacuaacuaccagcagcaagccgcccaucgccaggagguugcaguuucagccuaggcaaugggagggacgcacagagggagcucuguccagcucagcgggaaccagcuucugcuaccccaaggcuuugucuuuuauucacucuagaccuggucgcacgugugggccugugcaccaggucacuggggaggauaccucuccugcucgaaggccagaguccccgauggggaggggcuugggccaaacuguaggugcacugugccaagggaaaggagagauuguccaaucuccuguccaacucccuucaguccccucggcacugggaggccagacucugccugaagcucugggcugcgacuugaacauuccuuauucuaggccccagcgggcgggguugggagggaaaagaaggggacaaucccggaggguuuccccguacaacagcgccccccaccucgcgaccuucaggcugcugaggcuugaucugccucagggauagggucgaccgggacaggacgauccaggccuuugcauggcuggagacucaucaucaggccaauaguaaggcaagcuucucacugugaagggacccagaccuuuuucaagagcgcgaggcagauucccccuccucccagaaauaccccuucucuuguuuucacuauggaaccuugguccccagccuuuggugguuaaagcagggguggguuugggugggaggggauggcggcaacucgggacaaacgacgaaucccgcgcccaccgccacgugggccuggcucauggagggaaagaugcaucgguuggugucuuucuaucugugaauuucugcaaagugcuagagaaucggcuccagccagucgggaccgaaccuugcagccgagcugggcuugcaggcgaggcggggccgguacuuggcggcggccggauuuaccuguguuugcgucaguccuagagaggcggccaacuccgcgcguucuggcagggcgagguacugagucuucugaaaccuucucuguaaagcggccagcugaaagcuggaauaaauaguccuggguuuacgaacuuucuuugguuuaccauucaccauccucaccucuggcuccgccacuucuuucucuaaauaaccaaaacagacuagguuagagcuuccuggcagacaauggcucguuugcacaggcccucaaaucagcgagauuuuguuuguuuugaaauauguagucaucuuucucuuucccaauaucacaaucuuggcuuuucaaaccccagagaaaucugucccauccucagaucauacauggaagagcuggcgagucucugacuacuagccacugugugcguggggcacuuuguacacaucaaguucuucgcuuuagggauggaacccuuuggagaugcuuauuuuucucauuauuuuuucccucccuguauucaccuuguguguuucugggacgcgaauagccacuccaaucccugggcgucacgcgaggaggccccugggccaugacccucugucggcgucuguucgggcgcccgcagaggcuagacgcuugggcagggaagacgcuagccaagggcuccaaaguucaaagaccgacaagcaaacuauguuccuucacuacagcggcaagcggucggucggggcugcggcagacagagagccgauuauguaguccccauaaucucacugcagaucugagagggcacagaugugucugguuucuuucacaaauagacuuaauauguucuugaccaaaaaaaaaaaaaaaaaaaauccucucccuaugcaaggauacagagacagcaagaggagcagacucaaacuuccaucaacaauguauugcaaaggaaucuguaguaaggauauuuucguaguaaaggggaggaaccaaggaagaauucucacugucauaaauguaccccgcugggguccugugaauccguguuuugcuaaugugccccuaggccacauggccccuuuucccccuucaguccugaaaggaguggaagagucgguguaugaagcugcugccagaggaaggguggagaaggagggagggcugcggucuccgcucuacuggaguaggggaugcuaauauuagcagccuuauuaaugugucggugaggggagaucaaaaucgacuaguaaaauuucuccacugagacuucacgccucucauuuaccgcccaagcucucuaccccacuguaacgcucuaaggaaguuucacaguggacggaaaggggagucuguggggaagaaggaaggcagacaaauucuaggcacuuacggagagagcacucgauggagugugugugugugugugggggggggucccucuaacagagugaacucucggcaauccuccgcuauuuuaaaugacuuuuuguauuuggaaauaccuuggauaaaccgcaaaguucccuguucgcuuuucugucaggcugcagcccuccggcccccaggucacccggugugcugcccgcacccuccaugagaggccucggggcgcuucgcuggcuaauccagacuagaucucaccaacucagcacgcucacccagaauuccaacuaacuuuccuuuuauuacgcaaacaccacuagggcugcuugauuucacccaccccccgccccccaaaucccuuagccucuuugcagccaagcuggcuuucuggcuaggccagcuaggaauccagcuaaggagggauccucgagcagcgccagaggcaaaacacccgauuaaaccucuucaaaaguccuccacugcccccccccccaugccggugugaggugcuguccuguuugcagucccaggcccccacucgcuucugcgaagcacccuucuaugggugcggacagcguggcccucaucuaccacccaacuuggcgcccgcgggguuacggaugcccuggguaccugccucccgcccccgcgcgccuaccuggcuggcugguggcacucgggacgcgguuguaggcgccgccguacuggugguaggggcuggcguagccguagucggcauaagccuuggccggguagccggcugcggagccguucacgccgugguacugguacugguagggguugagcgcuuugccauaagaagcagagguaggagagcaguagccgugcggggcggcccccgcgggacuguaguagucagaaucgguggccgaggacucgggcaaaguuggcgauuccugagacggguggugcauggcggcggacgucgggaacggagcuuggaagucgccggaucggaugcuugggacucuucugucaaacacuccugucauagcucccgggcgguggcuguucuucuacugcggcggccgcugcugccugaauuggcuguggagcugcucuggucuaagcagacauggcugugggagcgagggaggaggaggaagaggaggaggcggcggcggcggcggggaggaggaggaggaggaggcugggagucguggaggcucugucucccgcaggcugacugcuggcugaggcgcagcacagccuugguuaaauccuuaauugcgcgcuuacgcacagcgggguggaucggguuccauuggccagggcuucgggagcagagcaacacccuaacucguccaacuaguuuuagcacaacaaagcauugcuuaaagagagagagagagagagagagagagagagagagagagagagagagagagagagagagagagaggcguacaaggagagagagagugugugugugugugugugugugugugugugugugagagagagagagagagagagagagagagagagagagagagagagagagagagaauaugaguuguucccuguugggggagggagggucucagucgaucucuuuuuagugaauagcuucgacaaaccaagcagucccagggccuagcuccgugcuguuugaagacaacguguuccaaucagcaaucucaaaaguacaguuuagaggaugcgguucuugaugcucuuuucuugcuccacaccuaccaguccucuccccccuccuccgacggagacuguaggagagagcaccgcugugggacugugugcagaggaggagcaguguuagauggcagugagaacaaauggagaacagcauugucuuagugggaugaugggaagcaaguugcaacuaauuuauguugaaaauuuguaaacuggaaaacaguuggacacgcagcaagcgcuuuugcagaagccccuguuucucaggacuccacagagauguccaagaaucuagacguccccaguggcaacugaagucuuuacagggacugcugaaaaucaaugucuuucauuccugaauaccuugccacugccugaacucucuuaguuggcuuucccagagagcugagcagccuuuugguuuuuugcucaauauccucgacuacuuggaagcuucuagaauggcucuugucucaguucaggagccagauuccugcaaacgugaauugauuugggugugugaccuauagugugccuccagaccaaauggaguaugaagaccgaaaaguaggcaaggaaccaaguccgcuugggagaugggguuucgaucauggacgacccucuccugguuccauuaccuacauccacuccaaucccccucucaauucuugaguuuggguucuguagcaucccccauuauuuccugccuacugagcaucuucguuuauguacaaagggagcaggguucaagacucauacacuggccacagaccaccagaagaaguuuauuuugucaacaugggcuuuuccucuaguuaugauugagugaggccuuaggaauguguucugauccucacucaaugcugugucuacuccccucaaaaaugaguuguauccuauuuugggccuccuuuuggccaggaaccugggagugucauugaauguucaggguggaaucuucugguuccucuucugguuccccuuuugccaggggaagaagugaaaaucugccugaguuuugucugagguuacuuuguucuuguuuuggcaaccaaggacuccaagccucugucagagagcuggaagcaggaggucagucccucucuggaaucuggagcugcaacuggaagcagcaacacgugccucaggugcacaugggccccauaaacccaggcuacuguugcuuuuccuuggcuguacaacuucagcuuuugucaacaacgagagggagcuagcaugcagcagggccaccccuuucuucaucuggagucccuacuugcagccuuggugucucuagauuucccuucugacacagauguguggguuuaacaaauguuugcuguuccuugacacugaucccuugccuuugauuuucauguggcuguccaggcucuagauuugcacugagugucuucaaggaggcaaacguacugcugaccuuacuggauuaugauugcggucugcucuaaagaugcucaccuaauccauggggccuuacaaaucaaugccuugagcuggucaaaguguucagagguuauaaaaaaaaaaagugcagagagaugggugaucccaucacaggccccaauuuuauuuacuauaaauuuaaauguaauaaccaggaggaaaaaggucagcauggucauuaucgccagaaggagucuaauaguucucuuaaaccuuggugagaaggcagcuucccaugacccugauacuggaaacugcagauauacuucauguuauauugguaagauaauucuacaucuugcuagcauuuacucgcugcuuccuuuucucaguggagauaugcauuuacacauauggauguacacacauacauuauugcacaugucuguauauauuacacauauauacacauauacgcauguaaagauauauuacacacaaaaauguauuuaugaacaaugaaauauauauauacauauaugaauaaugaaaaaggauggguaaggagaaaagaaugcgccaucucuacauauaaccugaagugcugaaagacuggccuuuaugcagauguaaaccuguuguaguaaguccaguucagggugaaaucaccaacuuggagccucuuugaaauucaccaaucucaacuuucuuuauggcuuuucugaguugaguuuugucacuuuccauccuuuccuuaaauacagucaaguaagggccacuauagacagccucgagucugcucacaauauguaguccuguuuccuuucacaaggacacucccuguguucugugugcugcaggccgagcuacaagucuggucagcacuuuuggagccacacuuuggguuuuuuucuggccagggauguuaauuuugucaguucugaggagguggaucugacgccauggcuagggauaguacacuagugcuucucaaaucccaacugacgcaucggcggagaaaggaucccauaguaucacaaauuccuccagcaaagcucccugcugagacauguagggagccuguaauuucuuuggguagcugaaguuugcaaagggcuuguggcgaugggggggaaaagacccuaaagaagcgcaagccuuuaccacgagcgccacccaguguccgccaggaacaguguggauucagcaaauguccccagcucagaaucacucaggcuggucuugaaaggcggucauguuuugucucaacuuccaauaaacccuuuucuccauaccacgcuuuuuccuuucucucuuacauaguugugaggcgauuggaggacguugagagucauccucuuucuagacaaucugaggcagcacuccccuuuccaugcaaaugagggccagucaggcuucugcuggagaguggugccacucugagucaacagcguaaaccccacggaaggcgaguuuguacggguaugccauuuuauauauuuuauauauucacuuauuuagaugcagaaccucauguaucccaggcuggccacgaacuuucuguguaaaaaaggaugguguggugcuggccaucuaacucaggguuugugcuugccucaucugucagcugagcuaccccuuccccaguaggucagauaaauuaauggcaauauuaagucuuuucccuuuucugcuccaucugaaaaucucuuuaagugggaauagagcaucccuuaacuuugagugugagacucacuucaaugcacaaaaaaaaucuaagguuuuguuuuuaaagaugggaacuuuauauuacauuuuacacagcauucagauacaggauugcauaauauaugcugguguuacacaugcacacuugauguaagcaaggcugucuuggauauauauauauauauauauauauauauauauauacauacauauauauauacacacacacacacauauguauauauauguguguguguguguguguguguguguguguguguauguguguaucagggucacaucugcuuuuuuuuauuaaagucuugugcuuugucuuuuucuuuauuugccacggagaacugcuagcagggaaggucucuguuguguuuuuauugaucaugauucauggagggcguguuuguuuguuuguuuguuuuuguuugagacaggguuuuucuguguagcucuggcuguucugaaacuuacucuguagaucaggcuggccucagucucagagaucugccuacuucugccucccacauccugggaucaaaggugugugggcauggauuguguauuuauuuauuuauuuauuuauuuauuuauuuauuucacagaucucaaaaacaagacugauugggucaugcguucugugaaggcagaucugaguaaccacuuuauuucaauaacaccauagcuaucuuugagauagagcacuaugauugcauaauaacuuaguaaguuauuaaaggaauagcucuacacuguucuguaugauggccaugugacugcaguucuauggaucgauaugauuagaugagaguagugacugggaaaacuaaggaacaaacugcugaucacugauguuggcgaugcaagugaguggccugugcuacccacucuggucaaaaacugacucucugaggugguuaugaguuagcaaaaccauuuagucccccaucuacgaucaaaguuuuuguuuuauguuuaugaggccuaggccaagucaacacguucagaagcccauaggaacugacaauuaagccaccuugggagggagagggggaaaaaaggagcccaaaagagcaguagaagaaacaaaaggaaaaauucuuccuguuugaaaacuaauuacaauacccccuuaccuuugcuuuaaaauauauaugucuggaguuagagauugucuucaacaaaauaacuucgaagggcucacgauuagauaauuauauaaauauucugaauaaauuaaaaaucuccagagacaaaaccauuuuccacuuaauuuuaaccuaauaagauguucaguuuauuucgaaugauagcguaucauagagcuguacauauuuuguuuuuuauaauuaagacaugaaacuguguuuauucauuuagcuuaaacauaacuauuuaggaaaagacaucaaguauccucucaaaucuauucuauaugagaugaauuuggcacagcacagcugaaagcacuucaaguuuaucuaagcaggaaguaaauggguuuccauuauuacaugucuuugcaaaccaaaaucguggcacguuuuucaucguaagcucagaagaugaucucugugaaaggaaaguuuggcugugauacuauuuauauaacauugauucuuaaguguauaugaauauuccaguuacaaaugccccuggugcaguuauggagaacggaacugucagguggggauucaguaaccugggcgaguuuaagucaucgacaguggcauacugacugcaggcuuacguuagacuuuaaacuucugaggcuggguaaauggcuugguaaagugcuaccgugcaugaaugagaacugggauccagauccugagcagucaguuaaaggcuaagaauacuaacacaagccuaagaccccagcgcuggugaggcagaggggcagacacggagagccugucugccaaccuagucaaacggcaagcaaguucuagguucaaauuagauaaucugcauaaaacaaaacaaaggcaaagagaugagugaagcagauagucaucauuaaccccuggccuccacacagcuacacacgcucacaugugugcgcgcacacacgcauauacaucauaacacacaugcacacucacacaugugcauaaacauauauacaucauaacacauacacacacaugcccgcauacacauguacaucauaauacaccacacacacacacacacacacacacacacacacacacacacacucacugacuugaggccucuguaucuuaugauauagcaacacugugcaaagauguagaaaaccauuucuaaagucaaaucuauucagaguucucaaacacagugagccggguaaaguuugcagagcaagagagggcaugaagguggaugguagcagcucccggcauguugauggcaugcugcaccuguccaggagcucuggauuugugaaugaaagccauauacauacaccagcuaauuuggauaugccuugacuagcucaaugacugggcauuucuaaaccuccccacggcuagcacacaccccuccgguauuccugaguuaacaucuuuuaaaaucuauauuucaucucugcuacccguuaccuucuggggagccauagggcuguauuccuuuccaccuacauugcuggaugguuucuccccugcagcucuugauucugaucccucugucucugaguccugguuauucccuuuccuucuuucccuuggucucuugucugcgcaaucuaaguccuaucuuugucucccuacccagccauuggcucuauggcagucuuuauuaccaauugaagccagaugggcgcagggacccucaggucuggaagcgaggcuuuggggagccaaauuaagacaaagcauaagaaccaauucccaacagcggaugauauaauuuuaugaaacuucauugcacucugcccuaauuauaucauuuuaauagacuaaaacaaacaaaaagaaaacacaaaaccuuuucuacagcuguguuuauugccuuauaccuuuuauaaagaaaagaaucuuaaacaggcaaccccagccugagauaagagguccuccugcugagucgcacagcauaaucaagggaaggcacagugcccaccuggacucacguuucucuguucuugcagaagaaaaugaagacagcagaaaagaaaagucaauagcuuccaugagugcggugcagcugacggggccguggagccucucugaaagccgugaacagaaaacacguguuuccuagguucuggaaucuucucaauaacccuugacuuagcgagucaacucuagcggcagauucuacauccuugcauccaaccaaccuucuauugaaucuauuucugaagagaaacuaugcaugaagaagaugguagacuuucauuucccugucauuauucuauggguguagcauuugcauuguguuagucagucugaggaauuuagaaagaccgcagauagaucaugugcaaauaucauguaauuuuguguaaugauaguaugcuugcuuggaggcugggcagagaggaaugaucaucuagucacagggagcaguugauuaaaaucuacuuuuucaacauuaaaucuuuaauaauuguuaacaugcuauguaucagaagagcacgggugcuacaagcauuuggugaugcuuauaagcaaauauuuguaaauauauucacucaugucaauuuaucaauacaugcugauucuuaagguuugcauguaccccacuggcuugugcauuaggaagcuccacccucuuugaugugugcauuuucaucaacuaccaagaaaagugaggaacacuuaguugcuguuguaaauuuucaaguaugaaacuuacuauguuguacacaucacuacuaguucaaagugagauuuaaagaugacugaauuuuuuuuuuacaaguuuuaagaaaucuuggagccacaacuaugcagaucuuuaugaaacugcuggguuucagauagcaacagaauagauguagacaacacacuaaaucuuaugggaaaauuugaaggcauauguagaugaacaaaucaaauaguuaacuaacauauuuggccaagaaaagcugugcucgcacuuguaagaacaggauauauuacgaguuauccauuuucccuauaacucccuaauuuguuucuucauuauuggagucucagugcuuuggagugugauuuaaugccaccccccccccauacuugccauuuaaaauuucagacacucuuuucucuguaucauuuuaugagucacugagccagauggcaguuucuuaaccugcaugguaaauccgaagagagaaggggacuuugaguuuguuuuguuuuucaagacaagaguuucucuagguagcccugacuaucauaaaauuuacauuguacaccaggcugaccucaaacccugagaucugccugccucugccuuccaugugcugggauuaaagaugugugccaucacugccuggugggacuuucaguuuuuuagaaaauugaugcguguauauauguacaccucugugugaauuugcucgcgugcacgcagccucagaggccagaagagggcaucagugaauauauccaguaacuuaagugguaauaagcucccgaugcaguucugggaaugccauucagauccccuaaaagaacaguauguguucugaacugcugagugacuccuccacccccugggacauuuuccuauucuuacugagaaaaguaagugaaucagagaguaacuuuguuacagcgaaauauuuuaaagagaccuguuaauuauucauacuguugccauauggguuaggguggaaguaccuagcgauuaaaaucgccuacaaaacuccccaguuuauaagaacaaugaacaagacuagaagagaaauggaaaaacaagaagcagaagcagcagacucuaugcuccuaaguagucgcugaagggaugccggagaaguaacucauucuugggagaacaccgcucaaagaagucagaaugaucggggcuauggguacugauccuguaucacucuuaaaacuuugucuuaaagauuuguuuauucuauuuugcaaugugugaggggugugugugcauguauguaugugcaccaugugugugccuggucccugcagaagucauaccuucuggaacuggaguugugcaggguugugagccacaguguggcccugggaagcaaacucgaguugucagcaagagcaggaagugcucuucacugcugagccaucuuucuagcccugucacacacgguucgauuccuugugaucugugggacauugaucucccaccuugcaccacauaccuguuuagggaaaauguucuguauuuuugucuacuguaggagaccuucaucucugcucccaggguuauaaggagcgucuggcaggacuucugaagacucgacagauuucaagggcuuuuccccaaagaggcuuugcauguauucaugucuauuuucacaguggccuugagaagcagcucuguuaaacucuugcaggugguccucgguguuuauauauuugccuuucauugacuugaaucggcucaccuuccauagcggcacuccaaccucaccauuuacugguggguuugggcagugccaugguagcauugccacugccagaucugcuggccuuugaggacugguaugaaggaugcagacagucucccagcuaccucucacuaggccuaugaauaacuaccuggaauuccugacucuggauguaccuucuaccuccuuuggacugccuaaucucuuuuuuccuauugauauucuugcaacccucuuucuaugaccguggagguuagauguuggacuguuugugcaaccuuuagcucuaguuugugcagcccaguguucuccuaagaggaucuuagcccuccuacaugcaaaaacaguaaaucauccuaccaccugguugaggcagagaaaaggaggccuuagagucaccauguagcuaaacuuuggauuuuugaacaucacauaccucugcuuccacccccaaaugcuaauaucaaagauuugauuugauuauauuuuuagcuuuguugaaugaauauccucuuuuuuucuauuuucuuucuuucuuccucccucccucccucccucccuccguuuguuuguuuguuuguuuguuuguuuguuuguuuuuugagacagaguuucucuguauagccuggcaguccuagaaccugccaugaagaccaggcuagcggugagaucuaccugugucugcuucccuagugcugagauuaaaggcaugcacuaccaccucccaacuuagauaucuacuuccaaguuucuuguuuuuuguuuguuugaaacaagguuucacuauguagcucaggcuugcugugaagucac

SEQ ID NO: 13 - RNA, 24264 nt, Mus musculus
gugacuucacagcaagccugagcuacauagugaaaccuuguuucaaacaaacaaaaaacaagaaacuuggaaguagauaucuaaguugggaggugguagugcaugccuuuaaucucagcacuagggaagcagacacagguagaucucaccgcuagccuggucuucauggcagguucuaggacugccaggcuauacagagaaacucugucucaaaaaacaaacaaacaaacaaacaaacaaacaaacaaacggagggagggagggagggagggaggaagaaagaaagaaaauagaaaaaaagaggauauucauucaacaaagcuaaaaauauaaucaaaucaaaucuuugauauuagcauuuggggguggaagcagagguaugugauguucaaaaauccaaaguuuagcuacauggugacucuaaggccuccuuuucucugccucaaccaggugguaggaugauuuacuguuuuugcauguaggagggcuaagauccucuuaggagaacacugggcugcacaaacuagagcuaaagguugcacaaacaguccaacaucuaaccuccacggucauagaaagaggguugcaagaauaucaauaggaaaaaagagauuaggcaguccaaaggagguagaagguacauccagagucaggaauuccagguaguuauucauaggccuagugagagguagcugggagacugucugcauccuucauaccaguccucaaaggccagcagaucuggcaguggcaaugcuaccauggcacugcccaaacccaccaguaaauggugagguuggagugccgcuauggaaggugagccgauucaagucaaugaaaggcaaauauauaaacaccgaggaccaccugcaagaguuuaacagagcugcuucucaaggccacugugaaaauagacaugaauacaugcaaagccucuuuggggaaaagcccuugaaaucugucgagucuucagaaguccugccagacgcuccuuauaacccugggagcagagaugaaggucuccuacaguagacaaaaauacagaacauuuucccuaaacagguauguggugcaaggugggagaucaaugucccacagaucacaaggaaucgaaccgugugugacagggcuagaaagauggcucagcagugaagagcacuuccugcucuugcugacaacucgaguuugcuucccagggccacacuguggcucacaacccugcacaacuccaguuccagaagguaugacuucugcagggaccaggcacacacauggugcacauacauacaugcacacacaccccucacacauugcaaaauagaauaaacaaaucuuuaagacaaaguuuuaagagugauacaggaucaguacccauagccccgaucauucugacuucuuugagcgguguucucccaagaaugaguuacuucuccggcaucccuucagcgacuacuuaggagcauagagucugcugcuucugcuucuuguuuuuccauuucucuucuagucuuguucauuguucuuauaaacuggggaguuuuguaggcgauuuuaaucgcuagguacuuccacccuaacccauauggcaacaguaugaauaauuaacaggucucuuuaaaauauuucgcuguaacaaaguuacucucugauucacuuacuuuucucaguaagaauaggaaaaugucccaggggguggaggagucacucagcaguucagaacacauacuguucuuuuaggggaucugaauggcauucccagaacugcaucgggagcuuauuaccacuuaaguuacuggauauauucacugaugcccucuucuggccucugaggcugcgugcacgcgagcaaauucacacagagguguacauauauacacgcaucaauuuucuaaaaaacugaaagucccaccaggcagugauggcacacaucuuuaaucccagcacauggaaggcagaggcaggcagaucucaggguuugaggucagccugguguacaauguaaauuuuaugauagucagggcuaccuagagaaacucuugucuugaaaaacaaaacaaacucaaaguccccuucucucuucggauuuaccaugcagguuaagaaacugccaucuggcucagugacucauaaaaugauacagagaaaagagugucugaaauuuuaaauggcaaguaugggggggggguggcauuaaaucacacuccaaagcacugagacuccaauaaugaagaaacaaauuagggaguuauagggaaaauggauaacucguaauauauccuguucuuacaagugcgagcacagcuuuucuuggccaaauauguuaguuaacuauuugauuuguucaucuacauaugccuucaaauuuucccauaagauuuaguguguugucuacaucuauucuguugcuaucugaaacccagcaguuucauaaagaucugcauaguuguggcuccaagauuucuuaaaacuuguaaaaaaaaaauucagucaucuuuaaaucucacuuugaacuaguagugauguguacaacauaguaaguuucauacuugaaaauuuacaacagcaacuaaguguuccucacuuuucuugguaguugaugaaaaugcacacaucaaagaggguggagcuuccuaaugcacaagccagugggguacaugcaaaccuuaagaaucagcauguauugauaaauugacaugagugaauauauuuacaaauauuugcuuauaagcaucaccaaaugcuuguagcacccgugcucuucugauacauagcauguuaacaauuauuaaagauuuaauguugaaaaaguagauuuuaaucaacugcucccugugacuagaugaucauuccucucugcccagccuccaagcaagcauacuaucauuacacaaaauuacaugauauuugcacaugaucuaucugcggucuuucuaaauuccucagacugacuaacacaaugcaaaugcuacacccauagaauaaugacagggaaaugaaagucuaccaucuucuucaugcauaguuucucuucagaaauagauucaauagaagguugguuggaugcaaggauguagaaucugccgcuagaguugacucgcuaagucaaggguuauugagaagauuccagaaccuaggaaacacguguuuucuguucacggcuuucagagaggcuccacggccccgucagcugcaccgcacucauggaagcuauugacuuuucuuuucugcugucuucauuuucuucugcaagaacagagaaacgugaguccaggugggcacugugccuucccuugauuaugcugugcgacucagcaggaggaccucuuaucucaggcugggguugccuguuuaagauucuuuucuuuauaaaagguauaaggcaauaaacacagcuguagaaaagguuuuguguuuucuuuuuguuuguuuuagucuauuaaaaugauauaauuagggcagagugcaaugaaguuucauaaaauuauaucauccgcuguugggaauugguucuuaugcuuugucuuaauuuggcuccccaaagccucgcuuccagaccugagggucccugcgcccaucuggcuucaauugguaauaaagacugccauagagccaauggcuggguagggagacaaagauaggacuuagauugcgcagacaagagaccaagggaaagaaggaaagggaauaaccaggacucagagacagagggaucagaaucaagagcugcaggggagaaaccauccagcaauguagguggaaaggaauacagcccuauggcuccccagaagguaacggguagcagagaugaaauauagauuuuaaaagauguuaacucaggaauaccggaggggugugugcuagccguggggagguuuagaaaugcccagucauugagcuagucaaggcauauccaaauuagcugguguauguauauggcuuucauucacaaauccagagcuccuggacaggugcagcaugccaucaacaugccgggagcugcuaccauccaccuucaugcccucucuugcucugcaaacuuuacccggcucacuguguuugagaacucugaauagauuugacuuuagaaaugguuuucuacaucuuugcacaguguugcuauaucauaagauacagaggccucaagucagugagugugugugugugugugugugugugugugugugugugugugugguguauuaugauguacauguguaugcgggcauguguguguauguguuaugauguauauauguuuaugcacaugugugagugugcauguguguuaugauguauaugcgugugugcgcgcacacaugugagcguguguagcuguguggaggccagggguuaaugaugacuaucugcuucacucaucucuuugccuuuguuuuguuuuaugcagauuaucuaauuugaaccuagaacuugcuugccguuugacuagguuggcagacaggcucuccgugucugccccucugccucaccagcgcuggggucuuaggcuuguguuaguauucuuagccuuuaacugacugcucaggaucuggaucccaguucucauucaugcacgguagcacuuuaccaagccauuuacccagccucagaaguuuaaagucuaacguaagccugcagucaguaugccacugucgaugacuuaaacucgcccagguuacugaauccccaccugacaguuccguucuccauaacugcaccaggggcauuuguaacuggaauauucauauacacuuaagaaucaauguuauauaaauaguaucacagccaaacuuuccuuucacagagaucaucuucugagcuuacgaugaaaaacgugccacgauuuugguuugcaaagacauguaauaauggaaacccauuuacuuccugcuuagauaaacuugaagugcuuucagcugugcugugccaaauucaucucauauagaauagauuugagaggauacuugaugucuuuuccuaaauaguuauguuuaagcuaaaugaauaaacacaguuucaugucuuaauuauaaaaaacaaaauauguacagcucuaugauacgcuaucauucgaaauaaacugaacaucuuauuagguuaaaauuaaguggaaaaugguuuugucucuggagauuuuuaauuuauucagaauauuuauauaauuaucuaaucgugagcccuucgaaguuauuuuguugaagacaaucucuaacuccagacauauauauuuuaaagcaaagguaaggggguauuguaauuaguuuucaaacaggaagaauuuuuccuuuuguuucuucuacugcucuuuugggcuccuuuuuucccccucucccucccaagguggcuuaauugucaguuccuaugggcuucugaacguguugacuuggccuaggccucauaaacauaaaacaaaaacuuugaucguagaugggggacuaaaugguuuugcuaacucauaaccaccucagagagucaguuuuugaccagaguggguagcacaggccacucacuugcaucgccaacaucagugaucagcaguuuguuccuuaguuuucccagucacuacucucaucuaaucauaucgauccauagaacugcagucacauggccaucauacagaacaguguagagcuauuccuuuaauaacuuacuaaguuauuaugcaaucauagugcucuaucucaaagauagcuaugguguuauugaaauaaagugguuacucagaucugccuucacagaacgcaugacccaaucagucuuguuuuugagaucugugaaauaaauaaauaaauaaauaaauaaauaaauaaauacacaauccaugcccacacaccuuugaucccaggaugugggaggcagaaguaggcagaucucugagacugaggccagccugaucuacagaguaaguuucagaacagccagagcuacacagaaaaacccugucucaaacaaaaacaaacaaacaaacaaacacgcccuccaugaaucaugaucaauaaaaacacaacagagaccuucccugcuagcaguucuccguggcaaauaaagaaaaagacaaagcacaagacuuuaauaaaaaaaagcagaugugacccugauacacacauacacacacacacacacacacacacacacacacacauauauauacauauguguguguguguguauauauauauguauguauauauauauauauauauauauauauauauauauccaagacagccuugcuuacaucaagugugcauguguaacaccagcauauauuaugcaauccuguaucugaaugcuguguaaaauguaauauaaaguucccaucuuuaaaaacaaaaccuuagauuuuuuuugugcauugaagugagucucacacucaaaguuaagggaugcucuauucccacuuaaagagauuuucagauggagcagaaaagggaaaagacuuaauauugccauuaauuuaucugaccuacuggggaagggguagcucagcugacagaugaggcaagcacaaacccugaguuagauggccagcaccacaccauccuuuuuuacacagaaaguucguggccagccugggauacaugagguucugcaucuaaauaagugaauauauaaaauauauaaaauggcauacccguacaaacucgccuuccgugggguuuacgcuguugacucagaguggcaccacucuccagcagaagccugacuggcccucauuugcauggaaaggggagugcugccucagauugucuagaaagaggaugacucucaacguccuccaaucgccucacaacuauguaagagagaaaggaaaaagcgugguauggagaaaaggguuuauuggaaguugagacaaaacaugaccgccuuucaagaccagccugagugauucugagcuggggacauuugcugaauccacacuguuccuggcggacacuggguggcgcucgugguaaaggcuugcgcuucuuuagggucuuuucccccccaucgccacaagcccuuugcaaacuucagcuacccaaagaaauuacaggcucccuacaugucucagcagggagcuuugcuggaggaauuugugauacuaugggauccuuucuccgccgaugcgucaguugggauuugagaagcacuaguguacuaucccuagccauggcgucagauccaccuccucagaacugacaaaauuaacaucccuggccagaaaaaaacccaaaguguggcuccaaaagugcugaccagacuuguagcucggccugcagcacacagaacacagggaguguccuugugaaaggaaacaggacuacauauugugagcagacucgaggcugucuauaguggcccuuacuugacuguauuuaaggaaaggauggaaagugacaaaacucaacucagaaaagccauaaagaaaguugagauuggugaauuucaaagaggcuccaaguuggugauuucacccugaacuggacuuacuacaacagguuuacaucugcauaaaggccagucuuucagcacuucagguuauauguagagauggcgcauucuuuucuccuuacccauccuuuuucauuauucauauauguauauauauauuucauuguucauaaauacauuuuuguguguaauauaucuuuacaugcguauauguguauauauguguaauauauacagacaugugcaauaauguauguguguacauccauauguguaaaugcauaucuccacugagaaaaggaagcagcgaguaaaugcuagcaagauguagaauuaucuuaccaauauaacaugaaguauaucugcaguuuccaguaucagggucaugggaagcugccuucucaccaagguuuaagagaacuauuagacuccuucuggcgauaaugaccaugcugaccuuuuuccuccugguuauuacauuuaaauuuauaguaaauaaaauuggggccugugaugggaucacccaucucucugcacuuuuuuuuuuuauaaccucugaacacuuugaccagcucaaggcauugauuuguaaggccccauggauuaggugagcaucuuuagagcagaccgcaaucauaauccaguaaggucagcaguacguuugccuccuugaagacacucagugcaaaucuagagccuggacagccacaugaaaaucaaaggcaagggaucagugucaaggaacagcaaacauuuguuaaacccacacaucugugucagaagggaaaucuagagacaccaaggcugcaaguagggacuccagaugaagaaagggguggcccugcugcaugcuagcucccucucguuguugacaaaagcugaaguuguacagccaaggaaaagcaacaguagccuggguuuauggggcccaugugcaccugaggcacguguugcugcuuccaguugcagcuccagauuccagagagggacugaccuccugcuuccagcucucugacagaggcuuggaguccuugguugccaaaacaagaacaaaguaaccucagacaaaacucaggcagauuuucacuucuuccccuggcaaaaggggaaccagaagaggaaccagaagauuccacccugaacauucaaugacacucccagguuccuggccaaaaggaggcccaaaauaggauacaacucauuuuugaggggaguagacacagcauugagugaggaucagaacacauuccuaaggccucacucaaucauaacuagaggaaaagcccauguugacaaaauaaacuucuucugguggucuguggccaguguaugagucuugaacccugcucccuuuguacauaaacgaagaugcucaguaggcaggaaauaaugggggaugcuacagaacccaaacucaagaauugagagggggauuggaguggauguagguaauggaaccaggagagggucguccaugaucgaaaccccaucucccaagcggacuugguuccuugccuacuuuucggucuucauacuccauuuggucuggaggcacacuauaggucacacacccaaaucaauucacguuugcaggaaucuggcuccugaacugagacaagagccauucuagaagcuuccaaguagucgaggauauugagcaaaaaaccaaaaggcugcucagcucucugggaaagccaacuaagagaguucaggcaguggcaagguauucaggaaugaaagacauugauuuucagcagucccuguaaagacuucaguugccacuggggacgucuagauucuuggacaucucuguggaguccugagaaacaggggcuucugcaaaagcgcuugcugcguguccaacuguuuuccaguuuacaaauuuucaacauaaauuaguugcaacuugcuucccaucaucccacuaagacaaugcuguucuccauuuguucucacugccaucuaacacugcuccuccucugcacacagucccacagcggugcucucuccuacagucuccgucggaggaggggggagaggacugguagguguggagcaagaaaagagcaucaagaaccgcauccucuaaacuguacuuuugagauugcugauuggaacacguugucuucaaacagcacggagcuaggcccugggacugcuugguuugucgaagcuauucacuaaaaagagaucgacugagacccucccucccccaacagggaacaacucauauucucucucucucucucucucucucucucucucucucucucucucucucucucucacacacacacacacacacacacacacacacacacucucucucuccuuguacgccucucucucucucucucucucucucucucucucucucucucucucucucucucucucucucucuuuaagcaaugcuuuguugugcuaaaacuaguuggacgaguuaggguguugcucugcucccgaagcccuggccaauggaacccgauccaccccgcugugcguaagcgcgcaauuaaggauuuaaccaaggcugugcugcgccucagccagcagucagccugcgggagacagagccuccacgacucccagccuccuccuccuccuccuccccgccgccgccgccgccuccuccucuuccuccuccucccucgcucccacagccaugucugcuuagaccagagcagcuccacagccaauucaggcagcagcggccgccgcaguagaagaacagccaccgcccgggagcuaugacaggaguguuugacagaagagucccaagcauccgauccggcgacuuccaagcuccguucccgacguccgccgccaugcaccacccgucucaggaaucgccaacuuugcccgaguccucggccaccgauucugacuacuacagucccgcgggggccgccccgcacggcuacugcucuccuaccucugcuucuuauggcaaagcgcucaaccccuaccaguaccaguaccacggcgugaacggcuccgcagccggcuacccggccaaggcuuaugccgacuacggcuacgccagccccuaccaccaguacggcggcgccuacaaccgcgucccgagugccaccagccagccagguaggcgcgcgggggcgggaggcagguacccagggcauccguaaccccgcgggcgccaaguugggugguagaugagggccacgcuguccgcacccauagaagggugcuucgcagaagcgagugggggccugggacugcaaacaggacagcaccucacaccggcaugggggggggggcaguggaggacuuuugaagagguuuaaucggguguuuugccucuggcgcugcucgaggaucccuccuuagcuggauuccuagcuggccuagccagaaagccagcuuggcugcaaagaggcuaagggauuuggggggcggggggugggugaaaucaagcagcccuagugguguuugcguaauaaaaggaaaguuaguuggaauucugggugagcgugcugaguuggugagaucuagucuggauuagccagcgaagcgccccgaggccucucauggagggugcgggcagcacaccgggugaccugggggccggagggcugcagccugacagaaaagcgaacagggaacuuugcgguuuauccaagguauuuccaaauacaaaaagucauuuaaaauagcggaggauugccgagaguucacucuguuagagggacccccccccacacacacacacacacuccaucgagugcucucuccguaagugccuagaauuugucugccuuccuucuuccccacagacuccccuuuccguccacugugaaacuuccuuagagcguuacagugggguagagagcuugggcgguaaaugagaggcgugaagucucaguggagaaauuuuacuagucgauuuugaucuccccucaccgacacauuaauaaggcugcuaauauuagcauccccuacuccaguagagcggagaccgcagcccucccuccuucuccacccuuccucuggcagcagcuucauacaccgacucuuccacuccuuucaggacugaagggggaaaaggggccauguggccuaggggcacauuagcaaaacacggauucacaggaccccagcgggguacauuuaugacagugagaauucuuccuugguuccuccccuuuacuacgaaaauauccuuacuacagauuccuuugcaauacauuguugauggaaguuugagucugcuccucuugcugucucuguauccuugcauagggagaggauuuuuuuuuuuuuuuuuuuuggucaagaacauauuaagucuauuugugaaagaaaccagacacaucugugcccucucagaucugcagugagauuauggggacuacauaaucggcucucugucugccgcagccccgaccgaccgcuugccgcuguagugaaggaacauaguuugcuugucggucuuugaacuuuggagcccuuggcuagcgucuucccugcccaagcgucuagccucugcgggcgcccgaacagacgccgacagagggucauggcccaggggccuccucgcgugacgcccagggauuggaguggcuauucgcgucccagaaacacacaaggugaauacagggagggaaaaaauaaugagaaaaauaagcaucuccaaaggguuccaucccuaaagcgaagaacuugauguguacaaagugccccacgcacacaguggcuaguagucagagacucgccagcucuuccauguaugaucugaggaugggacagauuucucugggguuugaaaagccaagauugugauauugggaaagagaaagaugacuacauauuucaaaacaaacaaaaucucgcugauuugagggccugugcaaacgagccauugucugccaggaagcucuaaccuagucuguuuugguuauuuagagaaagaaguggcggagccagaggugaggauggugaaugguaaaccaaagaaaguucguaaacccaggacuauuuauuccagcuuucagcuggccgcuuuacagagaagguuucagaagacucaguaccucgcccugccagaacgcgcggaguuggccgccucucuaggacugacgcaaacacagguaaauccggccgccgccaaguaccggccccgccucgccugcaagcccagcucggcugcaagguucggucccgacuggcuggagccgauucucuagcacuuugcagaaauucacagauagaaagacaccaaccgaugcaucuuucccuccaugagccaggcccacguggcggugggcgcgggauucgucguuugucccgaguugccgccauccccucccacccaaacccaccccugcuuuaaccaccaaaggcuggggaccaagguuccauagugaaaacaagagaagggguauuucugggaggagggggaaucugccucgcgcucuugaaaaaggucugggucccuucacagugagaagcuugccuuacuauuggccugaugaugagucuccagccaugcaaaggccuggaucguccugucccggucgacccuaucccugaggcagaucaagccucagcagccugaaggucgcgagguggggggcgcuguuguacggggaaacccuccgggauuguccccuucuuuucccucccaaccccgcccgcuggggccuagaauaaggaauguucaagucgcagcccagagcuucaggcagagucuggccucccagugccgaggggacugaagggaguuggacaggagauuggacaaucucuccuuucccuuggcacagugcaccuacaguuuggcccaagccccuccccaucggggacucuggccuucgagcaggagagguauccuccccagugaccuggugcacaggcccacacgugcgaccaggucuagagugaauaaaagacaaagccuugggguagcagaagcugguucccgcugagcuggacagagcucccucugugcgucccucccauugccuaggcugaaacugcaaccuccuggcgaugggcggcuugcugcugguaguuaguuaucagggcaggauagucuagggccaggagagccuucauucgucgcucagggaaaggcgcgugcaaccucugagugucccgguaacgugugccuuuguuccccacccaggugaaaaucugguuucagaacaaaagauccaagaucaagaagaucaugaaaaacggggagaugcccccggagcacagucccagcuccagcgacccuauggcguguaacucgccacagucaccagcggugugggagccccagggcucaucccgcucucucagccaccacccucaugcccacccuccgaccuccaaccagucccccgcguccagcuaccuggagaacucggcuuccugguacccaagcgcagccagcucaaucaauucccaccugccaccgccgggcuccuugcagcacccgcuggcacuggccuccgggacgcuuuauuagaugggcuacuuucucuugcucaguuuugggacuacaguguugugcugguuuagaaaucagaaagaaaggaauucauacggggauguuugaacaauggaaacaaaaaagauucauguguaaacuuuuuuuuugcauguaaguuauugcauuucagagagccccgcccccuuuuuuacgaaaagaacccuuuuuuuuuuuuuuuuugcgcaacuguggacacuaucaauggugccuugaaaucuaugaccucaacuuuucaaaagacuuuuuucaauguuauuuuaaccguguaaauaaguguagauagaggaauuaaacuguauauucuggauaaauaaaauuauuucgaccauggaaacugcuccuuuuuggcccccugauaacuggcuagugagguuauaugcagacgguuaagaacagaugaauucuccagaaauccaacaaugcaaaacagaagucaggagcugucugguugcagaaauguguuuguguuggaugcucuauuucauguaucugucugcacauauggccuguuuauaguacugucguguuuaggaugguuuuuucccucuaaccacaaaaccauuuaaaugauauuaaauauagcuccaaauguuuuggguaggaaggaauauugaaauuaacuacauuucuccuaccgugugugagggaaaaagccaacagaaaucccuugauaaccugguauucuaagcacagagugauucugguggggacccccucccccaucugcauguguauugcaauuaugagacaggggaagaaaaggaaauuuguuaucauuccucauauauauauaguuuuuuuuucucaaaaauaugaaauguuuggggcauagcaagcaguaguuuaagccuuggaguccuaauguggaugacuacaaaucuggccagguucuuucugccaagaaaauaccauagggauucagaacaauagugaaccugaaguacugggccaaacaagaaauauggggguggggagaauuacuuuucaaaaagguggggggggggcuauauugguuucauuucuugugauaagguucuucauauaauugucuuucaccggcauccguacuucaugccucuuucaggaucuccugugcugcuuuuacauaaaacaggggccaggcaaguuccaagucaucggaaaugcgauguuugcuagaauuccuuugugaagccaucuuuaaggaaggaggaugggaguugcagcaaccuggccucugauuugugcgucccuuacacuucugcauguagauaucuagccuaugcccagagcuacagcguggcuccacggcugugccccaaggccugaauuauaggcaucuuuguggcuggcuguccuuugguccaucuaagucuauuuccaaagaauauguaauguuagaaauuacuagauuuaugggaaauauuccagagcuaagaagucggcagcaauaaaugugacaaaagcgcccucuugggaagggggauuagagcaugaaaaacugcaucuucucaucucagaauuucagagagaaccagcagugagaacggaaagggcaagcugugugcccuugggccauuuacagagucaguuucugccucuccagucucuucccauuccuccguucccaucagccuucuaucuccauuuguucuccuuucucuuuucuuguucuuucuuugcacaggugauaccaaucccaccaguuugaaacucaguggacuuggggauggccaacauauauuuccaggcagccugggcagccuggaaacagccugccuaaacagaaauuuauccccuguccucacuccacucuaucuguggggggcagugguguuaggggagguccuggccccauuuuguuuucuguaguguacagggaguagaauggaggagaugaggguaucuauuuucugcucuuucuuugcuugcaagauuucagcaguuuccauuaaccaaaugcccacagcuuucugaaggcuuggucuugauuuccaggaccuggcuuucugguggucacaggccuguccccacccaggaguguauauuugggaagguuggcaagggcggaggacauccaucgcacccccccccccaauauuucucgcccacugguuucccaagagugucaaaacugugcugggaacaagcucuuuccgucuuggcauucggagaggguggaugucaucucccugcugcugcgcugguaggaagggguguguguaguuuucuacacuaccuccgacccucagauucagccaagcaaaggcaagggcggguccggacuuuucucaggaaaaaagagggaugcucuuuaaucaccauccuucaccccaaacugggacauugcugguuguuaaggacaccaaaguugguuuguugcuacgccaaaagccuggagcagcaauggcagggguugggaccugguuuuaggauugcauccccugugugagccucacuaguagaggucucuugaauugggaggguuuuuuuuuuuuuuuucaacuuggauggggagcggugaacaaaaaauauucuggcaagugagccgcaacgggcuuuccuggcacugcggggauucucccuggggaauuuaacucccugcaguccugcgcccaaggauguaaaaauaacagauccucagcaaagucuaaaaauaucuguuucucuugcccucccucucaccucuccauuguuucuuccuguguguaccaagcgcauguccuuccauuuuggcacugacagaccccgcuagcccuggacuucaaguagaagucucuugcgccugccccuucuguuccucacuugccuaguccucugucuaaugccccgaagaugaauuaagccgacuucagaacuaauuuucuucaccguagaccuccccccauccacgcaauacuuucgaccuccaucuugagaccucccugcaaagacucagaggcccaaggcauguuggcagggcuugagugauuuccucggugcccugcccgacuccggagcccuccuguugaagaucagauaaauuggccuuuguuugagacuuggguugggcuaggcggguuucuacccucauucuccccccuuuuuuuuccuggcggccaccuccuugugggacaagaggcggccuggggauccgagggaagcugcauuccugugggugccaggcggcuccagugcugagccacagagccucacacacacacacacacacacacacacacacacacacacacacacacacacugaagaacccgcagaccucgcugcccuugaucuaucucuaucucucucucucucucucucucucucucucucucucucucucucucucucgccccgcaccuacccgggagucaguccacucccccucggauccacccuagggcucugccuugcauagaaaagcuuugacccacacaaagguguacacgcauccccucccagugacacgggccagaucaguaucuccccgccuaaggacaacccuuucucccccgccccuuaucccacgacccaaggcgugccggcuggccuccgauggcuccuuugaucgcacgggacgcccaguggcucgcgggcuccugacugacccacagcaagccugaguugggcguuacagcacacagccaccuccacaauucaguaccgagcacucucuagcuugaauugcccuggaugccugcuggaaacugcucugcacucacccucugcuucuugcuuccuauuguucccaaagagagaccuuuaggacuacucagucaccccaucccagccccuucuccgccaccucuuggauccagugccucccacuggcugcugggaucuggccaacuuagagcucuccagcucuuggagaaggcacgcccugagggcaguagcucagagaggugguugggaagugcggcacccgcgaggaucagccugcaguccccaccuccuccacucucaagcaccuuccucccucccccucccccccgcacccccgucugcugggugcggguuuacacugcccagcgcuuggggagggggcuccuugacuuacucuggucuccgacuccuggcucccaccacccucuuguuuccagguugcccacagaccuugcacauuuuugacccaaucccaggccgagagaaaacagcccaaaucuugguggugcgcaugguauuaguuaaaccuuuccacgcagccuguaccggagacucgcaucccuggcguuuucuuuugcuucugacaggcuuuagauuuuuaaguggugcaaggcagaaaggguacaaggugucuacugccagagguaugaaugacugagggauggaggagccuuuccuucgcggucagcuagggcugccuacuguaauguaacaaccuguuuuauacuuuugaguucuaacuuugaagauacaaaccgaauuuaagcgagucucucuuuaaaggaaaggcgaguccuguucuuaacagcaaugagauguuucugcgcguuguucgcucgcucggacuucugauuuaagugguucugaauucauuucuuugccaaaagcacacguauuauugagucuguuccgcauccuaaaccaagguuuauaugaaaccgugaaauaccacacauuaugaccuuucaccacaggaagggaaaauggcuucaugaccugauccccccacccuucucuccucccucccaguuucaauaacaauucucuguggaauccaccauacacagucuauugcuuuuauuuuguuuuguuuugguuuuuuguuguuuuuguuguuguuguuguuguuguuguuguuuugguggggugggugugaaggaugguaaacgguucaaagcuaugauuuaucuuaaagcauuucuuuuccuugaaaggcgugaaaacagaaaccgccagcggacgcuuauucucaccuagaacuauuucagccacuugccauuugcaagagggggggaaggguggguggaagggggugcgggauauggacucaacuuucaucuauaaacaggggucacuaaacaggggacauuucauuauugcccuuaaauucacaggagcuagggagccugcuugccacccugcaggguggccuugguugggcagcuugugugggucgguaagauguccuugggaggaggggaaaucaacacaauuggcuuugaaacuggaaaagaggcugaagaaauucucugugcucaacagggaaacugaaguccugggauacaagguuuagguaucucugacugggauguacucuaacugggaugucgcuaccagaacuaauccagaggcuaggcuaacuaauccagacucugcuagggcaugacuuauauuucugcaaguaauagaauccucagagaguuugacuccaggaccagaaagagucuccccaucucucuugagcucucuuucccuuuuccauucuguccuuuccuguuugaacaugaucaggaaccuugcccuguuaggcgaauugugacauagaagcaaccagaaugguuuauuggggggggggucacuaauaaaguuaaugaugaaauuuaaaauauuaaccaaaccaacagcuucccagauggcuauauuuaauuaacauuaauuaauacguguucagcuaauauccucuaggacgcaguagagcuucuuuauuguaaaagagaagagggauagagggaagacacacuuuacagcacccagggcaguuggcucugaugacaagagcaauuguagauucauauaagaauauguuuauaaacaagugacaggcacauucugagguggcuuugguggagagaguggagggacugacaaauauccuuugcugugggggaggggcugugggggaagggcaccuuuaagaguaggaaaaugcuaugguagagggaagaaagacgggaguaguuuuuaaaagaaaaaaaaaagaaaaaaaaaaacuauuugagccugcaggcagcagcagcagcagaggcagcagcagcagcagaggcagcagcagcagcaggggcccugugaaugcaccagcucugcacgguggaagacuuggacacauaauacuucagacugcugauuugcuauuuucuuaauucuggcucuucuuuuuccauaugaaucaaacagucuuuuguccuucaggguuugauuugaucgcuacuguucacauuucacuuuuguacuuucccucuuccuauaccauuacucauugagugcccugugaaauuacaaucguacauuuucaacucagcaacccauuugcaguacaaaaaauagggucuaaauaauggcugaauuagcccuacuggacaguuucagauguaacacucuguaauaauuauauugcaggcuggauuaggaugcuauuaucauaaucuggacguuuacaauuaucuguaauuugcaaagaugcgccaggucuugauuacagcagcuuuuuuuuuuuuuuuuuuuuuuuuuuuuuguaucacgcuaaccaucacuaaacagugacaguaauaacagcuaauuuugcuggcaauauaagaggugcuggggugugcaaacaauuucacaccuggaugugcucacucaaccaagaauauagagacagagccucugcccugagacucagagaaacgcucuccugugccucccuccgcucaguauagauuucuagacccugaucauugcuuaagagauauucaccgggguaaguuuuuauuuuuggcauacuucuaacuucuaaguacuguuuuuauuucuccucucagacucuccaagcuauauacaauauguuguugugauuuacuugaauugcaacuuugguuucaagguuugggcucugaccuuuuauuuuccuuuaacaguaagaguugaucuggugagaaugggaucccuaagaaccugacuugccugucuugcuuccgugcgacugauguguuugguguagucugugacuugagacgaagaaaggaccagguuucugcgaguuguagaaggagcccgagaguccaagcuaaaaaucuaucugaaaauuguuacuuacaauugaucuuaaguaaauacauugagguuuuuauaugcggccaugauuuuagguuuugaggcaucagagaucaaacagagcuggcuguguggcuugcuucuuugcagucagcuauggggauggauguuagcaaaagcaggugugccugaaucucugggcuuugcagcccuuugggcaucuucucuccagcugggggaaaguuuguagaauaaauggcaucugaaacccuucaaggcuguuccguagggccuugcauagagcuguagucucugucucucuguaucucccuguccgugugugugugugugugugugugugugugugugugugugugagagagagagagagagagagagagagagagagagagagagagagagcgagagcgcagaggggaguggggagugggggaggggaagguauccagaccguggagcuuauugccugcugagcccaaauucugugauccugggcuuagagggggaugauugguugggacacagaaucgacaacuuaugaagccaaggaaccaguguagucuauguaccgaggaagauauuggcaacaagcugugcuguuccgucucuagaugacgcuguucccugacccuguaaauguuauaaguagcuagagugcuuaguauaggaucccacaaugucuuugacugcccacccugccgagagaagcuuuucuaccauggcaagaaccuuugcacuaaauuguguccaaagauaaugugguguuuauuuguuagagaggaggagaaguugucucucucuuauauuccuacccaauagcuaugcuccucaccccagcccuuuaguauagucagaacagggcuugggaacucaaacucuacagucuaguagggaguuugaacauggggaggcgcaauagacaccucaacuggcaacaccuuucacccaugcuccuccuaccaaucccucccucggggaacgaguuuccuugggggucaauacauuuuaaaggagaaaaaacuauuaacccuuggaguucagggaauccagugggagcccaguucuaagcagaguucuaggggacuaucugacagcaucucuguaacuaagcucauguucaauaggagauaaagauggaugcagaggcaucagccccaccuccaaccuaguaauaaacauuuucugguuucagaauucuauacacucacagugguuuggcauauauuuggugaaauuuuuuaaggaaaaauuaguguugguuucgauauaugguagcuuuuucucuaacauaauuugaauaauucagcaaagcccuacuaccagcuguacuucugcagccucuuccauucuuuccagcauuauaauuuugguuaauuuucaauuuuagguccuacgucucugcaauuuguguaugaauaacagaauaauuucccucuuuuguuucgccuuuccuguuccugaaucuaaauaaagauggcuuuuuaguauuaaaaguggaagaaaauuacagguaauuaucuuugacgguaaaaacgcuguaaucagcgggcuacaugaaaaauuacucuaauuauggcugcauuuaagagaauggaaaaaaaccuucuuguggauaaaaaccuuaaauuguccccaaugucugcuucaaauuggauggcacugcagcuggaggcuuuguucagaauugauccuggggagcuacgaacccaaaguuucacaguaggaagggggaaaaaagaaaagaaaacauuuuuccuaauguaacaaugcgaaugcuagaaaaugacaagacugaucgguuuuaaaccauucugaagacugacugagcguggaaguugcucaacaaaaaagggaacggggauauugguaaguagucuuugcuuugugucuaauuauagugacuguccuuuugcacgacuguaugucgcugucauuauauggagcacucugaguaucucuauugacuucugauaaauggcucagugguuucaagguucauaauuugaaggaugcccaggucuguagccauuaauucucacaguauggggcuuccugcuuguaugacgaaaggacuuuucauuuucauuauuucuuugcuuuccacgagaucggaaggauguguuucuugcaggauagaacauuuuccuaccuugcuagcuugcaacggguuuuuaacauuaaguggucaaaauugugcacuuugcuuucuggguuuguuauucuuuucucuuuuuacuuuuuuuuaaaaaaaugcuuccaaaggcaaauauagcuguacuauuuuaucuagggaaaggggaaggagaauauucagauacaguauggaauugucuggaugucuaaaaguuaagcugugucuagguuauucuaauguuuaaaaauacaaaagugugugugaaucacaacaaaauuaaaaugaaagccugagaacacccauggcucauguuaaaguaccugagacaaagacuugugguagaaacugacaucuuuucaggcacugaauacguauguauagagcacaccauauuaggaaacaaaaauuauuuuaagagagauagaaaauauaguggaaagggaggaaggauagacagacagagaccuggagcaguagaggacacucccaacauuuuguggcuuuuacuccauauaugaaagaagacaaaaacauacaaaguauauauacaacuaaaauucaacaauauauacagaaauguuccuugauauaaacgucccuauuagcuuagugaaugccacuauucaccuaagaaaggugucaaagcaauagaauggugauuuugguuguuuuccuuggucuuucuucuuuccaguucagaguuuggagguggguuaugcaaagagcaucuuucuuguugcuguuacuguuuguauuagcugaguugucauuccugaucauugcauuuugaaaagacaugcaguguuuccuuuguggcaauguucuacuuuuuacaaccaaauuuucuucuuucuugaagagauauugggggggggguucuuccauuucuuuucuucuucuucuucuucuucuucuucuucuucuucuucuucuucuucuucuucuucuucuucuccuccuccuccuccuccuccuccucuuccuccuccuccuccuccuccuccuccuccuccuccuccuccuccuccuccucucagucucagauugguaaauaaaaauccaggaguccaaaaucuuuguuuuuuaucauguaaugucuuaaacucauuaaacaaguaaaaaugcugccauguuugugcagauucuucugccgguggagaaugucuguaaaaaaaaaaaaaaaaaaagucauuuggauagagaguacuaaagaggaggcucggggccugaaucccag

SEQ ID NO: 14 - RNA, 190460 nt, Mus musculus
gcuuaagaagcaaucagaacacaaaucaugguguguugucacuuacaacacagggaagauaagacuacacaaugagaacuagaguaugcccaaggcagggggagaaaggcauggcauggacaguccagcuaauuugaauuagcaaggauucauuaggcaauuauuacauaucuuggaagaauuacccuauucugaagaauucaggcuuuacucugaaagagcuaauagugguuuaguucaagggacacagcucagcaggauagccagauuucagugcuaggcacgagagagaaacaggaccuuaagcagaggcagacaagagaauggaacugagauacuagcagucagggguggggguuugggggaccucagacaggugugaucugugaugauagagugcugcaggccuugaaaacagaguuagccacucuggggauuaaucacucaaguacuguuuguucucaaaaaucauaaagagaaggugaguuugcuuuuaaacauauauucaggauaucagggaccaauaucaauacaaaacuaaacugagagaucuuaaauacgauggacagauguggcacauuaagacuugauuuuagacuauguuucaaaaucuccaugccaugauccaggucagaaacuugugucuuccaaucucaagaucaggaucacacagaucccacggguuccucuccuauagugucaucccagcugacuuaagagcuuggaagaucacuauagcucugucaccuucaagguguccucagacagcagaaaaccuuaucuuguugaagagugcuacaauuuuuccagucaccucuuguaacugcgugccaaagaaggacuccaugaaagaugacagaagaagucauugucauagccaagugggacuacacugcccagcaggaccaggagcucgacaucaggaagaacgagcgguuguggcugcuagaugacuccaagacgugguggcgggugaggaaugcggccaacaggacaggcuaugugccuuccaacuauguggagcauaagaacagccugaagaagggcucccuggugaagaaccucaaggacacacuaggccucggaaagacgcgcaggaagccaagugcucgggaugcuuccccaacgccaagcacugaugcggaguacccagccaauggcaguggugcugaccgcaucuaugaccucaacaucccagccuuugucaaguuugccuacuuagcagaacgagaggaugagcugucccuggugaagggcucccgugucacaguuauggagaaaugcagugauggcuggugguguggcagcuucaacgggcagaucggcugguucccccuccaacuacauucuggaggaagcagaugcgaagcugcagcugaggcccccagcuuccugagccuacgucggggcacugcacugagcaaugggcagggugcacgggugcugcacguagugcagacacuguaucccuucagcuuggucacugaggaggagcuuaguuucgagaagggggagaccacggaggugacugagaagccggagaaugacccugaaugguggaaaugcaaaaaugcccgaggccaagugggccuggucccccaaaacuacgugguuguucucagugaugggccugcucuacaccccgcucacagcccccagaucagcuacaccgggccuucagccagugggcgcuuugcuggucgggagugguacuauggcaacgugacacggcaccaggccgagugugcgcucaaugagcggggcgucgagggcgacuuccucauuagggacagcgaguccucgcccagugacuucuccgugucucuuaaagcauccgggagaaacaagcacuucaaggugcagcugguggacagcgucuacugcauugggcagcagcgguuccacagcauggaccagcuuguggagcacuacaagaaggcccccauuuucaccagcgagcacggggagaagcucuacauugucugagcccuacagugaaagcagccauuggcucccucaugcccugcccacugugggccucgcugccaccucugccuccuagagcccagcacuucuggucaccuccacccauguggccuggaucaccucuguggcccagucuguccuucuuuucagcuuuguuggucaaccacggcuaccuaggcccucacaaccaugccccaggccaccaccuucuggugaugagggucagagggagcaaagcuacucacuucuuuccuuuccagccggaaacaaccuguuugaauccuuacacagacacauacacagagagggaaaggggggggggggggauggagagagagagacugacuaaaaggggggggggauggagagagagagagacugacuaaaagacuggagcugcuucagagggucgcgaggcuguauguagugaauaugugaccuuggcacacacuccgagagcuguguccauggguguuuggugccucuagucagcaugcugguccagaccggcagccuguguccugggccugcuuugcuuugcuuucuuuguuucuuucuuucuuucuuuuuuuuuuuuuuuucaauuuuacuuuuuaauuuuauuuuauuuuggcuccaggcacugcaggaguccaaaacuguguggauagcaauacuggaaacccuggggaaaugguggugagaaaacugcccagugccuuugaggcuguacuugcaauaaaagaggguuuugguuagaguuggucugcaaaagagggagguagcaacgcagaaagaaagguacucuggugaugucccccaggugugccauccacaucgugcuuuugcccaugggcuuguuugaauuucacaauuauguauuuaauucucaaaguaauauguaucuguagcugguuguugacacuaauaacaugauuaaggaaaacagcugaucucuugggaaggggagcuaccaauacuuuauacauacacuauauauauauauauauauauauauauauauauauauauauauauauauauguguguguguguguguguguguguguguguguguauaauauguguauauuauuugcuuuacagggaaaauuuucaggguuuacaaaagaauaugugauuaguaguaacaauguuuaugaaggaauugcauuuucauuuuucuuuacauuugaacuucuuuauaguuugacuauagagucuugagauggcacauuucuaaaauugaagaaggaaacuugcauacccgguuuuuugaauauuguaauaaaaaaaguauuaugacaaaaaaagacuugauuuuauuuuaaaugguuuggcauauuuugccuccauauaugcaugggcauuacuugcauguuugguacccauggaggucagaagagagcauuauauccccuggauauguguuacagacaguuguaagcuaucaugugggugcugggaauuaaacccggguccucugcaagagcagccagugcucuuaaccaucaagaaaucuuucuagcucuacaauaagauuuauauuacauuuucaaguauguguuuuuacuuuaauuccaucuagacuuaaaauugugguccuuccaccucagucugcuggguaccaagauuacagauguccaccauuacaccuggcuuaguuauauuucauauaaugauucauauauauauauauauauauauauauauauauauguauguauauauacacacacauauauaaaaugauuaauuauaaggagugauacccugccuuuuuccuggggaauuauuucuugauucaguacuaugcuagaucaagaacugcaggaaguuuauagaaacagguucaaguucaguagacuuacuuggaauagccuuggaacaacaugaagggacaugaaagcagcaggauuggguggagauagcuuauauuccuaccaggguuccuauuuccuauacuguucagaauggagacugagaguaagaccuugauauaccuauguggccccaaguaggguagaacugugcugagaaagcaaucugagcagacaggaagagcucuggguggcacauuauaucauauauagugaaagcucacauuuuauuuggaguuccaucccaguaaccucucuaugucguauugggauggaacccaggcucucaggaaugacaggaauaauccucuacuauuguacucuuuccacccagaccuucaacuuuucaccauuaucuaugucuauauaggauguucugugcuagaauaaugaaauaaaguacauuuuacauuuuugacaguacuuauuucaacuggaaacuauucaaaagaagaguugacaguuugugguuaccauuuuggaucgcugguugagaacagauucaguuuugugacacauuaugcuguuuaaacugaugaggcucuaaaacuugauguuuacagauaaacaaaccuuaaagauccaaugaauuugaugagcaggaccacaaauaugucaaauaaaguguauucuauucuugaguagucucauuuauuuccuuuaucccccccucccuuuuucccccuuuuucugagauggccuuaacugagaauccuccagucucaguguccuacauagcugggaccguagacauccacacuccauacugagauuuuuuaaaaauuaaauuuauugaauuuauuuuuugacagcaugacaccuguauuaaguauauucuaauucucauaagacaugcuaaguuucccuuuuaccccuagaacuccucucccguccugcuaguuccuuucccauauucaugucuuuuuuuguuuguuuguuuauccuacccaaucaguuucacuaggauccucuguguaacccuggguuugaaauaauacacacacccaagcuuuaauugucauaucucccagaucuaauguccuuaugucccagguuuuaagggccauauaccccauauacccguugccauacagucucacaccaagguuuuaagggucacgccccacccccaucagcaaggcuucaauguacugucauuugcuucuugcuauagaaaauauguuuugcauagcaagugccagcuuuguacugggcauuaauaaugcaguacuuggucucuaacaugcagaaagacuacucauggcacuucucucaacggauuucguguuuugaaucugugauaccucugguauuuccuuaaaugguuauuuucuuauuucacugacauuccaaaauguuucuaaauuuuuagcacucuuacuaggaauaucuuaaaugagcauaacuggauauuuucuucaaauuuagucccuaaaguuggguugggagauggcuccucagguaaugcacuuguggugcaagcacaaggaugagaguucagauucccagaucucacuuaaaagaugugugggaguaugggcccugacugggcacauaacauauagagacgggauugccagagcaagauggcuagcuagacuaccccagugcugcacuuaaaugugcaaugagagauucuaccucaauaccuaagguagagaauaauagacgauaauccacaucaacauugaaccuacacacacacuuucacaacuguuuugcacauguauauaugccauacaugugugaacauguaugcacacacaugcacaccacauacauaugaaaaaaauuaguccaucaaaguggguuuacugggucaaagaggagagggcuuaagcuucuuagaugguaggguguucuugcuaaauuauaugaguguucaauuaaucaacucuuuggaaaaauagugauuucauaguuguuauucaugguaaucauuuguguaauauaccuuuuuaaaccaugagauuagaccuuucaguuuuaacucuuaaugcacaaauacuaaacuguuuuuagugccaaugcuugccucuuuggagcguuuacuguuauuuuucaguuaauacccaucuuucuuguuagauuuacucagcaaauaagcugcccaguaauugauuuaugaugacauacauccuagaaccaggucagggaaguguccucguuacagugucucuugcuuucuagcucguuggagccacagguauacuagaggcuccuaauacuagaggcuucuaaaaguccuacauaguaggacugaacaggauugacugauccagaagaagcagacgaaccauugagguugagcaggugcagugaaaggcacagugcacagggccaagggaaggaauuuauguuuaggagccaccuaacccuaaagaugucaccuucggauuuucucuaccuauacuauggcuuucaauuaaaaaauuucaaguuuauuuuauuguauguauguauguauguauguauguauguauguauguauguauguguauauauauauacacacauauauaaugaauauuuucuauaucaccugauuauaugugauauauauauuacauuuauuauaaauaugaauuuauaaauagcuuucccuuaauccuuuuaaccauaaauucuuauuguaaaauggcauaucauguuucuucucuucauauaucuuucuugaacaaauuguacauuaagaaucugaaugccauaaagcauuccuaucugaacuguccauuaucccuuaacgaucguaguuagcuuuguguucaacucuaggauuaacuaauacuuuacugaauaaagcagacauuuucuguucaugauuuauugguggaacuuucuuugguauuuuuuuuuccauauauuguccuacauaaaaucuugaaccacuuuguuaauuucagaacuacccaaacaaagaaacugaaaauugagaauggcugacaggaaauauguauggaaugagacagcuucacauuuucuaauuuagagaugacgccuucuuuucugcucacagagauuguucuucaauauuuguuuuucuucauauuguggcaacugagaccucuucagccuucaucaguacaccugcaugauucccacuguucucuauacaaacuguggcuaguuuuucuuccagugaaaugauuuauuucuuccuuuucauuaauucuaagagccuuuuaaauuuauucauuugggauuuuccagguauuaaauuguaucauguaugaacaaugguuaucuuuacuuucugccauuuaggaauuaacuuuaagaaauucauaugcuaugguaucagcgagaaaaucuggaaacuauuaaacaaauaaugaguuauaacaaguaauuuuuaauaugauuuuaauaggaguaucuuuaauuuuuauuaauagguugauucuuuuacuuaccaauauuuguugaaugcaucuaagauauuagauucugugcaaugucagacaugcaaggcagaaugacacaaucccugcugccugagaaguugguuuugauuuugaggcaaguagccaugcugugcaauguuuauuaccucauucaguuacuuugaugcccaaagcuggaugagugcaaccauccaccagcauagagagcugauagaauuccuccuuagauuacugagagcuucuuauuuauucauuugaacuucuaggcauauuacccagucauguaguaauaauguugauuuuagucucuccccuuccacuaauugcucuuuuguaaauauucaaauuuucaaaccuuuuguuagguuuuggcaauguauuuuagguggaauguuucagaaggguucaugacuuucaccccauauuaugcuauguugagaugaacgugguuggcuggaauagacuacgguaaauugcauaaguauuucucacccuauaaauagccaacugccauaacuuuugaaauauuucucuaaccgggcuuugcuaugaaaguuucugaagcuaaugcccagauccuuugccaagaaacccuauccucagagggaauauuucuccugcaaagaagcaaggcugugagugcagggcaucuggacauugggucauuuuaaagucagacaugcacacauuuacgugugugugcaugugcaugcacacacacacacacacacacgcacacacacaugcacacacacacagguauaugcuuguuauuguggucuugugauaagaacacagcuucacacauaaaaacuuuucagauguguggcucccaagaacagaaaagguggcacuaggcauggcagggagugacacaacagggacccaguuaggagagcuguugccuuugauccugcaaugccagugcaaaaauugccucccacuaacuucugccacccccaucucaaagcacccaggugucucugccagcucuaucaagaaguguaguguggggagcagagaaagcccccaguggaugaaguccugagugggcaugcacuguugacaucggcacagacaugucaaggaccaugguuucagaccuaaagggcgacagcaaagcuuucccuucuguuccaucuauggauguuggcacuguuuaucaaaaaugucuaccacagcuuccugcuugcuggauguucauaggcugcagaccacuccccuacagcgacuuccuccuaauuuaccuaaaccugucuccucgauccaacuguacuccauaaacccugccuccuuguuuauuugggugcaauagaccugccucucucuucaacucuauguaauaaacauacugugcuucugggugacaaugcuucgccacccgggagcucacuccaccagacuccacuuccuuucucugucccauucccuuccugucccucccgugucugucugucugucugucugucugucugacugucugucugucugucauuucuucauuuauuuaccaaguuugucagggcaagugagccugugucuaggaacacaguaccauagaaaauauaccccucuacacacaguuuccucacagcuuccacucugaggaaugagggacauucuguuugacaagaaccauauuuaguggguaguucuuucccaaaucauuauccucugucccucugcauugcagccuaaggagacagcuacccacuggaugagccugagacauacucugcucacuuccuauccuaagugugggacaggauggucacuacauugggggugaguuaacacugucauugauauaugagaguuugucaugagaguuuuaaucauuuuggaacaaggagaaaugcuagcucaucagacaaaagccugaucguagcuacucagaacguuuaagaguuugguuggcagaaucuggcuguugccuauggccuggugcaaggagauugggauaagaggucacuugguggcccugaccuauaccccacaguauuuuuuucuuuggugucugaaaggacuugcaugaggaaguguccucacaguauucagaacacucuagcuugugucacccaccaggaucuucacacaacaguggcaccagacacucucauugcauaguggggguuguuuauugccugugaugauuuaagcaagaaauacacacaacaccggagcugucagacccaugaggugaacuuuaugaaaugccugcccagaugugagugguggcagaaacgucacauggguuuuccucaagguuucacuuucuguucacuguuaguaacauuggaagacaauggagguauuugccucaaaggucacaugcccuuccgucugucuucuuuccucccuguccuguguccacacccgccacagcuaccccaggcuucaccggacuaacuguauguuuaugucugcuggcagaaagugagggucauguguguugaagaaacaaugcacauugcuuuuccuuacaaaaaugagaugaaaaaauaaaucuagacacacuuuucaagugucacucuucuuuaaacuuuauauauagauagauaaagauauguguucuuauuuuucuuaaguauacucuacuuagaacuuuuaaaaaauaaacuuucuuuuugguaccucuggcuuccuauauaugucuuggaaacauuuaaaaaauacaucuuucuagaacucuucugugcaaauaauaaacauaaauaaaauuaacauuuguuacauaauaauaaaaaggccauuucaaggauuucuuugucaccacauuuggcuguggcccuucggaggugauacuauaaguagcccgugacuugucccuggaagcugugcagguccugcucuggcugugguggguuggauagaaacucaccauccugcuuauccaucuguaaacuacuuccagacaauugcaagacacuucccagcccacuggccagugacagcgaggagauccaauuuagggagccaaagcugggcagauggaagagugacgacaaacgggcagucugacuagcacugguggauugucucuuagaauccccaggacauacuucugaaauagccccucugggcauggaggacccugaggccugagagccaaguccuuccagcaagguguucucucuuaauggcauguuuguauccacugcacuggguuccccgcuggcuucuggggaacaggucagcugcugugugaacugggaagcuugagaggcacagucucuagggagagucucaaaaggucccauggucuuccuuucugaaagcucgguuucugaguguccagguggcugucccugagcaaaagucucuuugggaucacugaauuuguugagggguuucuuggccaacuggcguccuagcuggaguuggguggggaaaagacuccccuggagggcuuugaaaaacaaucuagaaagaagacacacacacaaaaaaccaaucagauucuaaaccgggccauggcugagcuucaugagacucaccgagguucaagcacagcaaggccaggggcuguguauauucuacacuuccuuaucacuuggcuuuaccaacucagcuacucaccugggcaacaaugcagcaauaggugcgaugagacaagucaaguagaacagagggucacccaguaaugucugcaugguccaguaaggguuagauggaggguagcauguggcacaggaaguguuguaaaucagagccacggagaaaaacaaaaagguacugaagccacaggcuaaccaguugagccaggucuaaaaggaaccagagagaaagggcauuuacuucacauuaagaguagcaacagugugagcaacaugaguuuaucagggacgguuaagggugugccuuccaggucuuagcgaagauucuugccauugcuggccagugggccuuaguggagcagccugggacaggagcaugagggcaagaggagagggcuaggcaaaagcagagcagcgaaggagacaagaaggcagguagauaaacagcugcucaggacaguugguggugggucacucaaagcuaggccagcaacuuugaguguguguuauuuuccuuuuuaugacauagguagggcagcauuguagccuucuauaugugcaaaacaccugcugggaaggacaugucucauaauaccagccccuugugguguguggccuugccccuggcucucacccagguuuugguuucaauacccaggugcagcaggaaggugaacagugcuauugcugugacaggggucccccagguaaagacauccacaucggagucauaguaggccugaaagacagaaagcaaaaugguuaaguucugugcgacuguaggugccuagaagcagcugaggagaaaaccaaugcuggguuccuacuuaccagguagggaaugaaaaagcauaccaggcuuugaaaggcagcauccaccauguuuaaccagaaugcucguggucuguauuccugagacacagaaacaaggagggauuacagagaagggcuugucuccuccaaggaauuuuggagcaugggauacccuaaguauuccaaggccuggaagacaauguuuuguuucaggagccaaggagagcaaggcuccaacauuguggaugagaaaccaaaaacagucagagccagaguugcagguauccgggugacugggaaccucugaaccaagaacaugagcccuuuuagguauaggucagcagaguuaugaauuucagaagcuggggugaggggaguaggaggaauuggacaggagaagagggaaggguagaaaugaugucaguauguucaguacucaugaaauucccagaaagaaacaaaaacaaaaacaaaaacaaaaacaaaaccagacauugcucacuauggaacuucucaucaggaaaggcuaucuaaaauauugauccugcugcccagucugcaccaccuccuguuaugcccccaccccagucagggcccuccuuccacuuugaaaaggcuuuaugaugaauacuuugaaagacucuuaucaauuagccuuaaaaucuuagugauuuuuggaacugucuauuuuucuuucaugcauaguguuugcaccuguauauguauauguauauguagugauacaggauguguaucacugcccagaacaguaaguauucuuaaccaccaagcccacucuccaaccucucaugauguugguggaacuguuugggaacgauugggagguaugcuccuggaggaggcaugcaugccugccugccugccgccugccugccgccugcuccuggaggaggcaugcaugccugccugccugccgccugccugccugccgccugccugccgccugccugccugccugccugccugccugcccgcccgcccgcccgcccgcccgcccgcccgccugccugccugccugccgccugccugccugccugccugccgccugccugccugccugccugccugccugccugccugccugccgccaugcuccucaccauguugucuguagacucacccucugaaacccgaagucuccaauaaagucuuuuaaaaaguugcuuuggucauaguguuuugucacagcaauagagaaguaacuaaaauacugacauagugggggacgggauaggggguuuguggaggggaaacggugaaagaggauaacauuugaaauguaaauaaauaaaauauccaauaaaaaaaacgaggcuugcuuaaaacaaaacaaauacacacacacacaaaaaacaaacaaaacaaaacaaaauaaaaaaccagacauagguauuccauuuuaacaaugccaagcacacuaugagacaaaaugguccugauacagacaaauggaguguuccaguaccuggaugauacaaaucuguauuuaaagaaacacccaggaccccaccacccccucaacagcagccucauaaguccucaaguaacucccagaggcuuugauugcuugccugguacacacaggagauaggaggagcauuuaccaccacuuaaagaaaaggcuggugacauccucaugguuaccucacuccacaugacaaguuaacagugucuugucucauggccagccaaggacaguaagccagcugggaugggaauccugucaagaccacugguaucuccuaacaaacugcuuucuaagcugugacaccuguuccuaugagaacucacuaucugugaguguucucauaggaacagcagaguagccauaggaagguaacuugaagcaaauacauccugacucugacauacugccgaagcaauagggugcuucauuauuucugcacacaucaaaacuaaacuggccaaagagaagcauacaugcuuuacuuuaagggcuagcugggacaacuggccaucaguuugccaaauaucuagugcuaauguaagcaucugucugcucacugagugguuacccugugagucuguuguuuaauucaagucgaaagugacacuuuguuucuucuuuaauuuggccugcuuuagagaaauuguuuaccaccugugaccaaggcagauuugcugaagauuuuucuggagaaagcagagguggaaacuguuuuuacuccauguaccuucauguauuugcuuucaugaaugcaauggcauuugggggaggugauggaagcuucaggaagugacacuuugucacuuagucacuguggccaugcugcuaaguggaugaugagguccuguuugcuuccucuuugcuuccugacaugagcaguuugcuccaguauguguuucucaccauugcccugaugauuaggcacugucaccagaagcgcaacuggaauugcccuauccuagaucgcaacugccagaacccucugugcaaacaaucgucucuucuaaguguuuuguauuagcaaugcaaagcuaacacaauguauuacagagccuagcagacagcaucccuucuacaacuucaauuuuuucccaggggugucuauuaguagagauuugggggaauuuuacuuucuggaagguugaguggagaauggagggcugggagacacagggagcuuaccuccauguuuuggccacucuuguaaagcuguggcucucucagcagcaugucagcuggaacaucuuuauccagcaccccagucaccagcuggggaagugaugagaagagcagauuaaagaaaaucagauaccacugaucaaucauggcagaugcagaaaagccacaguaaaacuggaaccaaaacaagagacccacaaacaucugcaagagagaacaaaggcauuuagaacaguuuuuguuugucuguuucuuuauuaguuuuauuuuguuuuugcugucacuacugagacucaucuaaaggacccaagauccuuguagagauuuucuguagguuaagugacuaggcagugauuucuucccaaaaggcagcccuaaauuccagccuucuuguagccugccucauacccucuucuaccacaaccuccuaucuucaagagacuugaaacaggaauuuaaaauuccuaagaacaucuuagggagagaugagauuuuugugccagaggaguuggagaugaucaacauuaaacaaucaaggugugacuggggcuuauaauggcucacuuuucaagggggccuguggcuuguuccuuggggcuuucauuuuccuuucuucccaaacaacuacccuaggauagaucucugagcccauguccucuuguuuucccauuuucuuuguguuuucuuuucuccuccuuuauuugggggucgggggagacaagguuuaacuauguggcccagucuagccuugaauucaugauccucccauuuuuacuuucuauuugaaaaagaacagugaaaaauuaucaacagcucccauuagaggaaggcacacacaagugcaaggccaagauacagauguuaugaagcagagagccugaauagccugcucagcagugcuguggguuagguaggucuuucuacuuucacuggaucagguugucaguggcugggcugcauuuacauggggagcauggcagucugaugacagauauaaaacacugugguccagaucuuaagugucucccagaggccccuaaguuaaagcucuuuucccagaucgcagagcuauuuggaguagugguagucaaaacaggugggccuagugaagggaagucagugagggcaugucauuaaacagaauacuggaaacccaauucccucugccucuccgagaaccaugggguaagcaucuuuauucccaucaugaugugcugccucaccauaaacccaaaccucuaacagucagccaaaauaaaaaccguuuccuuuauaacuuauuuauuucacuuauuauaguauagugauacaaacccaacauauaauguauuuucagacucacuguguaaucuggcauagaucauaucacccucucuacuucaguuucccuguccaugauauggccauaccacugagaccuacauggggcuggaggugggggauguugagaaguaaaggaucugauaccuuaaaacacucauuagaucucuggaauacuguagcucuugucagaggcauacucuuccuagcuuaaugucuucauuuccuucuuugaggcucacacucaaaguccucuuaacauuuacagaaaugagauaugaaaacacuugaucagaguaugagcaauacauccaacuuguucaaacacaugaaucuuggcuuaaggugcaggggaccagucuccaaaagagaugugauagaguggaugaauguuccacugagcccagugaggguucugagcuacagcucuucauggcucuugaaagaguugcuuuaugucuccagcucuuggcagagcuacuuuaccugucucugggcuuuaguaucuagccuagaaaauugcuucugaggaucagaagaaaugcuaguccauguggguggaagcgaugacuaaaucccccaaguuacuguuuuaaucuaugacuuaaguuuccuaauaugcaaccuuccccccuucacacaaaccacugacagucuugggcuuuucauugauuuuuccccccugccuuccgcccacagcucacucuugcucacccgccgugggcucagccuuaugagucauaguaaagcaaauggagucaaagggaacaggaagaaaaauacucagauaauuaagagcccccucucaucguaccaaagagcuuuauucccaaagcucgguuacuauggaaacuguucuucucugcucuuuauuggaaaggccauuuuauucuuaaaauuaaugacucucuccugugaggacugauuacccuugaacuccucauguggauaaaugcucuuaacaaagcccugcaucuuacaugaaggaaaacaggcuaauucuccucccuguguucuccaacaaaggcaggcuuaacaaggugagcagaaggagaguguacacaugucaggcugccacuuuggccucgauuuaccuccaaaacuuuggaaagcuuacaguauguuauucucacuaccuucucaaguuggcaaaccugaauugggaaugacagagauaagcuagcuuaauuccuaguuuuguuuuggggagauuaaaagaaacuauaacccaaaggugucaaacagacauggucuacaacuuaugaggccucaauuuaguuuuuuuuuuuucaaguuuuugauguagggugaaagcaauaugcauucacccaaauuuugaauuuugauugguucuuugccugggcuuuauucucucauaaaaugauggauagugguuuugagccaaagcucccagcugucugcaagguaacaauguugcaggguucugugccacaaagcuaugauaguaguugaucuagguggacugaauguguuuuccauuugugauauuuucaacuuguaauggguuguuaucaagacaacaaaacccuacuaucgguuuagaagcaaugugcuuaaguugccacuaaaaagacugaaguaaaugaggcugcauuccauucuggccuacucuacagaggccauucacuucugcagagggaauugggaaacucuaggcucuggguaucugaggaugcaccgugcuggcaauucaauacuggcuuacaaugaauggacacauaaacucacaaggucagaaacagcacaacuuuuuuuuuuggggauguggucccaggcagaguuuaaucugauuuaauuucuaaaucuacucaauuagccauaucuugauugguucugagcaucuuguauucauuuguuagaagacauuuugguaaucaggccagugggugggagagguuaggaaagaaaaugugucaguuuccagaaugaaccauuaagaauacaaaggagcuauacugacaucagcuuagaguuagcaugaagguuuucauuagaagucauccauaagauggaacacaggguccccaauggaggcacuagagaaagcacccaaggagcugaaggggucugcaacaacauuaugaacuaaccaguacccaccagagcucgugucucuaccugcauauguagcagaagauggccuagucguccaucacugggaagagagaccccuugguauugcaaacuuuauaugccccaguacagaggaaugccagggccaagaagugggaauggguggguaggggagcagggcggggguagggggggaggguauauggaaauuuugggauagcauuugaaauguauauaaagaaaguaucuaauaaaaauaaaguaauauuaauaaaaaucuaaaaauaaaauaaaauauauuuaacaaaaaaagaauuuuuuuuaaaccuuuuaacuuauuuuacucuuuuucagaagaggacaagguauuuugauacuggaguucugguaccuagacagugagauuucuggaacaaguuuagauucucauuuaucccaagaguuuaguuugucucuuuguugguucacuuagccucaagcugcuagaggcagagccaagagagcagucuaacagccucucaggagaaugucuagaaaccuuacaaaugagucagaguucugugaugguccuguguuccauccugcaagccuauggaguaugaaggaacuaggauuaaacaugagggaccaugugggagagaucaggaagggcuuuguauuaaaagccccuaaaaagacacaaacauucacagcacaucuauucuaggaggagucuucccuuaauggagcuaccuauuaaagcuagccagaaaaguaucuaucuacucuuagcacaaaaagaugugcaaucccccuuuuucacuagguucaagggcacaugugggggcuuuguacaaggccuggugugagugugucucugauagacaccauuaaugccugaacuacacaagauuaaguaauuuucugauugcaggaccacugaacacucuucucuuuaaccuuccuggucuacagcagagaaaucauuuuccuacuguggccaugccugugaaacacuccuacaaaacacacgcagagaagcugaauacucgagagcagaauuagacaucagguagggacacagacuuagcaaccuaucuauuaaaucacuuggaaacugcuggcuuugucauuaugcuacuuuacaaagucauauaugaacaguccugucugccugcuuauuagaauuuucccccuuaaaaaaaugcagcuguuuucauuucccaugagcuagucuucaaauauuacaggguacaaggcaaggcuaagaucacagacaaacccaaaacaauggggcagacagaagacucuugaugauuuaugaaggcagcaauccuacaaauuguaaaauucaagacccaugucaaauacguacuguguuuuuauagaagaaauacagcaccauauuggccagucuggaguagcaccaguguccauggacgaucaaaagucucuccagguaucggaaucuuggcacugcaaagucacuugccaucacagccuugaaaaggaaaguaauucucaucacacugaugccccacuuggcauggaacaaaagcaagacaaagaaaauaggagaggaaaaaaaauccagccuaacacauuacuaaggguggcuuugucuuauuaaguccuccaauuaaacagaaaaaaaucauucaauaaucccuguugcucaugaauggcacuuucuagaacuauuuaaagccacaaauacuagauaugugauuaaugaguuuauacaggcuucauuuuuucccucuucuaauguuguuuucuaacaagccacaaaacagagauguauggaggucccccccgccaucccaccuuucuccagugccaaugguccuuuuccuuauacuauacccacguuucaaagaugaacuaaagcuaacccaccaauggguaucagacagacagacaucaagacauccucagaguugugcuuuggacaccuuuuccaagagaauaaauggucuuuauggaaugacaagauaaaaaagaucucuaaauguuuggcacucaugcauuuuguucacaaaaaccacccucucgggugcugguguaugcagacagggagcgaauggguaugaagggcagguauuguggaggucuacgcucagcccuucccuuccccuccugcugucuucaacacuguucacucaugaaauugagaguccauauuugauuuucuuuugucuccucacaaugccccacacaacaccaugaauauggagaagcucaagaaauauuuguugaaugaaugaaaggaaaaauucaggagggauuucucagaguugcuaguuuucucuauuuccccuaaggaaagacuaaugagaauacuugucaaucccauaugcaaagaagaccaacaaagaaauguuuuauaugaaagaccuugaugguaaauacuuagugaggagacuuaucuguuaccucuguuccuaggcuuguugcaaauacaucauuccccauccauaagacuugugacuugaaucuaaugagcaguguuggaaacaguugggcccauaggucagauagcguugagcaagcaaauuucuagauaggguguggcugaauacuuuuguauguacuucaagugacauguaauaaaggauguauuaugcaagaugggcacaccucuucugcccugcugcuaauauguuauuccaguaagugagagaccacuguccugagcuuuucuuguuauauauggguaugaaaaaucuaggcugagucucuauggacaagucaggcuaggucaccagcccagccacugugggacagccacccucaggucaggagcuggaauggacgacagagcuuccaugccugagaugcucagucucugugaacucuucuggccaccauauuguacaaaaggcugaagucaagcucugacagaggcagacaugaagucaacacagcuucuaccaccucagcuguagcagaacaggugggaaagccaacagcauugguaugggcuacggcuacaaaggaacaggcacugugucuuggcuggauuuguaguggguaagaaaggagaagguuagagagacaagugagcaucuucaggaauccacagcaugugaagauguuuccaaagacaguccuaaagucuacccuguggccuauuaaucuauucgguuuucagcccuugaaauccaaccuggagucacuaugugugcuacguaagcuccccacuccugagcuguguccucuugucuuuccaaugacagucccccuuugugugaguuucuaaacuuacuccacuaaggacaguaauaugucugauggcaucuguuucuaagucugugucaggcaauagugaaggugcacugaguuuugaaagaaugaauaauaggguaaaugacugaagaaucacagagcauaugaagcauuugggucagaaaugcauguuccauuaagcauguaaguuagccuuuuguauuuguagaacagaaucugcagacucaaacaaguguggauguaaaacauucagugaaaauguauugaaaauguagaaaguguucucucuaaacaacacagcauaacuacuauuuacauacuguuucauugcacugaguacaagaaaucaucuagggaugauucaaaguauauagaugggugugugcaggguuuaugcaaauguaacaguuuaugugggagacuaaugcaucugugaacuuugauguuaaaacagcuccucagauagugagaggcaacuauacuguacuuccaagccuaucaucugacugcuguuuaauacaaagccagaaaauuguuuucugcacaacuuuauauauagugaguuuucuauaaaucaucucugauugaauaagugaucuacccugugaauaaauggagauaaagacuauuauuuuaaaaaacccacugaauaaauuguuccucacaaucuuuaccaagcauggagcacaggguccccaaugaaggcgcuagagaaaguacccaaggagcugaaggggguugcagcccccuaggaaggacaacaauaugaacuaaacagugcccccugugcucccagggacuaaaccaccaaagaguacacauggugggacucauggcucuagcugcauauguaccagaggauggccucaaugggaggucaucaaugggaggagaggcccuugguccugugaggguucuaugccccaauauaggggaaugccagggucaggaagugggcauggguggguuggugagcagggggaagugggaagggacaagggguuuucagaggggauaccagaaaagggauaacauuucaaauguaaauaaagaaaauauauaauaaaaaauaucuaauaaaaauguuuacauauauauauauauacacauauacagcucaaacuugcucagauguuagaauuugauacagugcuaucuccagaagcuguauaauuuaacuggugcauucaaauuuuggaacauucagaacugaaacagagacaaaugaaaagcacacauggaacuuccaugggaguuaggaugacuaccuuccauuuucagagggauuuuggguucgaacagugucaugaggcaacuuucacagaguauagacacuguugagcaauaguaaacauaaugccuucagagaugagcuggggggggggcuaugacucaccuugccucuuggagucagagauucccaaaauauacuuggguuuccacacauggcucauuaauagaauuacaauauuucuuagcuucuacuggcuuagcagaaggugagcacugacccauacugaaagcaaauccuuuaccuuaaucagaggccagacagacugggaaaacuugugcucuaaugggauaagagggugauuugguccuacaggacaguccaaauggucuuuuaccugcaugcccuccuggccugagaucccaacaccuacaucugccaccuggaucaugcugacaucauuggccccaucaccugaaaauaacacagucagaaagaaucauugauuuugaaauucacagaagcacauggacaaauugaccgucuuggucuccugcuggacugaguucuguggaaaagacuggggaaagggaagaagaacaucuuccugggaaaacugagguaaccaaucagaauuaggcauaguauacggaauugccaaucacaucaagcugucccaguaaucagcuagcauuuagccaucaucuuauucagugggcucuauucugucaggauacacauagaaaagguccuugaugugaugccuggcacaauaagagaagccaucaucaucaucaucaucaucaucaucacuguugcagagacucaacucugggcaucaggaccucuccaacgcauaguugccuuagcaauuuucuuauuacaucaagcagguugaauucuguucagcauuuuaugcacacugugaauuaacuaacauaugcuuuuggguucuuugaggcauagcaaagaaaacgcccauuuguuccaucaaguuguugacugaggaauauuaaaacaagaagucagagaccuggacauguuuuggaugucagacauagacauagccauuauaauuuagacaauuguggccauucuuagaauuagacucagagugacccaaggcaaagcagauaugccaagcuguaaaguuaaaagucuacgacacacaaaugucaaggcaacucaugauguggcuauagguugacccuuuaauuucugccuuuccuuagucuuagaaaucaaaccuaggguuuucacaaguguuaugccacuggccuauguacgaaguucuuucuucacuuacguugagacagggucucauggaguuugucauaauagucuugaacuuacuauguacucuuaaggguggucuaaauguaauccuuuugucucaaucauuuucauaguugaauuacccaggcaugacauaggucaggauuaggaugucuuuuccuugugauuuuauuuuucuuuauugggcuaagcucaacauggaugauuaauuaguaguacuuguugaauuaaaaguaugggaacaauggcauucucucuagcuucccauaaagcaccuuucaaaauaauuacaaugcacaauggggcucucuaaaucuaaauaguagguucuuaagacuggggcacaugguccaaaagagaugugauguucuaaugggagagaagcuucucuuucccuggaggagauguuaccuucccucagcuuaaggcagggaagucaugguagacacucuggucauguauccugagcaugcacccuuuuguccaccuguguacuuuccuuaguggauacuacugaucucuauaaaucuuagaguguucagacuauggcuacuaaggucuuauacuuaauacuggauuauuccuaguagauaaaguacacaugugauacaggguaauacuacacacuuucugcaaauuauacuauaaaugcauguguuucacuaguugguaaagauaucuuuaucacugagccuacuaguuccagaaaugggucauauuuauaaugguguuaugauaguuacugccuucuuaguucucaccaggaaguggcuaagccugugcaggagacuauaggcaauuuagaaaugggaagagaugcucccuaagggugugauaagugaccucuaaccugucauugaagaguuucccagacaagaguaccugcaaagaaaaauaauguuagauauaauccuuaaaugaucuaaaacugugcugucuugaaauggaugugugugccauuuuggauguauuuaaugagacucucaucucagaacaguagacaaaauucagcugagaagagucacuggggcuuuuggauggugcagucuggguucuuagaacaucauaaagccuugucaccaagaugcauguaauaucucaaagccuuugaaaagggucucugcuaagucaaaauaugcuaacauaggacaucacuguggcuggauuguguagaacaaucauuaccuaaagucuugucauugaagaauuugucuacacuccagcuggucuucuuaaaucagcaauugcugaucuuauaauacuacacuacaugugucugcuaccacccacaucuuguggcucuuugaucuaugcuuuaugucuggaaugcucuacuuuaccaugcugggcauaauauuguaaauggaacaggugaaccggcuuuucuuacuucauaguucuagauggaagagaaucagaaauuugggucacauugaaagggaguggcuaaguaagauagcagcagggucagccuaaguacuugccuauggccaaggucauggccuugagcuugcuucugacaagcuucaccaccaugcucuuuugcaaaggggucgaucggcagcagaggacugagcgacacugcuuggcaaggaaaagaaauuuguccuccaggcuuuucucgagggcauaggccagacuucuuccaucaaucacaaggcuugggcuggggcuggcgucaguggauguggagacuggguugaaagagaaccccacacucaaguugcuuucagaguucugaaggguacuucuaggguuucuggauugcacauaacugaggcacugguccagcagggcugcacaugcuuccugaaauggacacacaaccaguuucaguagggucaugucacugauccugguuaucugcaacacccccaacugaaguccuucucaggcacugggcucauggcucuuuaaaccuccagaaaaggaauugcagcuagagagaaugacuuucugcggaggagaggaacucagcuuccacuggauuauacuuuauugacugccugugagcugaaauugaaauggagcauguucacguuuauagguguggcugcauuacugcuauacuguacgugauuaggcugaagguuuaaccuguaugcuguuagguucucuucggcuuuuaccuaaaccuuccugccucauacugcaccaucaacagugguacacaaagcccuuucaaagcccuugcuggaucagccugccuaucuagucccauuacuguguuuuuuucaguuauccaugcccuucccaaauuggagcugaguuccaaaacaaaggaaaacuuggauauuaauauacuuuggagacacgagccagagaccaaagagguuacucauuuccaggaacaaacacaccauggagaaguuuaaaaggcuccuguccugaugaagacagacaacccacuggccuaaggccuaguuccuuacagcacacuguggacaucaagcuguggccaaucgauacuuacugaaagcgguuacaugcagaaacuauuaaaucugaaaaaagauggccagugcccuuaggaagacuuggagaagauaggccuuuggacaugaccacugccugucacaauggggaacacacagacuugugacuggagauagaauccucugcuagaggacauucugguaaccugggaaaacuuaagaagaauguggauguagaaagccaugagguugucgaauuuauuacaaagcacccacauagcuaguucucuguuagaugaagcaggcucaccccauccaguuucaacccugaugcagcuguuguaccuggccaggugcacagagcagcaacucaugaacucugaaaguaccauuuggauagggaaaggagaugaucacaauaaggacaccaaaggguugcaaauguuucauuuuacccuagaagccucugacauaggccaagagacugaggaaucagaagugguuaccuaaaaacaggagcucuggaagaaacucugggcucuggcuguaggaggaagaaaaagcacucccaaugcucagagaagaugcaggaaauaucucucucucucucucucucucucucucucucucucucucucucucucucucucucucucucucucguuuccuccuaauccucauacuggcagcaaacagagcaaucuagaaauaaagacuccaagggcuuggaaccugcuucuucucucaggugcuauggugucaagacagcaguauaaugacugucuuuauguccuaccauuauaggcaggugggguuggggaggaaaaagaagaaucagaaggagguaaaauacacccagguuuuuucaccagagaacauuaaagggaacucauggaaaauacuagaaaauccuggaaagagaguaaagggagacacuguagcuggcccuauaaugcuauuuaugaauucauggguucccuauaugcugugcacacauagguauaauccugaggggacaguaacacaaagaaugacacucugguacagucccuaccccugguccaaacugacuuucuaagggaaaaauauguacauucaaagaugggcacuggaagcacacaaaggcugagcaaaugacccauccagagucugcgcagagccugaaguacaaauccaaaaggacagaucaccuguuuccaaaacuccauacuccagaggaaucaaaaaggucggggaagggugagucauaacauaauugacauaagucacaugacaaagguucagugucacaagaacuaggaaaucccagcucccgugaaaaagcagugaacagaaggugacccugacacuagcauaaucuaacaggaacauaaaagcagccaucauagaaaagcuccaggccagcauuagcauuuugaaaaucaguagcaaaacaguuuguggggaaaaauugugagcaauacacagaaaaaaaaaacauauagaaaugugaguauaauccuaaauaauuuauguagaaacucuaccucugaggagguagacugcagcaccacacuccuuaagugcaaauucacauggacuuacuuccaaagaguucaguauagaaaagagguggggguggggaguugcauucuuugcgaaauggauacaaguagcaaauacuagggcaucaugaacaaguaagcaugauaauacaaugugauuaaauaacgauacaccaugcccuucacucagaauucacagcuucauuguaaucacaauaaaaccaucagguaaaucuaacgaucaaaucagucuauaaagaauuuuaucagcccucuucaaacugccaaggacaggaaagacaaagauagccuuagaaacugucacagccagggacauucaagagagcuuugacaaacugauguaauaugaaguccuaaaauagaaccggaggugccaacuaagacaaucuacuauagcacuacuauagcuuuaguuagagcauguguuaauauguguuuguggguauaacaaaugugcuaugcuacugugagaugcuaauugggggaaacuggguguaauaugggaaugccccauagguuuuuccaaacauuuuuguaaaucuaaaaucauucuauauauggaauuuauuuucuaaaauccucacuauauaggcuuaguagaaaagaggcaauaauagauaagagucagcaagcucaaaauacaaacacaccaugcucaaacugcuuaaaacaagaggcaaagaaguaaaucgcaauaguagccauucagaaacauugauuauuacauagcaaggguucaaggacugugcugauuucauuugaaaccaugucgggaaggaaguggaauauguuuagugugcugaauggaaauaauugccauuucagucuucaauucaaagggaagacaugguuccagaaggaagguguaguuaagcuacuuccugaggaaaacaauaauauuuguugucagugggcuugcccucuaccaauugcuucagacacaaaggaaguagugagccaaggaaacucaggaaguccuguccccugacccuuaagacacaagaauugaaccauucuauuugucaacugaauggcucugacuuuggagaagagagcacccgaguccacacaauggaaaccaauauaugcuauucuuuuuuguuauugaaaagcuaaugaaaugaaauauuaaucagguuggacucaaacuaggaaucaguaugagaaagaugaaaagacauccuaaaaacuuaaaaaugaaacaaaauacucugcaaaaauccacagaccuaaaagaaaauggaaaauauuuauaaggaacaucaugagcuguaugcaccugaaaacacacuucaaaauugugaggugcagacaaauagugcugagucaaacaguuggaauguagaucuuauacuagaaaagaaaaauguuugagcacaggaaauaaaaacaaagaagcacaagaagagaaggaggucaaugaagaagaaaaagaagaggaagaggaugaaggagaaagcucggauuguuauaaauaaagcuucaaauacaacaaaccaacaugaaaagaaaaagacaccaagguaaugcaaaccucguucuugaagagucaauauaauugacagacuggcaucaaaaguaaucaaagaacagacacaaaauaccaaugucauaaauaagagagggaguaucacgaaagacccacaaacaucaagauagcaaggggagacugucaacauguggcucucagagacaggguccuaaggacuggacagcugaugaucuggcuguagaacuuagauggaauccaugaaucuccauagaggcugucauggccuggagcuucuguaaagaaggcagaggaggagcuuugcauggaaggaggcucaggcuucaugaagaagcuuguggauacccugaagagauuucaaguggagcucaugggagaaaucggauucuagaucagagaggggcugggaguugauaacccuugcauacuugaggauuuaagcaaauaaaugugacuagaccagagaagggucuagaggccguugacgaaacuagagaagcucgugcuaaauggaucgcugccuuggcuccacauucuagacauguaggaccucauuuaaaaaaaaaaaucaacaaaaacuccagaaauaugaaaaagaaguucaaccuucacuggaaaguuugacuaagaaagaaaauuuaucuucaaauugaugacuguuuuccucacccuaaacagaguuuacaugacuguuauacauaaacagacucuaagauauucauuaaucaccagcuuugaaguaaaucccuacuugaagagaacacaggugcuucugcgugugauuuuuauaaacacccaaaugccuuaaccccuucccacaccaggauucagggacagccucucagaucaccuccuagacagauacaccaugagggaagauguguguuauggcagcagaguuauggcuucugcacaaggugauugugcauauguaggcaaugccaugccagccuagcauguccuacacucugccccauccuccauuggcuaucagaucuuuguugacacuucugaaggacucuaggaaagaagcaauggcaacagagacagaccaagaauucuagaauaacaagccuccucuacaucuauugcauauccuuggagggcaagaccucuauaaacucggugaagaaacaugaaaagaggaagaagaaggaggaggaggaggaggaggaggaggaggaggaggaggaggaggaggaggagaaggagaaggagaaggagaaggagaaggagaaggagaaggagaagaagaagaagaagaggaggaggaggaggaggaggaggaggaggaggaggaggaggagaagaagaagaagaagaagaagaagaagaagaagaagaagaagaagaagaagaagaagaagaaguuguuguuguucaaccuugcauuaauaaauuccauauguacauucuuuuggcauuaagaaauccuaaauccaauuucuucacccaggagacaucguucuccagggucuaccugauaaguuuauuccucauccuuccucaagaaaguuucucuuugcaacagcuagagaccauuacaaaaaacuauagcccaucaaaaugcagagcugugaagcccggucccaauagauacauuuauaagacaauuauuaggcaaguagaaccuaaggcucagggaucauagggcaaagugggcagaaugaucauaagagccagaggaacauggaguuugcugugagauuguuucuucuagaaaugucagaagcuacacccaugaagucuuaucaacaggacugccuaaacauacaaaggacaacaaaagacaagcuaacauggauggaggaaagcccaagagauucucacucuacaaaaagaacuacaggcagcuauggaaugcugagagugggagaaauaccuaugucacaacaauuuuuuuaaaggccauaaggagaauaaggaggugguaugugagagggucuggagagaagaaagggaaaauaugaugugauuauauuauaaucucuaaguaugaaacuuagaaaaauaaaauaaaaaagaaaucccauagaagucgacaucucacaagacaauguuaagaaugucccaagucucagaaacaguaccuaugauaggagggaugcaguggguaagcauucuucucauggugacugccagaaguggaagccuugguggcuuucuaauauaacucugucuuuggagcuugcagaauauuaagcauugcccacacccacacccaugcccccaggacaagaugcagccucucuggaaguuaccuaccugagagucagcauucagugugaugaccucuucaccaugauccagcaguuugcaggcauaugcaauguuaauggcuguuuccuguuugucaccugugagaacccaaaucugcaggccagcuugucguaauuuggcaaugguuucagguacuccuuccugaaggcggucuucuauccccguggcaccuaguuaaauguaugacaguuccagugaguccuuaaaucacaauuugugaugagguacaaaugccauguaccaaacauaccaaagacagaugacguacuaccaacuaccuaagacuuucuuagggcucaccugccagaugacacugaauggcaaaaagucccucuggaaccaagauaaaaugauuccccauuucaggacugaacuagauacuucccacagcuguugacaugacucagucaagaauauguagaagguacaaaggcaagccaacaaacaauuauguacacucauaaagaguaccuugaaaucuuucugacuaacaagcagcuaacuuuguauauaaucugacaacaaggaccacagggagaagaaauuaccauauccauaugccaaaaggauuaaaagaaaagucuuaguaguaacccauccccuaucuuccuuuggaaaguuuucauguauaaaauacaauguuuguguucaaacaugucaaccauuuguuauccaaauggauggugcagaaagauucaauaguuuuucaaacaauacuauaaugaaugccuuuuccaaaaacacgaagaauuuaagagguaagauucccuuacugacuucauugugcuuaggaaaguauaugacagguagaaaaagaugaaaucugaaaggcuccagaaucccaaacuuguggaucugccauuaucucauagaaaagauuacaaucaaaacaagagggucugcagugucugaaauuaccuucagacuaugcauguguaaaguauacaaaauguaaggucauacucucuuguguauguaaaagaaaccacaaacacucgaaaccaaaacacuucuuuuccugagaauuuugggugaagacuauuuauccagugcuguaaugugcucaagucugccaccauuccucuucuguguacauccugguaagaugguuucugcauuccuaccgcuagaagugagcugaaucccauuauuuccugggcuccagcuuugacccaggauucuugccauuccuacuucaagcucccuguccuggagcaccgcuaugaacugcauacguguguccccagcugccaacaaugcuuugagauucgcagagggaagcccuaagucccaguguuaggagguauggccuugcacaggugaugauguuuagaugaggcaacgaaggggagaugcugagucccaugauucacagaagcacuaguugaguucugaacucuuccauacacccacauuacaauaccuagauauaagaugguuuuuugaugaaacagaaaaggacuaagggguuccagaugacauuuagaggaaccaccaaaaauucuggggaaaaugagaagaauguuauagcuacauuuucuuucuuucucuucccgagaaagcagauuaagaagccagaaugacagugacccuuccugcugaaauguuauuuguggguuguuuaacauaaucacccaaauaaaaagacuaagaaagaagaauuuagcuuagaauauuaaauauauaaacagcucauuucaucuuucucagaaaugacagugaggaguuggggaacuuccuaaaugccuuggcccuuggugaagcucuguugguugacucuuuuacaagcuuagguuccaucacucaaaacauaaauuuuucaggugauaggagguugaaaguaguuaauaacuggucuucaagagcaagaaagaucuguugaauuuuuguuuauuauuucuaugaauucaugcagaagaucaaaaggugugcugaugucaucaucagugugugacugagguugacuagggcuggucugaccuaggguauaugaucagacacacaucacaaagacagggaaugguggauguccaauuaccauagacaauuuguagaaaaaaggucagucaagccaugucacguguggaugcaagcaccugagacucaucagaaugccauuggcugagguagagcccaagccccaacaccacucagugcuucacaccaucuccuccuuccauccuugcaguagccuucccauacuggcaucauuacucuacacagagcagauaacuaaacuuggauacaaagacugaguaacuugcccaagcuuccaggaauaguaaguggcagaaccuggacuggacaaccgagccaggacuucaaacugagaagagauagaagguagggaaggaagucacagucauccuauuaugacucaggaaagggaauagauucuaucugcauuguaaacuucacucuaucugagaacuuagcaccauccaggagaaaugccacuucaucacucacccaccucagccauggagggguagugccugggagcaaagagguugagcagguggucuagaaguaucagcagggcaaccucccucuucucacucuagccaucaauaaagaacauuccagaacuucccuuucuggguuuuuaugcuguuugauuugauuuuuuuuuuuucagacuaggcuccucuauuuaucucaggcugaugccacauucacauccuauagccuguaccuccucaucuaggacuuaacagguaugccccaccuuaacugccuguugauugcuuucugaagacaguggucucacuaugagagcaaucccaauucaguaaucaagccaggggcguaaaauaggcagacacacuugugaggaccuucauuuaauguacuagagauaguauucacuaugucucuggguuccaaacccugaagauuccugaauaggauauggucugucagacaaagucugugaugguauuuuaucuagagcacaucaugcuauuaaauauuaacaguaacuacuauagacacaucaugcuauuaaauauuaauaguaacuauuguaaaaggcauguauauauagaaauauauauagauucuuaacuccuuugcucagaaaaugaggacaagggaaugcauccuuuguuaaacaagaaaaggugaguucucuggagcugugugcaagcccaguggaaauuuaguaacaucuaaguuuaguugcggugugagcacacaucacauacacaacugugggacacucagccgaacuuauucacuauuuuaauauaaaauguuaaaccacugaaaaauuaaauauuaaaauagguacuaaagaaauaaauaccuuaacgucuuccuaauaacuaauuagauuuuauuagaauuaaauagggacaaaggagaaaauaagagucaucuucuuuucauuccaaaugaaucugaaauauuuaugagaugcaaaacucaguauuuccaugaauguucacauagauuagcaggggguugaaaucuuuucaacuauauaugguuaaaaaaggcucgcuccucguagccauuuugauuggauagugaggcuuaaaggagguaaggaguucauauguguggcccauggaaaaagccuacagaauguguuccuuccaauguggaauaagcuagcuucaggccaagugguuccucagacaaggccaggacaguccagagcaagaggagcagccaugucacuagucacucgagaaccccugcaaccagcacuacucaauacaacaggcaccuggaaagcuaauuacccagcaggugcaaguucgucuccaggcgaacggcagacuggaagaggagcuccucacggcucuccacagacgccucggcuucuauguggcucugcaaccagcaggcauacucuucuuugcucagaaccuauggagacacacuguugaaugcugcgcugggugcugugcaugggaggcuggggagggcaguugcuaguaugugcccucaugaaggaggcccucacuuacccucuuggcaaugcacagggugcgcaggccuucuacugcauaaagauugagguaauucuguguuuuacuccggaucuuuuucuggugccuuccucuggcgucaucuaggucagaguacaagaagaaucaguaagagcagcccagcugagugcccccaugagguuuuccuggugcccgucauauugauuacaaacagcgugcaaaugucauagagcucaaaaucagccagcuguuacuuuaauaagggaaucucaucaaaacacaaguuuaggguuguuuauaaaaucauuugagaagcacaagagaacaaaauuuuaucaaaagugacuugacaugguuuuuguaaagucuacuaaauagaggaguauacuaacuuauuuaugaaaagaacuucaaagucucauuucucuccccaaaacauuccccacuggugagaaaagauguccaaguauugcauaugucauauuuuuacuaaacacacacacacacacacacugaauuugaaauuuaaguggaacuguauuuucucccucggcaauucugaaccauaaggccgcugaacccaagaagucuugucuacuauucaaguucaccucgagacaagcuggauguggccagcaaugcaagagugugacaaaggaugcaagaggcgucugacaacuggggcaaaguaaauaaauauaaauaaauaaauaaauaaauaaauaaacaaauaaauaaauagaauucucagucucguguaugaagcagaacauacauaaauuguacccuauggcaugaaaaugucuuggcaggccaauuccuuaaagguggccucuuauaguuaguagugaacaugaaguguuguccuggaucauuuaacuuuaauauuuaaaugaaugauaagcuaauguuuaauauuuaaauuaaagacaaguucaaagauaugcucaguuugacugccuuauaguguuuucucaucacuguugcaugcuuccugagucucuggucacugauucacuuugaaauuaaaaugcaaaucacccaagcucuuccuuggucucuggagaggagaguguggaugguucagaagaggauaauaauaaaagggcagugacucugaucaaccacaguuauugaaaaaacaaaacaacuacuugaaugaaaguaggcuaagucauucaagacuugaaauggauggagauaaggauggcccuaggcauccauuucugggcugggcggaaaccaagauauagauagugucugauauaaacgggcagcuacacugcuucacaaaaccugcucucuggccugcacuuagcccaggcacaaggacauaagacucuaccacauuuggagaaaccuuuucuacacuaucaggcagcucccuauaagagacaggcagggccgucagagggaaaauagugcuggggcuugaaggaccuguuucuaugcuuggauugaucuauauauaaucugguagaggaugaaggagguugcaaaauacccaagcuccacuggagcacaccgaagaucuuguaagucuaaggaaauucauucuggagcaaggguauacaucacccauuagucuucucaugucuuggacugaagccagggucugcugacucaggcuaaaguuauaauauucccaaugccuguaaugucauacucaugccaaagccuccuuauccccccccccauauucuacagcaaucucugggguuaguuaccuaccuauuaauagggggaaauucugugucugguguucagcaccauagauaauggaacaccaguauauucagaagugggaugaaggcugccaguaccuacacugcuuguagagggauccacgcagaaggaugcugagacugagccaggguggggcagacaagugccagagugacagcuccuaccaccgucuagaaugauggccuacauguucaccaacuuucaaauacagagggauugagagagcaggaacuggccagauacugggagacugcuguugcugcucacaaccugugaggcucccaauggggaauacaguuucucuucuugauaucaauguguauuuuuuauagaguguuaaguguuauuuccuuuacacuuuuggaauuauauuuuuccaauaaaaauuauauuuuauugagaaacgggggaaaugugauucucugguuguuuaugagagagagagagagagaaaagagaauaaaaagcuuaacugcuguaguagguagcagcaugugagacccugcugggcagagggcuacagugaauaugcuuucuguccuugcucccagagaaagaaggccagagcagacugaauucacugucuuaaagucuuucuaaaguggugacuccacgaaaccacaggcaagggcaucuugaggagcggugacagaggaauagaagucgguggcauaccgggaauugagccaguguguacagggcuuccuuugaggcaggcauugacacacagaaagugaaugacucacacaggguggaagagccaggaaguccagaugugauguuugauugaacagaggaaugugaagacuuggguggcauguugcuacgcaucucacacccacuuguugucacuucccaccguggccagcaagacgaaaggacuuggcuaugugcugauauaauagccucucuugcccugucacauucacuucugguaaagugccgugagcucuuugaagaaagcgugugucuuucauccagcaaagagaccuggguacccuccuacuguccucauguguacacaggucagguggccuguugcuucuugguuacuccuagccaucuguaacaagucuguucuucuccacaccuaucuuaucuucucaaacuaaaagcuaaacaauuauguagauggucauguguccaggugggugaguucacuggaauuccagugcuuugcuacagcugcuccuccuguuagcuacagucucaaucuugacaugugcaguauacuuauacauccuuccuauccaaaacaacugcaauacuucccagaggaagguggagauccacacaaacaggugauuucuauuuguucuacuugccagguggcacuuggagaauauaagauacaacugucaucaccuaggccuuccaggccuuccaguauguaaggaauuugagcucuguccuuaucugcugguaucugcagguggcaggcuucuuccugaggccuacccuaggggguggacaggacaaggcgcaugggugcacagcaacccugcauuguggcagcaugacuuaguggaagggguugcaaagcuccccaaccuugaccuuaaagcugguucuguuuaugcuuuguaaaugguaaauauuuucuuccuuugcagaugcugcacaggagcaaagccgugggcacacuuaguagccaccaucucuggguacucuguuaauguucccuccuguccuuagugaguguccugacacugccccagauaaugcuccuuccccugugacauauuaggagaaaaugaggcauaaaauggcaagcaguccauccuauuacauuuauuuuauuuaaugacaucuguuucugagauagccuuggcuuugguugauuuuaaaaugucuuuuacacuacaagaagaccuauggagucaacuaaucuggacccuugggggcucacagagaccaauacaccaaccaaagagcaugcaggggcuggaccuagguccccguacacauuuguagcauuugugcauguuugucuacaauuggaaugggguugucucugacucuguugccugccacuggaucaccuuucuagagcugggcugccuugucuauccucagugggagaggaagugccuccagcuauaacuugaaaucccagggcuggugguaccccagaggggcuucccguucucugaggagaagaggaagggguaguuggggaaggggcugugauggugggauaggagaagaggaggacugcaacuggcauguaaagugaauaaacaaacuaaugaaugaaugaaugaaaaagaauaaaacgugaaacaguggugaugaaguguggguccuucaaagcccauguauuaaagguuuggucccacuguuuuggagcagggugaaugaugcccacaaccugaagcuugguggaaguucauuagaucaccaggaguaugcuuucaaaggggguaaauaguaccuggacugcacccccuuccacuuuugcuuccuagccaugagauaaggaguuuguucuaguaggugagccuacaacaacagccugccucaucacaauacugggauuaguagggucaagcaacuguguauuaacaucucuuaacugugauccucucuauaggcugauauuuucagguauuuuguggcagugauaaaaaaaguugacuaucagguggcauuacaagacugaguaguaagaguuucuuuaugguuuaucuauacaguugugauguucuuaaaccucuuaaauuagauggcuuccuucagggagucugguuccucacccagcuacguagggcuuacugcccccuacagcuagcauaggaugugaugggcuucuucagcuguccucuuccccacuguacaugccagugacuucauucuuugagaaguucaugcaugcauacagugcauccugauuacugucccccugccucucuaaucucccuccuacucgcaccacaugccuuccacauacaguccuuuuucuacaguaccuuuccuuuuucuugugagagaggcugaagccucuaccgucuaucauucugccuugaaguacugccaguagaaggaaaucugcucagacagcuaccuucucugugcuuucuuucauguagguguaaacaagcaucaagaauaaaaaugaagguuaucuuggaauggaaaaaaaaaucaacccauuaauagggcucuguuaugagcaucaagaacuccauauacagucucacaacaggugauacccaaugugauuccagauauggaagccagaaagauuguaggggucaagcaucaaagcccugggcuggauccuuuugggcuacuaucagcauucugcauccaccuucauccucacuccuuuguucucacuacaguguugacagagaaaaagccaaguucacuuuacaauguggccuuugcuuuccuucugcaggucaggaggggauuucuagcugcacagaguuacaaccuuuuugaugguuaaucacacugugguuuuacaaaccacaauuuaccccaaaaguaauggaaagagggguccuuagcccauugaaagcagaauaaagauguugggaggcccacuuccuaugacaccaaucuacucuuacauagcccacaaacaagcuaaagauuguggccuagaacucaaagcugcccuaagucuacagcagaaaggaaauuuccagaacauucgaucuaaaggcucuccaguuuucauugcuuauaauuuaagugggaugcuuuccaagaaaucucuaacuccacuaugcuuaaagggcagaagaaagugaggucaagaugccaaagcccccuaaauucaugccacugggcacuaagaaugcugggauucucucaaagggucugugcuacaggcaggauuaaugaaaaucccuugacucagcuggguagaguuucucaaaaugcccugccuggcucuagggugcaauguaagaagaggaggcuaauuaccugaggaacagggcagcagaagauccaugaccaccgaaucggcccccuugguguauacauugaucucgucagucagcggguggcggaucaccacugacauccucuugcggauggagucgaagccaagugugugcagcagcucgaaggugagccugccuagguguggcaacuccacagacaccuggucgugaagccgguccaccagggcacaguuauaggcucuggcugcauacaccagugcagccucaucugggcucucagccucauaucgcagcucccccuccugcugcucccucugcuccccuggacacuucuggucuguaguacacucugaggcccagcuuuccuccuggccugccuggcuggcauagccauugcuggcaauggacggugcuguuugacccagcuucuccuccagcccaagaagcaugcuguccugagacaggcugggcagaaaagcugauccagauuuguggcuggauuuacuggugcucagguucccgauacugcugcagccagaagccaggcggcugggcgugaaccuccgaaggaaaucuucuauggucuuuacuggggacuucagcucaaaccucacccucaccuguaauggaagcaguccaaaggcagaugagaaaaaucccaacuaucccucacucuucauaaguaccucaggggagcaagugguucgcugacguucaggacaaacugagccugucucuuccaccuacuccacaauggaaaagccacuuaaggacuagaauaguggaucaaaccugcaaucucaguacucaggaggcugagacaggaggagcacagauucuaauccaauugugucuacuuaugagacuaguuuacauauucuuuugacuuauaucacuaaaaugcuuauauaccagucaacaugucuaaacccccaaaaaccuuucucagcaaauuaauaaacagacugauccguaauccaaauuacuaaaaucuuuuuaacaagcaucugaaaagaaaaaggaggcacacacagaauauuguuagagguuuaaaagguuaacaggagagcaaugaagccacucuuuacuuaaugagaauauacugaaacaagagaaaccugaaauguaaggaugcgcuccagucagccccaaucccagcauggaggggacagggcaugacaucucaccccuagcuaaagagcuguuggcaauugauagcuucccagagauuggagggaaagcuaguuuuaaagguguggcccaugcuaagucgaccaagcuccagcgauggccauaccuccaugaguauauggacagcacaaauuauuugagcaguuuaaaaaaaaauggagugggggaaagacagacaaaauuugaguggguaggguagcuccuaagaggagcuggggaacaggaugaaaugacaaauaauacacuguaaggaaugguaauaguaguaguaguaguaguagugauagagacaaaaaagaugggagaaaaagcaaauguuaaaacaacccaaaucugaaauguacagauuuuuaaaacuuuauaccugaucuuuugggaccaaaguuguagauuaccauaguaguuuccggcuaauccaggcauuaggacaagugagacacaggccuaaauuaugacaaaagcauuuuuccuuuggaccuauagugccucucuuuuuauuugcuucuuuugguucugagaacugagugcuggaccucgugcaugcuaagccuaccuucugccauggaaccguauguccuugcacacuggaaugacuaugcuaucugucugaguggguaaagguaucacucugcagcaccugaugccuccaacacuccugacggugauauuuaccucgaugcaggaacaaaaauguauucagaaacauauucauuugcagugcaagggugggugaguaacuauucuuucuguucccucuguaggauggcacaugugaccuuccgaacacaccuuauguuaguuaaaggguaagcuagcacgcccucagcccuccagaaguauacaugccagagggcuuugaugcuuugugauaaaaguucccacagccagguaagggaugcuaaggcagcuuguaccaccguaggaaucagcuucuccuuagagcuggcuauacaagcuuugcaugggaguguaagcuugaggucuucuguccaguuuuaggaucuuucaggucucuuagggccuugccaaguugaaguauugagaauuaagagcauagcaaagugaacaauguuuucugccauuguagagagugguagucuaccuugcucacuccacauaaucucccagggguucuauuaguggaggaagguugcuggaagaggugagccaggaggcugguagggggcaggucuagggcacacauucagcccugaacaccauuuccauccaugacuuacuugauacgaacaaccaggcucacaggcaucuauuaugcagccugauucaugagcacaauucuacgaggaacacuugggcuacacaggagcccuuuucacaugaaucuuucuucucuccaaaaagaaucguaaugguacaccaaaggaaauucagcuuugguucugcuguuuacaaaaugcuaaaugaccucugacugaaucucucucauucacuucaccuugagaaaucaugauaaauguauuaugaucaccucguaucuucuauauccaaaauuugacucugagaccuuccuuuaaaugcucaccacagcucuauggcccagaugacacggcgauuagaauagcaugucuaaaaggcuuccagucaagagugagguuugcacauuuuucucccagaaucuguucccagccuaucuuuaucaucucucuuauaugaugcuggaagcccaaggcucuggauaaaaucacuuuggcuagccaucauucgaccucugcccaaagccguaaggcccaggacggcccaggguaagugugauuuccuugaagucauguguuacccuugaggccaaguuuucacuguccucuauauggauccuuuccaucaugggcucaaaagguaucuaaacaaccuguccucucaccuacugcagcuugguacccucuuuccuucauauaaagcauccuguugcaucgccuuaugccugagggacuacucacaagcagcuuccugcaggaaagugaagcacgcucacuaccuucagucagcuaucacgaugaagagagugucaagggcacuuuggggucucauagcuuuugcagaacuugccuuuugucgugguuggucuggagaggugacaacuacuguauugcagauggugagugcgaugaagaaaucaaaaacaucagacagcucgggugagagaugggccagaggguguuccuggugccuugcaauggcgaggaaucggucacacucacucaccuucuccaacagcuuggggucagguguaaugucuuucuccugggaagaaaauagagcugcaugguguguuugacccauuaacuugccaagugguuugguuauuaacuaugcaaguagacuuaaauuuauuauaaggugugaauagaauucaaucccacuauagacauaacauuuuacaauucuacauuauaugcaaccucaauuguuuaaaauacuuauauauuuaaauaaaugcauauauuuccauuaugugugaauauacuucuuaaggagauaaaacagaugauauacaaucaguauagaaaaucucaacaggucuacaucucaugaacccacaaaaugucuacuuuuugaaagcaauguuauacauuuccuugagaucucacaucuuuacauuuagauaauuaaauuaguuuacauaaucaauauauuugauaugaaaaucaacaguugucucucaaagcauaucauaggaacuuuuacauggcuuaaaacuauaugagaacacauuuuaaaaaacauucuccaaguagacagagacauuaugauuaucuggcuaacauuucucacuagauauuuaacuuuuuuucuguuguaauuuuauuuuauuuauuuuuuaauuaauuauuuuauuuauuuauauuucaaauguuaacccccuucccaaucuccccucuguacccccccacuccauaccucuccccuuugucucuaagagagugcucacccauccacauauccacucccaccuaccccucuagcauuccccuuugcugggacaacaugccuccacaggaccaagugccucccauugaugccaaauaaggcaguccucugcuacauagguagcaagagccauggaucaacucauguauacucuuugguugguacuuuaguuccugggagcucuaagcgguccaguuaguagauauuguuauucuuccuacaggguugcaaucccuuucagcucuuucagaccuuuccuuaacucuucuauugggguccccaagcucacuccaaugguuagcugugaguaucugcaucugucuuagucauaugcuggcaaagccucucagaggacagcugcaccaggcuccugucuacaagcacuucuuggcaucaccaauaauguugagguuugauaucugcagaauggaugggucccaagauggggggugucuuuggauggccuuuccuucacucucugcucauuuuuuuuguuccugcauuuccuuuaggcaggagcaauucuagguuaaagauuuugagauggguggauggccccacccuucaacugggggccaugucuaucgacuggagguagucucuugagguucuaucuccccacuguuggguauuucagaucugggagccucccacaucucuggagucuggaacuuacuaucgguucccagcccccacccuguccccuacuccauaaugcuauuucuauucauucuccugacucucugcacuucucuccugucucuucccguaccugauccuguccccucuuuccccuccuccuccccucucccccccaguuccucccucccucugccucauaugauuauuuuguucccccaucuaagugggacugaagcauccacacuuuggccuuccuucuuguuaagcuucauauggucugugaguuauauuguggguauucugagcuuuugggcuaauauccacuuaucagugagugcauaacauguauguccuuuugugucugagauaccucacucaggaugauauuuucuauuuccaucuguuugccuucaaaaucugugaauucauuauuuuuaguagcugaguauuccacuguguaaauacgccacauuuucuguauccauucuucuguugagggauauuuggguugugucuagcuucuggcuauuaugaauaaggcugcuaugaacauaguggagcaugugucuuugcuauauguugggucaucuuuuggguauaugcccaguagugguauagcugaguuuucagguagaacuauuuccaauuuucugaggaaccaccacauugauuuucaaaguggauguaccagcuugcaaucccacuagcaauggaggaguguuccucuuucuucacauccuagccagcaucuucugucacuugaguuuuugagcuuagccauucugauuggugugagguggaaucucaggguugucuugguuugcuuuucccugacgacuaaggaugcugacucuuuccuuuaggugcugcucagccauuagagaucccucaauugauaauucuuuguuuagcucuguaucccaguuuuaauuggguuauuuguucuucuggagucuaacuucuugaguucuuuguauauuuuggauauuagcccucuguuggauguaggguugguaaagaucuuuagguugccguuuuguccuauugacagucuucuuugccuuacagaaaauuuucaguuucaugacaucccacuuaucaauuguugaucuuuuucacuagauauuuaaccuucaucauucugccaguauaaauaacauauugguaaacuucugcuacaguaauuguugauugagugacugaauuucuggacuauaacuuuugaguacuucacguagucuggaucuacauuguagaaugcuggaagagaaauggguucuucuugcaucccagagccuuccuucccacaugacagauguaaacccaaagauuagcaucuacaauucuagaugccuguacuuaaaugguagcuucuacaugggucuagaaagucucaaaagaaugaggccauucaaaguuagcacaauucacuucuccucuguucuuaaaacacagugaaagaacccuuucagaacuuguuacucacuuugagaaauuccccugccuaaugauaggaauccaugaacacacuggccauggagaagacaagagagaagcaguuuucuaugcugugugcucaucuaauuaauggggcagguaauuggcucuuccuuuucacacaugucacuuuguucugauguuuuguucauuucauuuggcuaggcuuccuccucuuugucacccucuucagauggcucacuuagcaaccacgcagcaucagauacuauggcaaagaggcuggauaaauguuucaggaaagauaaaaugauguagagggguguuucuagaaaucuucugugccuggagcacagccaagccugagcuuauuugugugauggaaaagagguaauuuugauuaucagagacaguggacaguggaaagaaagcagagugauaggcucccaucccuucagaaggguuacccacugccugcacucaccauggggcugcugaaggcagugugcuuagacagcaugcuggcucucuuugccucagcucgacugccugugcgccggugggacuugauacuuugggucuuaugagucauccagaugcucugauggcucccagugcugccacggugggauauugugcccaccuuggacaccacuuccuccucuucugagucugccucuugauaccuggccagucgcugagcuguggagauagggacaaaauguuagacaucaaugggggcagacggaauuaauucaggauguuguagguuccaugagccugugucucagagggcacccaauccccacucuccaaugguaagguuauaguuaguauuucaaggggauuuaaaauguucucuagcauucuuacuaacuugcauucuccaugaacugaguggaacuaauagagagggagcugucuacaugcaccaguagaccgugaagugcuauagaacaacaagguucacucucuugagguugcacagucuaaucgcauguagccaggccugagcccagccagugaggcucuauccaagaggaucuggacuacauuccugagauugagccuuggggauucacuggccagugagguccccauauucacaugagugucugaaaaauggcaugaagaagagcucaugccacugguuuuuuuuuuuuuuuugccaguggcucugaucaaaucuuuccaggauuuccagguuaggauggcucuucgagacaugggugagcaauaagcaauguauucagaauuacucuuucaaacuaaguauuuaaucagaaggucaagugcaggcacagcacuugguagaaauauuagggcggccuaauaucaggagauucugaucuccagagaagugggugcccaugcccaaugucaucaggcuaaguacuucuccauaccaggaugccaaacauacccucuguucucuggugacauauggccuagugugccugcuggauugcaaggaggagaaaagcccgggcacauagcuguugugcccacuuucuggcauugugaauugaauuaacuccagccuggagaggagcaacuuauaccuucaggccuccuccuccuccucucugaagcuguggagccugaaaggagcuacuucuguuguacuguuuguaacuguagaggcguuggagaagccuacacauaggcaugcagccagcuaccuguagguuauuaggucaagaggugagagaagaauaugcccauagucucuguggcuagcuuugguaugugagcucuggcaaaccaugggcugaacugauuggagaugaucuauuucaguccuggcacuucugcacagcacaaagaugcauaaaggcuuuuaugccucaaauacuuaacuguuuccucuggaagugacagaaccuguuaaccuuagcuuugcauuugacuucugucaaaucuaugauucugucccauaaagucucagaugacaacuuuauuuuuuaauugugcuauuaauauuaucuuuuauugacaaaucauaacugaacacauuuagagggugcagauguuuuguuuugacauagaauaaaaugugcuauacauacacacgaaacuauuuaauauauccauuaccucacccucaguggauauaucagcauugauugaaggcacuggugugcuagagaucucaaaccuguucuugccugucugaaacugagucccagcucuacaaggcuucuaaaaacacaaugccugggaguacacuucagugcacaaagcugaguaagugggcagggaaaggggaagcaagaggguuagagugugguagggaccgcggaaugagguuaggaagguagacaggguagauaggcaaaggcauggaaaacaccacuagcaguuuacuuggggugcacaugaaaguguuaaacaguagguagacucgucugcuuucuguuauauuguauacaaaggaagauagugcccaucaagauaauucuuaggugcuggggagauagcuuaguagcuacugauccagccacucacuggaucccauuccccacucuauucucuuggcagucugugcuuuuuugcuuuucuuauuggaaagaagggaacuguggggcagggguaugugugugugcgcggcaguggggggggggugacucacucaaaauugcuauuacucuagagcuaugacugaagugcaggcaucuucaucacuguauuuucucuuggcaaggggcuuaagaagcuuggugauuuugccagagccuuucuucagcaaggagggaggcagcaaaggauaaggaaaggaaagaugggaggcagggcuagagacucauuucucucagccuugaauagacauuguguuccaaggcuaagaaugcauuguaaaguacacagugcccgucugagaauuuucagcugauagcugaaagauaaaugagugacaacagaaaaucucucugccccucuguggugcaaagugaagccaccgcagaaacuagcacuucaagggugugcugucuggcugcugugcuugccuggcagaaaaugagccaaaacagaugcauaucauuccagacacagcagcgagcacgacaaugucagcucauucuauaaauaguucugggcucccaagugaucaagaaagauuuaucuucccuucagccagcaaacccugaaccuuguggacugucuccugcccaugcacaauuuggagagagcaguucucuaauccagcccagacuggaggccucuguccucacacucaccauuggcaucgugagaauauucuaugccggacacagugcaucuucgaaagaccaucuuguucucaguuaaugugccgguuuuguccgagaagauguauuuuaucugcccuaagucuucuguuauguucagagcucggcacugcagcugugaaucugucucuucaucauagagcucuauaucuugguuaaugaaguauacuuggcacacuuuaacaauuucaauggaaacauauaaggaaauuggaaucaaaaccuagaauacaaaggcacacgggaugaaugacuaugagcaccagggagcaguucucaguuaauacaaucaaaucaaaugacaaaugaccaaggaagcaggaacuguacuguaccuuuaagagcuuaaauggguuggcuuaaagucacuauuggaaaaggauuaaaaguacugacaaagaguuuaaacuagaauagccuaggcuggugcaauugcagagcggaaauccacuccuaugucuggaaggauaacgauggccuggagacuaaguugugcuugagaggggcuaggaaaggaaagagagaagagaagaaaacaggcacagucagaguccucaugagcaaagucaccucuaacuauagcagcacucucccucauguuuccccagagccccagugacaggagcugucuauuacccaaggaugcgcuccacaguccgggggggggggggggggggcagccaugggaugaaaagaguuguuucagaggcugguuuuauguugcaguacaauuuccugaucuugugcaauagagagcaaaugcaagauggcuugagaaaaaaaaaaaugcagugugguuugaucauucaagaccaaauuucuggaaaugaauguuuauuuauagagccacaacacugaccuaauauuuaugagcccagaauaucaucuucugacuaacuggguucucuugguaaauuaauuauguuaauaagacaccaacuauuauccuaacucaaggcuagaacaaaauuuacauuuacaaaaaaaaaaaaaacaacauaaaacaaaaaacaaaaccuaauuugcaaugucaaaugauacuguuuuccaacuguaggaaggaaccacuugugauaaggcgaggcuggacacagccucugguugcucuguccucacacaggcuaggugugaccaucacugccccuuagagcucuggggauguuuuuacuccuuaacagaccuuucuggugcugccauucaguuacagauaggcaggcaugugaaugccuaugacugcuacugaauacuaaugcuaauauaugcagcagcaccagaaugaauucugggagaggggcucaucugcagagaugcugugaaugaaauagcuugggguuuugcuuguagcaaaguauucagguuggcugccucgauuucguggagaacuacaucaguaggaacacacucaugucagggaacugggugagaggcgaauguggauguccuccauuaguguacgaaaauuucuguagaucuaaauauuauucccagauuaaauuuauuuuuuaaaagaggacucaggauguaccucagugguuagagcacuugccucgcaugcgugaggcuaauaauaauaaauuaguaauaauucauaaauaguaauagaaaaacagagaaacaaugggaaaacucaauccccaaagcguugaucaguuaaagaaaagcaaaagaagagcaugaacuggaaagucaccaaagagccuucaaauagaacaaaaagcaacguggauuugugauucuucaagaugcagaauugauagaaaauucuuugcaagauuuuuauguucucgagaggaaaguaaaguaauuaccauauaauauuuauuacuguuaccugcagaacuauuaucauuguaaaaaaugaguaaacugcagcuguggcuggggauaaagagcugccaucagacucgggaacaucaaauagugcuuuuuucucuugauagcgccgaacccacaauccaugcccugugcauguuuaaagagaggcaucauucaucugacaggaaagaaagaacgcugcuugggaaaauuaagacauuuuuuuaaaaauugcuacugacauuguuauugacauauucguucuaucagcuuucuuugucauaaaagaaagcacccuucggcaggcagcugggaagagugcacacugaguuuugcucccauccagaguuucuuaaacuguguaugauacuacacuugugaucgugucacuugggaggcuaagguagaaggaucaaacauucucccccauccuagacaacauagcaagaacccccacaacugcacucaaggguuuccuauugauggugcugaauggcgccacugauccugauauaaaacacggccugugugcugggagaaugacuucaucauccaggugccuaaaaaacagagucacaacggccuggguaagcacgcauuaggaccuaaauacggcccauguggccccuucuuggggauucaacuuucacauguuacaguuucuaagaagucaaggguuaugcguguuucucgcuaaacuaauuugcacaccucucugguuacagaaaccuuuugguguucuauguggcucugcuuuaaucaucugacaccaugcuacaccugucugguccauguugacaagguagggacaagguauaaaucaagugcuggagccucaaaacaugcuacugaaaagguucuacaaucuuuugguccccuuccaagacccauauuguuguuuucucuuuugucauaccgccucauugcuauauguguuccucuccugucgcuagcuuucaucacuauugcugaauccucuuucacuggacacauuacuacggcuaugacggacccaucgcccccauccaaguagccuucaacuccaaaaggaacauuacucugcaagcucauucaccucaguguggccacacugaugcugaugcaggcacuccuggaauccaaguagugaaaaugguguuuugaccuuuaaggugcugggucuaguggagucaggauagcccccaagcuugccuguaggcugugcagcagucuacuucacugaggacucaucuugggagacuuaccaaccgcugaaaauagagauauacaaacgaggagaaggacacaccagaggacaucgcaguucaucugccuuucaagcuggcugcgcuuguagcggggcccacuauuguucagcagggcuuugguuucauguccugcagaggaggauggagggguaugaaacaccaaucuccuaaagacaaggaaccagggacuggagccuacagagcaauuaugcuggauuucagcucucuaagaaccucggucaaaauaggauucagaaugcauuauauaacaacuguaaaaugaacagaaagaaauauucuaaagaaaacggaagaacacuucaauugaguuguuauuagaacuuugguuuuuguuuuuguuuuucugauacuuuucuguuuucauaaauuuuaaguuuccaauuuccuacaauggguauguacaacuuuuaauaugagauagaaauuagaaagaaacauuggagaguacguggcacaguguggcaguagauggucuuagguguagccugugccuaccugcguagaugacaauuccagccacagccucuguguuucugauggugcacccacgaagcagcaaguuuuccuuaugcagcccagccuucuccccauugcugugcaugcuguggaagaacacggagcagggcaugucacauggcuacacaagcacuuuguugaaguacccagaaggcccugccauggcugucugguuguaacuccauagcagcucugaggaagcugcugcaaauuagcacagaagucccaaagcugcuguuuaucuacuuugaaugggauuaacugggaacugacuacagaaagugccaauucuguaguugcagggcagaccugggaagcugacaaggacagucucgcugggugauagcugguacaucuaucuacuccgccagaaaugagagugccagucagugccuugggaugucacaaaacacacacagccauugagaagggaugguaugaauuuugacagcaguuugugugugugugugugugugugugugugugugugugugugugugugugaguuucccuaucuuagguguaaguguauaugccaacaaguguguauagguaccaacauggaguagacaucuauuacccuccucuauccuuuuuugccuuguuuccuugagacagggucugucguugaacccagggcuuaucauuuuucagccaaguuguauggcuggcaaaugcagcuguccuuuuguuucuguucccagcuucugcuuccugugcuagugccacagguauggauggccacaccuuaucuuuacaugggugcuggggauuugaacucagauccucauguguacacguucucuuagucaaugagcccguuccucaagcccaauuuuggcaucacuuuacaucuaucuuucauaaaguuauaaagauauuaauauauuuaaucugagauauauguaaacuaugagcauuacaaauugugucagugcuguauagaaucaaaaguacuguucaaguuuaagccauugacuuuaaaacuuguccucuugguccaaugaccaguguuguccaacagggucuacacuagcacuauacgagagcagacccaggagcacaauauacaggcuaccuucccauacccaccauagacacccuucuccccacccuuaucaaaaugucuccucuuggcaacucaggugaaccuaaaagucuuucauuccuuacagcuccuagaguggugcacauuagcugcagaaauaaauauauuuucaaugaugaagagaaacuauauaaaaucaagacuacaaugcuuguugugcuuaagugcauuguaguucauuuaacauaauucaccacagugccaguucuucugcagaguauguagaaagggacacucaagggacuauuaaaaaaguccuaugacgaaggcucacagcaggaaaaccaagauaaagguucaaagcugaagcuaagcaucaagagauuaggcagauacacacaaaggcagauacauauaaagcccuaccccauuacugucccauuaccagauagaaaacugcaauguuguauuucucauguggauauuucuuuagugacaacuagacaugaaaaaaauuccuuugggcagcaguggagaaagaaaagcccacuuuucuagaaacaagacggacucagcaaaaauaagaauaguauuucauauucaaccuucucugauaucauguguaacuacuggcaguccucuauaucucugagcauugcaccugcagauucaaccagcuauagguagaugacacugggggugaggaauucucuauaguuaauagguugauuuuauuuuucuuguuauuucuuaauuuuuucuuuuuccaauuuuuuauuagguauuuucuucauuuacauuucaaaugcuaucccaaaaguccccuauacccuccccccacccuggucccuugcccacucacucccacuucuuggcccuggugguccccuguacuggggcauauaaaguuugcaaggccaaggggccucucuucccaaugauggccgacuaggccaucuucugcuacguaugcagcuagagacacaagcucugggguacugguuaguucauauuguuuuuccaccuauaggguugcagaccccuucagcuccuugagaacuuucuuuagcucuccauugggggcccugugagcauccaguucuguguuugccaggccucacaagagaaagcuauaucaagacuacaagagaaacuauauaaaaaucaagacuacaaugcuuguugugcuuucagcaaaaucuugcugguguauacaauagugucugcaauugguggcugauuuaggaucaauccccagguggggcagucucuggaugguccauccuuucgucucagcuccaaacuuugucucuguaacuccuuccauggguguuuuguucccaauuuuaggaagaggugaaguguccacacuuuggucuuuguuauucuugagugucauauguuuugcaaauuguaucuuggguauucuaaguuucugggcuaauauccacuuaucaguuaguacuuguuauuucuugaaaauacaguauauaacuauuuacacuauauaguuuuuauaucauauuauuuagaauuuacaggaagauauguguaguuuauaugcaaacauuaugcuauuuuauacaagugacuugaauguuugaguuuugguauucauagugaagaguucugugaauaaccuccaagguauugaggaucuaagaauugucuuucacucucugucucuaccugucuuuuucucucucccucucuuccucucucgcucccccccacccccucgguguguguguguguguguguguguguguguguguguguguguguguguauguguguguguguguaucguacuagagauuaaacacaggucuuccaaaaugcuaggcaagugcaccuugaaacugagcaacacuccugaauccaauauugugccuucaaaucaaaucaacugaggaguaaacucaugauccaguuaaaccagccuagauaaagaccauagcuacaggaacaggcagcagaugcagguaccacagacauacucccaugagaaaagugcccauaucagaaguggaaggaagacuagagaagagaauaagugguucuagcgcucaguaacuggucuacuuccuugaacuucugagguagaguguucccaucagcaguagaagagacacaggcacguaucucaguugcaaagaugcucaagaggaaagcccacuaagcugccauuagcaccuguuucuugauuauaggcccaacuacauugucccuagaaaucauguguugaaaucuuaauaaccagagccccaagauauuucaguguuuauaaguaacuagcuuaaaugugagcauggggcaucucuaacccaaucugagugaccuucuaaaaagagauuaggacacagacacacagagagauggcaaugggaaaagacaugggcacaaguuggccagccacaagucaagcagagaaagauugagagaaaucaacacacugauauguuggccuuggccuuccaggcuccaggaagaagaaauaaaccucugucuucaauucugccugagugugguacucuguccauggcaaccaagcacaaccuuuaccauuuagucuagccuccuuggaaguacucgucuuguucaaguccuuaggcuucuugacucaccuaaccaugcucuucuuaaugaaaacuuuggaagcaaaaccauaaagaacugcuaagaucuagugauccugggaaacagcagcacucaagcagacaagugucugcuuuucucucucaagaagcauugcaucucucuaacucauaugcugcugagaacaggucucauucaucugaguagugugugaggaaaggugaggacuggcuaccacauacaugacaaaaggacaggcaugggggugaaaaaucaugcaguugcacugacauaggaggagaaggcccugaugcuuagguaaugccuaccaagcccccagugcaaagaaguagcaacuugcaaaggcuugaagucagcucuuucuccaggguagcuaaucuguaccacuuagacaccaggcaucuucaaucuguucugcucugagguaguucuauaccaaccuggccuugagguccacuaauguaugaugaacuccuaucugcuuuuauaucacaacagugauaagaccucaacauuauacucccugaacuuuguaauccaaggccuuuauuuuugcuccaugucugaagcgcugcuccaauucagguuuuacaaacuccucugcaggaaccuacagcccagucuugcugcccuuguccuucugcaucucaagacaugcaugcaaccuucuauccaugcacaugagcacggcacuccucugggaggagacuuuguaggcuguguacuuccguagcuucccauacaggcugucaacucugcagugccuuagcucucuguaggcuucugugcugggcagccacccacagaaauguccuucccuccuuaugcuggcuuuggugucagaggaggucccucuuauagugugggcucaguuuuacagccugcauguacaccaucucugcuaaacuucuagguccccaggcaggguccuccugucuuauuacauucucuacccuguugucccccuaaguaauuggcaaaugcugacuacugcucuggucucggcuuuacguuggaucuauugaaugggaauguugggagggauggugaaggauagaugggagcaacagggguuagggaguaaaucuccugcaccuucuuggucagggagcacugacugacuaugucuuuucaccucguguccacuccugcccuugaguccacagaccuugaggugguaacaacacaacuguucuugauucaguauuucuacugccacuuauacguuccaagguuuccuccaucccuguguagguaacugaacucuaacuuccaugacuguaaggacaccuucugccccucucagcacugauugacacaggcaugaaggacaagaugauaacaguuuggaacugccaauccauaggcagacuuucuuuugguauaauacauuguucagguuucuguucaucuaauucaaauacacguggaaaugaccaaacugcuuugugcugacguuuucucgagggaugauuaugugaaugaaagcacucaaacauugacgagucuggcugauaugauuacaguucaccuuaaagccugcucauugccacuguugcuuggauacauuucacacaaaucucacucucaacacaggcugggagaagcuaaggaacugaaacaguucaauugucaguaaugauccugcugcuauaccucuugggauauggugcuuugaauaagaauagcuccccuaggcccauauauuugaauacuuagucccccacuugcuggacuguuuaggagagcuuaggagaugugaccugguuggagaagguaugucacuagguuuagcccaguuucacuuucuuucugccuccugcuugaggcucaggaugugagcuccugcucuggugucugccugcaucccugcugccauacuccucaccaugauggaaaaguacucaccuucugagacuguaagcaaaguccauuauuaaaugcuuucucuuauaagugccuuagucaugaugcuuccuccagcaauagugcauuaaccaaaacacaaggugacaagagucccugcauuggucaccagagugaggaggcuacccaagugagcaggcuccauuccaggggcauccagcagucacccugguguugugauacuguacccaggucuaugauaugcaggcaggaaaucucugugaaugcuuacuuuggggcaaaaaugguaugguaacugagagagcauaguagcuggauacgcuuccaugggaaaauaggcuugagaucaaaaacuucccaagagauaaaaacaaaacccucucucuuuuuuuaaaucaacacaacagaacgcuauaacaauuauaaauggacccaacaucaaagcacucauauauagaagcaaauacagggagaucugaagagaagagcaggcaacuggcuuuaugaugugaaauaaauuuuauaucagacaaacaaccagacaaccuauggcuuuauguuuuagaccucuggaucaugcucucaaagaucaucauguaagaggcugagcaaguggcucaagugguuaagcuugcuuaccacucuuuuagaggaccugaguuuguuucccaauacacauguccuccugcucaaagcugccuguaauucuaacuucaugggcucugaugcuuucugggcucuguggcuacccacccacacauacucaugaauaauaaaaaaaucaccacaugcugugaaguugacugaacauagaaaaacagaggcuaccugagaaagcuuucucuucgucauaggaaaggcgaggcuuaggccuaugcuagugaaagaauuuuggaaauagccaaaagugauggagcuucuggggaucucauuagggguuaauuauaaggacuaaccuaaagaacacagaauacuaaaguacacuugaaucaugaagcaccugacauuuaucucuuccuaauaaccuacaauguauuucuuguaccacacuauaaagucauuuaaaguacaaagcucaugcuuauacacucagagcugugaaaucaccagaaaauaauucaagaauguuuucccaacccacaaugaaacccuauaccacagccagucuuuccucuucuuaguccuuucccccaaacccugcuuaacuucuaauucaaagccucaaucuuuagacaguccuacaauuuccuaucaauggaaccacacacugaggcaaacacuacccucucuauacaauggcuucuauauugcaagauaguuuacaugguuguuucgcuugcuucucugguuaaccuggggcugaaggagcagucauauuaccuacaaaauuaccccagaguacagaaaugcaagguaauuccucuaacugccagcucuugcaaggagaugaugaggaccuaaaauucugaguuacacuuuguaaguaacaaugaccaaguuuggauuaaguggaccauaaaacagcacaaucugcaggcaugccuagcagugaguuuggaugcauaccauggcucucuagcaaguagcuucucucucauagagacuggggggaggccacucugagaagauaacaggagcaagagcccuugagccccugaccaaggacagauucuguagcugauguauuuugugagcuagcccccaauacgcguaucaggaugagguaggcugaggauuccaucucagggaaggauaaggaacucagcacaaucaggccugcuccugggaaagguacaccccucaacccagaucccauccugauauccacucaccuacauccauaguccucuguacuguucccaugaagacagcauuagucuggcuagcugaagcagagcuucucacucuguagugucuuggagucacaggaaauucuaaguaugcugcugccuacagcccaccuccagagaaccauccaaagugagcaauggagcagggguucauuugccccagaguccaucccauggccuacuuaaauuacugugcccaaaagagaugcaagaaucagagagauggcgguaaggauacaguggucuaggcagguggcacuuuuuuggccaccugugucuuuaugucaugccucagccaaagcuuuauggagaaaaaguagaaaaacuaacaagugacuaauuggaaagccagguaugaacuacgucauacuguacuggguguuucucucuauaaacgugccugccaggaggacauuuauguugucauuauaagaaaagcuugaguuaguggaauaaaauccacagaugaggugucuuccccaguguccagaagaaaaggcagaauuaggaugcugagccaauugagagguaggugcugugggugagccaaaggcuacaagccacucuguacucaagacuucauauauucacgccuucauaugccccuugcacauaacuaaacacauuacuaguauuagucuucucaaacuucuucuucugacaacucucuauaguucccaggccuucaucucuagccuuuucaggacguacuucuagagugcugagcaacugacacaugcugcuccauccucuggacacuggccauuccauuucauuuuccaugauggcuaucgccuuuccucgacucugcgaaacccagaauaucccuuccaaugucuccuccauugaguacugcccaugucggcauuucuuucacaucaaagaugauguuccuaauuuguaauuuuccucauggccuggccucuucacugacuaaauacaacaucuaggcaaaggguccucaaaucuuuaucucuaggucccacccucaccucaaucccugaugugauuuaaaugugacaugguugucuuccaaggacacagaaauuagaaacuugauugugugugucaguguuaagagguacuggcaaccucacagggaaggagguugcuauuagcccuucccuaagaucugccuuucugaauagaguuccuacucauuuauaaucccacuacaaugccauugacugggaaaacacauagcucggguuccuugccacagcgugaaccaauuuguacuuucagauguugaaaccgguacauaaacaucuuuacauuuacccagauuuuacuaucaaaucagucauucuguuuaugaauucaccaucaucucaagcuaagcaaaccucaaacccaccuuccuaucucauauagcuuucuuuuuuuuauuagauauuuucuucauuuacauuucaaaugcuauucugauauccauaaaaggcagacaauucuuccagccaccuugugaacuacucuccuuccuaaugaccaucucuuaucuucuggcccuucucaccggguacucgguauucccuguagcagcgaaacuaacagcagcuucuaggaugacaguggucaguauuuagaaggcacuuccuaucuucuacacauuaaaugagcuuucaacagugacccggaggguacccuaaaauuaugcccacuacuaauuaucuagaaaguauggucuccagaaccugccaaccucaguuugagugcuaguuagaguccucaaacuaccuucuaaagauucagaaaguacuuaauugcuugaagguccucaggggagggaugggaaguggcugaugaaagauucauucuccuuuacugugaacgaaacccuaugagaggugaugaauauaugaacaguuaucugcacauguuaaugcggugucacuuagaaacuuccuucaggacucacaggaggcaaagggaacagagcccaaggucuaggccaaaagccauugggaaaugaucuacccuuuauuuuugauugaguuggcaacaugaaauugcuuguuccuccuuuauuaguuauuuaaugucaagacuccuuaaacaccuggcaucuccucucugcagcuaauuuggucucaggauucacagagguccuggaacuggugcucuguuugugaacuccuagaggcuaguuaagcaggccagaagaagauaggccagaagacaacaaggacaagaaaaugcacagcacacuggcugggugguagcacauuaacacuuuccuuuaggaguuuagccucuuuugguuucuuaaagggaucaucuaacaacuuccaaguucugaacuacagagcaaguccagugaauggcugggucaucucuggggcacagaaguccacuuuaccuucuucugugaagcuucuguuuaguaacaaaucccauuguucccgugccuggacuggacacaggcagcagugcaggguacuaucagcaaaucagggauucacacagagagaguucuucaauaugaagcccauuuccaggaguccgcuuaagagaggaggcugcucugcauuggacagugguaucacagggaugcugagggagcuaaaucuuugaguucugcucuuacagaaaggguccagaggcaugccauggcagccugaaccugauauccuuagacuuuuaucaccugcuucauucuccaugaaauaguucacacagcuccacuuugcaguucaggaauuccagauacaugcuacucucaguucacuguuucuccuacacuaacauuaucacuauuaggaauuuuuccaaacaaccacuaagaacagacugacugauauagugagugaccuccugagcucuacauaccccugaccaagauucaccaagugucacuuuacucggccacucccggaccauuuauccaccuuuggucuuucugcuuaggaacaaagaaggaggcugaccuauugcacauagaaaucucuuuuauacuaauuagaaggaauaaauauuaaggcaguaacugcuacugcuguauugucaguguacuggcuaggaccgauauacagcaaauacucuaaugcauuguucaagaaggaauguauuuccccggugcuuucugccuggccucugacuuccauuugugaaaucauauauaauggccauaaacuucuugucccuugucauguuccucaaucucucagagggaaaaucagucacuccucaauaacacagugccuuugacaagcucccacugcugacaggaucuuacaaauuacuuucaaggucaaccaaaaaugauguauguggcaaagacuauccaagaacauguuaugaaucuguguaucugugugugcauaugguuuaaaaaagaaaaguaagaaagcuugcaaagaugcaugauacucacauguagccacgaaaccuacucaggucauuguuuggcuucucacacucgauuacacuggugaacgucagaggguugaauucagaaaccugaaauaauaguacauacacauuagagaaaccuaggcucuggucuaaaaggcucuuguucaucugcuucacacccauaguagggaaaccaucauggacucuggcuagaguuucuacagaaugccacacagccagugcuuaaugcauguuuucucauuuuaauaccaaacaauaacuaauuguuuuaacuaugaacagacuuguggauagugagaugaaaugauuaguucuaaugcaaaaucagaggcugagauaacagaaaaggaggcaccagcaaggaaaagggaugggugugguuucccgagacacauaagagccuuucuaauucuucauagcaauuuagaggaguaauuccuacuuggaaauaugaauuugugcuaaaaucccauuugcucgaugugcucuaaagauucuuccuugaccuuugccagaaagaauuuaaauagccacguaugagcaaagagcucagcgccuucaccaugacugugcuguaaaagaaauggcaacucacuguaaagagaauguuuagaucuuuccauugguggaaaagauggcgccuccuccaaagagguaagaaggagaagaaggggaaagauaauaaaggagaaauauggagucaacaacucuaaugagcccagugaaaccgagggauuuguuucuuucucucuuuuuuuuuccaaucagccucuggucagguucauuggauuuucugucaagugucacaaaacaaaacaaaacaaaaaaaaaaaaaaaaaaaaaaaaaaacccauugagcugucuuugcucauaugcaucacuggaaaaccaggcugaaacaucacaaaaaggauacauuuagugcugacaucaauccagguaaauuguauuccaucacaacaauguaucacaauguaucucccugaacacaauauagccauagaggaaauuacucaaaagucacauuuuaauguuuccuauugugccccguguaccuuaaggaggaauuaucuggcaauacuagccccaguacaauagcuaauuuugaaauauuuaaguuuucauuuauugugaaguacuaggauuugaaccucugguauuacaaagguggucuaccacugagcuccgccuuugggucauggaaugccauuuacaaaggcuuuucuuuucuuucuuucuucuucuucuuuuuuuuuuuuuguuuguuuuguuguuguuguuguuugagacaggguuuuucuguguagcccuggcuguccuagaacucacucuguagaucaggcuggccucgaacucagaaauccgccugccucugccucccaagugcugggauuaaaggcgugcgccaccaccacccagcuuacaagggcuuuucuuaaagucucuuagucaucacaagucucucuccuuuacugaaauagccuugcauuccauuugcagagucaggcucuacuucagcuucuaguguuuauuuaaagcuuuaugaauuauggugacacuagaggacugcuuuuuucccauagcagacacuggcagauacagcauacaagagggccaugaagggaguagccucugaagaaugccaggaugaauuuuggcauacaaagaagguaugacuuaaaauauuccauuucuguuuauuauucauucucacuaaggaaaaaaaaagcaauaugcacagcuugaaaacaguaggacauucuguccccagggcuucauuacugcauuuguaaugcucugucccaaccaugugucuugggaagcacacaugcccagggcccagaaucuuguuucaucuggaacuggggaggacuuuaaaacuggaggaaucuucagucuauuaggagcugaacugcacuccucucgugcacagaaugcacggguugaggugauaaccuucaggaauacagaaugugcuuguguuuggagacaggcccuauagacaauuaauuaaacuaaaugaggucaugaggcuaggcccaauccaauagcacuggugcccuuauaaucaaaagcagauaugacacaggcacauggagugaggguagguagggcaaagaugagucuauaggggaaagauacccaugggagaagucucaggagacaucaauuaaacuguugauccuuucgacucagacuuuccguuuuuagaaccaugaacgugucuguugguucacccugaagucuguggcagccccaacaaaccauacuaaggccacuucaguuucucauuuaaaaugucucucacccuggagauggaacucaguggaagagcaccuguccagucucuguaaaaucccagcauagcuguccagccuauaugagacccuaggcaucugucuagcauaugugagacccuguguacagccuguaugagacccuggcacaucugugcagccuaugugagauccuagcacauuuguccaaaauaugagauccuaggugccugucuagccuauaugagacccuagcacaucucuacagccucaaugagacccuagcauaucuccccagcuuccgugagaccuuaccacaucuguccagacuaugagaaaccccagguaccugucgagccuauaagaaauccuagaucucucuccagcauuugugagacccuagguaccuguucagccucuguaggauccuaggucccuauuuagcaugugugacacaauagacaacugaguaugugggcaauuuugucuguaucuaccucuucuguuuuuauuuuuuaauuaguuuuguuaacuuucaacuuuuuucuagggacugggcccaaugucuugauuacacaaggaacaugcauuaucaugagccacacccacagccaauacaaaugaauuuugaaagucucauugcuuacaucagggucagcauggucaaccuaguaacaaauauuugauaacacaaaaauaucagggguugagcuugggcagugcuccuucagagcucugcugggagaguuuuuuuguuuuuuguuuuuuuuuaagaauguauuauuuuuaguuaugucucuguguggauauguacucaugagugcaagugcucucucaugacagaaaaggguuucagaucccccuaaagcuagagucagagccugaauguggaugaugggugcuggauacugaacaggggucuuccacaagagcaggacaugaucuaaauuccugagccaucucuccacccaccucaguuucuacaccacugagaaguuagcauucuuaaggguuugaccaaggucaaagaggcccugcaauaacuagagcugccuugucaucggagacacccaguuucaccagagauagacacuugauguugccuuaaaaugagaccauacuauaucuaauacaccaguaacugugcaguagauucuaaaauuucucuaaaagaaggaggaugaucgugauggcugcucaguguuacagaagcaguaauuccuacaagggugaugcucacaugcacagaccagccuugagcugaagcugcagccuucagcaauuuggccacaagagggcaauagucugggauucacugcaacugacuauagggaagguuccgccacuggauagcaguugcuacauagcucccuggcuguguaaugcuccaaguggcuguucuucugauggcucugaauguucaguacaugaaauaacauagguggaccuuacuagcuggaaagaaagaaguggcauggcgaugcagcugagaguccucuuccccuuuccuugaacuugcaauucugcuagaaacugcaucauucuaugaagcaaagucaucaaaguaagugcuacuccuuucuuucagagacacccgaagccuccaaagcaggguaucuuccuaaugcuccauccacuucuuuaaagcugaugauuuaaaguauucaggaggaucaaaacacguacuauggacaugugugcuauuccugacaaaggacaugagcaccugcagauuuuuauauccucaggauggagguggggaaccuuggaaccaauucccaacaguaaacuggcauuucacacuugcauuaauuaaauuacucauaauuauucagugaaugcaaagcagauuuucugcaucuuacuacagcaguaguggcaaccaaaaggacauuuccaguucacagaagugaaauaggcuaaucuuuaggcuuagcugaugaaguguaaggacugcacaggugcacauucugugccuccgguacagcacugccuacaagaaucuugacgagcuacgagguagaauuaagagggagaccuccugucaaggucguuucaugacacuggcccuggugagaagggaugcugugugcagcagcaccuccuagcuggccagaaccacugccuacuucugcaauaagcacguuuggaaaacacuucauucuguucuaucaggacccuaucccgaaaacauccucacuaucacuugucagaacaauccuaggccaaaagaaacuccagguccuuccuuuaccuucagucuguaugccaccucuggacaucagccccuaaauguucgcugccuggaacaaugucucugacugguuuccuguauuauuaggucuuaacacuugccauaggcuugggccaggcuagccugagcacagaaguauuuuucugcuauuuccuagaaacaaaaacauauuucaagacaguggugagaaucugucaggguaacuauccugaccaccuucccuguccucauuccugccccagugauugggauagcucuccucgcauucucucucuacgaaaauggauagcugcucugguaccuaagcugcugucuucccaggaacuucugauagcauccuaaagacagcaggcaagugccacuguuuggaacuugcacaaugcccuccaucuaccccagguauacacacacaaacacgaacacacacaaagacagagacagagaaaaggaggagagagagaggggggggagggagagggaaagggagagagaggggggagggaggagggagagagggagaaagagagcacaugcauauuagccuccugcuucucugggaaaggcugagaagaccuauggcuccuucacuggaccacaggucccuugagaacaagaacucuguaccccaugagccaccacagaacuugauguuuagggauggucaagagguaaugccugcuuauguuccauacucuucugcauuaccacaaaccucugcaguggacucauuggggauaaagagguagaacgcguauugacugcuguuugucaacaguagacaggcuuugccuggcacuggggaagguacgacuguuaagaggcuacgagagauuccccauaguuccaaacaccaaagccuuuucuuuuacaaggccaagcauguuucaucucaaaaaaaauguaagaugauuucuccacagccuguaaucucguucuauaucucuugacagugugugaaaaauacugaucuaauuuaggcaagcauuuuaacccaaauugaugaaguaauuaccccauucuacuucugcacuuggaaagcaaucugugcugcacacaagccuggcaguguugcgagauuucccaggaggccacugggccaauacuauacuaaaugagugggugaaccaaugagugggugaacuuugccagcauugguuggacuaaucaaaaucuucaacuuguuaaggaaguuauggguccaguccauuauggcuccucugacauguaggagggaauucaagccuguuuguuaaauagguauguguucagaugacauuccucccauuuaaauuaaauuuaauauaccacaauugcugugauggugcuauuuaagguacuucuauuaugcucaugcauacaagugacauaguauauguucuggugggucucacaguucuaugugggucucaccauuuccuggcaucaucauuuccaggguaucaaagcagaugccccaagaagagcaucagguccuucuucagggacaacuucacacauguccauaccauugggggccuccaggaagcccaacauaucugauagguauugaggacgagagucugggucuuuacacauuucucuucuaacugcaaauuuucuugucauaaacccaaguauuagagauuaaagggacauuucuuugagaguagaaagccagcuuuucccugauuccguucugcuuguaggagccguucccuccucucccuucccaccuuuuaguccuuuguucucuugccuccuggcugguucacagcccagaacccuagaagcuccauuuagaugguagcaaaaaucaaaaggcucagaguaccgugcuugagccugaauucucaaaaucaaagccuuucuuucccucuuggccacaaauacuucaugcugcuuuagugggccaguugucagcagaaccccacauuaccuuuuaucaaauguguuuaagugcaucaaagacugauugugcauuuagauagcaaguaaugaaugcuguuucacccaguccugaaaugagggcuguucuuuaagauagcuggcuugaaagagucuguacuuauuccagcacggugccgccgcaggaagcacucugcaguggcgcugcugagcuaaacugcacagccagggcacaaguccaggcucuacucuguucugucucacagccaauaacuacuuugugccucuuccaucacuaacaguggcagggaugacauuagcaaagacgggcugaggucugugaccuacgugucuuagagaccagugagcccaucgccuggugcgagaaaaggcuauccugcugagacagaccuaggaaacacccgugagguuguuuuguuuguuuguuuguuuguuuucuuuuucuuuuuguuucuuuuuuuuuuuuaaaugaggccauaaagaacugcaucccagagaauagcugaauugaaaggaagauuucuaggacccagagacagagggacagguaccuagagguagaaagcaauggaggccucagguuuacuuauuagaaagcaauaguacauuucucucacagguauuuuugaggaaaauuaagaugagggauagaaaaagacaggcagcuaaugcauucugaauccaacuuggagaauggccacacagauggcagcugggauaugacauucuagaccacauccagauuagcuccuccaucagcuucaaaaggcaaaucagcccagcaaucuagaccagagcuccagcuucacacaaggacaugcugggacugaaugcuaaagucacuuaucccaaacaccaacuuuagcaaaagaugaagaggcaucaagccaggacccacauaaggcagaaacucaagaaagcugaggucaggucuugccggggccccuuuaacucacaggcuuacucgcucugaaagaggagaaggaacaccugagugugccuaauggaacaaauucuauacccuaggggguuuguauucacuuuacugucacugcaucaaauaaccacagauaggacucagaaagcaacacaagucugguaccuagcugcucucugggcugaagucaagguacaggcucugagccaaagaaaacuccagcagagaauccaccaucacccugggcuuugggauucuauucauuuucacaaucaacacugggaagagugauccuuucucuuguggagucacuuugauaauugaccuuucgcuucugugguuacacuaaauucccagggauaaucugggaccaucuucgcaucauggaagaagcugacuauucauuuaaucucauuuucaaccucaguuuccccaucauuagcucaauauauuaaaaggccgagaggcuugagauauagacuacgccuauaaagagguuuuuuuaaaaaugaguucauggagaacugcacccccaagagaaugagggaaccgaaagaaagauccucagcauggagacugcauaggggguaccguguaaccuugaguuaaaauagcuacccagcugagagucaauagggagguuagaaaaucucaguccuaaaauacagauuauagugauuccacacagagcacacacagagagaaggguccccucucuguguagaaaacuaaacauguacacauauguacauguacaaauacgcauauaugaugcaaguucuccauguauuuguagggaucaagcuuccgagugcaauucagauccaucaccaaagaucucucucugagagagagagagagagagagagagagagagagagagagagagagagagagaacgcgagagagaaugagauagaaacaguaguauaacacuuucauucaccuuuuuugcuauggucaugaagccaaugagaaaagugaaauuuuagaaguuccagaagcuaaaaugcauccaaguaguuugugagcccucaaauuccaauuuaaaacuuaggaagccuuuauuagauuugggaaguauuuaaaaaaaaagaccuauaauaaauaucggaaagagucauuuggcacagagcauggugugagcuacaggcugggaauuguggacagagugugaagaagcuggagggagagggggaaaaucacacaggcagaagugaaugagccaggacuggagggaaagaaagcugaugauguagcauguugacuguaaggcacagaagauuaagccuuaaauaaaaacaaauugaggcagacuauucuuagguauaugacaugaaagugcacaaagcuggucagauuugcagcucauauuugaggauccagcauccaggguuaaggugggagggaggaaucuugucgucuaggagcaguacuuugagugagacucuuucucaaaacaguaauauaacaacaacaaaaugcugaaaagcaaagaagauaaaccaaauaaacagaaaaaguguguguaugugggggucgggggugagggggugggcuggagagaugccuucaugagcaaaggcccuuguagcacaaaccuggagacuuaaguuccaucucuguaaccaacauacauaaaggagguuuacgacucugcaaaguuguccucggauuucuacacaugugcggugacauaugccuccuuauuucauucacacaugggaauaguagucguaauaauaauaaauaaaaauacaacaggauagagaaaauugcugucauggguuaagacuaaagaaaguacuaaauaaagcuguuuaaagcaaaauaauuuuuaaaaagucaauccuuuuaagacggcuaauacauggaaagaaugaauccaauaaaaaugguugaggugucauugcugaacuauugguggcaaugucucaggggcuugcagacagguaugguugcaacucaugaaugccugcacuccaagagaacagaaugcuaaaaggaauuagagcauucuugcacugucugggagaguacaaaaauaaaucugcacuguaauguguagucuaaacacgaaaauagcaccaacagaccaucugaagagagaaugauaaaacagucaauagaagagaaaggggaaaauagaucaggcaggacaaacaaaagcuacaugugcuagaagggaaaaaaaccuaucaguccuaagggacuggagaaguggcucagcaguuaggagcacuugcugcucuagcaggacacccuuguucagcucccagcacuuaaugacuuggcaaauccuaaccaucuguaguucuaggggaucugacacuuucuucuggucucugugggcaucccacaaauagaaguacuguuuuaauauuuaaaaauaucucuauucuaaggaggaaugaaguauccacacuuuggucuucauucuucuugauuuucuuguguauugcaaauuuuaucuuggguauucuaaguuucugggcuaauauccacuuaucagugagugcauaucaagugacuucuuuugugauuggguuaccucacuaaggaugauauccuccagauacauccauuugccccagaauuucauaaaugcauuguuuuuaauagcugaguaguacuccguuguguaacuguaccacauuuucuauauccacucaaacacuacugcauaugccagcaagauuuugcugaaaggacccugauauagcugucucuugugaggcuaugccagugccuggcaaacacagaaguggaugcucacagucaguuauuggauggaucacagggcccccaguggaggagcuagagaaaguacucaaggagcugaaggggucugcaacccuauagguggaacaacaauaugaauuaaccaguacccccaguagcuugcauauguagcagaagauggccuaguuggccaucauugggaagagaggccccuugguauugaaaacuuuauaugccccaguacaggggaacgccagggccaagaauugggagugcguggguaggggagcagggcguggggaggguauagggaacuuuugggauagcauuugaaauguaaauaucuaauaaaaaagaaaaauaaaucucaguaauguuuuaagauaggccaauuaaaaucuuuuaauggaaucacaaagacuguuagacugaaucuuuuuuaaaacacccaaaaauauuauuaguauaaaaaguaacauaaaaaauuauagauacaagaaaagaaggugaaaggcuaaaaaaaaaaggcgcaaaauaaaauaacuagugcaggguaacagagagaaaccucguauaacuguaauaauaucaaauacaauucagacucaaaagacauucccauguaaacacagauuacgaauaugaaauggcaacaguucaauuuguuaagacaauaaauuucuaaccuugcaugaagcaaggaaaaccauacauccuugauaacugcuucacaugaaggagaccaaagggaagucuaaaccuguccuguaaaaaacagucagaagcaggugguuucaccagcgaagcaagcgaagaguguggaggaaccacacuccauccaaugagaacaaauacuuccuaaagcugacaccugcuugcaacccaauauaaacagaaaaucacaugccgcuucaauuauuggaaaaaaaacccuuaauaaaaugugaacacacugagcccgcucagauauaaagauauaaauaacacuauacuaggaaagagagacguucuaggagcucaaugucagcagagcauuaaauaaaucaguguaauagccucauugacacaggagagaaauccugaucgucucaggugaagcagaaaauguauaauuuucaggauacaauucaacacugauucaugauauguuaucagaauaagaauaaaaggauuguuaucuuguaaaauuauucacuaguaucccagcuuaaccucaauaucaugguacaauguuccguuucccuuuaaaaguccaauuucagauguucaacuuuaaaaugggaaaacaugcccacacaacugccauguuuuucaguuucaaaauaaucuucauuguugauacauucaacaauuuauuucaauguaaggcucagugauucugagcacguuuggaacaggucaggguaagccaugguuucgguuaagaguacuacacucuggacugaggacauguucaaccuaacaaugugcuuauuagaccauaagcccaucagaagcuuagaagcaucuauauuuuguccaccguuugucaugucagacucuagggucagccugcuuccuaucaccaacccuacuagccaaaguaugugccauaaguuucaagauuucccucccagcagaagacacuuuuccugugaauauuacacuuaucuuuaaaggcacuuggcuauacugcuuacaauuuuuaugcaacaaaaaugaacagucuggauggaaagguaucccacuuagaaucacguuuaaaagagugaaauaauggaaaauaacuugaaucaaugguugaauauugaggaccauaagccucaguggaaaaauggauagaagucacauguaaaugaaaaugcagcuaguacuuauaggcagagugacuuuaaaauguuaugaugccauaggaccuauaaacaucaagauuuauccugaauccucgaggcaaacuaguaagagauuaucuagauuaaaucauggaggugagaagauccuacauguaggcagcagcauucuaaaggcuggauuccagcuugauaaaaaagaaaguacgcugggcauugacauccaccauucucugcuuugugacuauagaugcacugugaccugcuaccucaagcuccugcugccaggaccuuccuugucaugaugggcuguacuuuggauugugagccaaaauaaauccccacucucaaguugucagaguauuguaucacaacaagaaaagucacucaggcauuacuaaacuagaucuccaaacgcagugcugcagccugucaugauggcagcgagcuuuuuuauuuauuuuguuuuuccagaaauggaaaagccaguucucauauuuauguagaauuacagggaucagaaacagccaaaaugauucucagaaagaagacagaagucgauuucaaaauuuaauccaaagaacuacaguaauuaaagcagcguguuauugccuaaggccagaacagccaaaacaauuaucaguaccuccuuacauacauagucaaaugauauuugagauugguauaaugucugugaaugggaaaaauaaguauucaacaaauauugccagaucaacugaguuucuacuuauacaggaauauuugcccagcacucaggaggcagaggcacagaucacuauaaauucaaggccauccugguauguauuggguucugggucagccagugcuauacagugagacccugucucaaacaaaagaaagcaaagaacuaaggagauggcucaguugguuacugccugccacaaaaucaugaagauuggacuucagauuccuggcacccauggaaagaucugaugucugucagacaagggcugggaguaacacuaauaaguggacucccagaauucauugccaauucgacagccagucuagccacauuagcgagaccuagauucaaugagagauguuucaaauaauaagauagugauuuaggaagacacucaugucuaccucuagugcacacagacacacacaccagcaugaacauacacauacacuacacaugaaaacaaacaaaaaugaauguauuuggaggccuauaugacacuacacauaaaagauaauacagugucagucagugauauaaauaugaguuaaaaccauuaaauuauuagcugaauauguggcaaauauuccugaaguauaaaaugauggucuuuaaaauauaugagcaaauguacaagcgacaaauggguaaaaagaacuuuauaaauaguaggaacauggggacaugaagggauguugucauuagaaugaaaagaauuguuuacaauaauaucuucugguagcccacagaacauuguaaucauauguccaacaagaauuuaauagaagaguagaaaaguaacaaucgaaaacaaaaaggacaugagccaacuguguggcuuauaccucugagcacucaugaggcaggggaauuguugugagcucaagaucagucugguaacaguaaguuucaggcuacugcaaacugcauaauaaaaccuagugcaaaaacaaaacaaggguaaagaacuagaaugagcaaaaaggcaaaaggcaacugguugcaccuagcauugugaaaacaaaaaucacugguaaaauuucugaucuaugaaaacaucucccaaaagaguaaaggcaguguuggcaaggaagcggagcuauuggagcuucugggcaucacaagugagaauaaacaggaaguuguuaaaggcugaacacagaaucacacagggcaaauguguagacagaagcagguagaugaccaggggcuagaagauggagaaaaugacagcuccugccugguauuuuuaugaguuucuguuugaaauaugauagauuuuuaggggcaaaaugugcuaacacuauacaauaccugaaagaaguguuuaucauuaaaguguacauuuaaagugacaguguggcaaaucauacauuauuuaugacaccacaauucaagcaugcgcacugggugaccguuccucaaugccaagugccucugagagugaggagaaaauggaaaacuugugcccugcugguagguugcaaaauggcuuagcccuuuuagaaaauuucccaacugaucaaguuaguccacaucuucuuuucuuuuuuguuaaccccauacuguuauuaccucaaaugucuaucaacugcugaauaagucaauacaguauauauagcuauauuauauugaauacuauuagcuauaaaaaaaaaggaagaaacuauucauccacacaauguagcccaacuucuaaacauacauacugagugaaaaaaagccagguccaaaauuuacaaugugcauuuauacaacuuucucgaaaaccccagucuuaagugacuuaaagaucaauaguuugggaacacaggaagaagugcagaaagcgccucccagcuuuaguaugacaguugccugacuguugugggguuucucacuuuugccagggcucuuuccugcaccugcacacuuucacuaugcacaguaggcaaugugucaaccucaccucaauagaacaaguauaaagacaaguaguugaaauuggcaacguguguguguguguguguguguguguguguguguucgcauauguguguuuuuccuuggugguacacuaguuuucccuuuauuuuuugagaaaaauuuuaagaggaagcuaaaaaagcuagcuaacaggagcagcacugucgucugaucaaugaaagcuagcuuccucuuauggagacugugauuuuaagaacacaauugcuuuccaccuccacacacucacaaaguuugcaacauuaccugcuuagaguccugauuuaauuuuccaaaaucuaaaauacauguguauauaauauuuuuguuguuguuuugucuuuuuucaaaagaggguuucgcuguguagcauuggcuguagucuuggaauuuacucuguagacuaagcugggcucaaacucagggauucaccuuccucugccucucaagugcuuggauuaaaagcauucacagccuggcuguguaaauuuaaugaaaugacugucagugcaacugggcuuccuuuuuuuuuuuauuccagcuaauaaauauagcaucuguuuauuagguucaggguauuagcaacuggcaaagcugauuaacuccagaugacagcaagguuccaguuggcggcaacucccuucacuucagcucaggacucacuuuuaggacacucaaacuuuccuuauuccuccccacacuggguguggugguuugaauagguuuggccccaacagacacauguguuugaaugcuuggcccauagggaguggcacuucuaggcgauguggccuuguuaggguuuguguagcauuguuggaauaaaugagucaucugugagggggcgcugugaggucugcugugcucaagaucuauccaauguggaacacagucucccaaucucuuccuggcugccuucauaucaagauguagaacucucugaucaucuagcucaugucugccugcaggcuaccauccauccugcuaugaugacaauggacuaaacuccugacacuguaagccagucccaauuaaauguucuucuuuauaagaguugcuccaaucugccuuucauugacucaaacccucccccacucaagucauauaaacuccucaucuuccucugcuuguuucccacuaggaccuuagaacaaacuacucacaacuaacuacucacaacuguacuaauuuuacacugaacaaaagcuaugucccuuucaauuacuauagcaaaacaugggacaugguaggaaacuggaaaguccaacaucauagaacccacaucuaguaagaaccuccuuguuccuucauaguauacuaggaggcauaauguuccaagacaaucuucuuauucuuauaaugccacaaacaucauauggaagcucuauuuuaugaccggauuuaauucugauuacaucccugagaccucaccuccaaacaccaccagcauauuaaguugagcagguuuucaguagaacuuucaggaaagauauucagcuaugacaaacuguaccuuaaucugucucugauucugaggacagcacaggcaauauuguuuaacugauguagacauacaaggcaacugggccacauagaccacguaacuggccccacuuagggacaaacaagacuuuaauucccucucugucaccauuccuuucucuuacuuaucucucucauucccuucagugucccauugggaaguggaagaacccugcugucuggugcugauguacccuucagccacucucaucuuucacucacaccuacagaaaacacacugcuaagaucagcacuugagccaaacaggcuucaguaacuuuuccugcacaagaugauuaaaacagugcucaauuggccagccacaggcauucuugcgaaauuccuaacccuugugaggauuaaaaugaacaaauggaaggaacccucuuugugcuacaaggggaccagaaucagauagcaagucuacucagccuacacucucaaugcuucccagacauccauucacugucuaugggacgagagugguccugccuugauccucacaagacagacaaggggugcuugaguacugcugaacauagagcuaauggggagcccuccugucaaaccuacagccaucaaucacaugaacuccaccaagacauguagaccaaagcaagaaaaaaaaaaaacauaagaaacuaaagcacaggaaagggaguuagaguuuaaguucgaagaguccuacuguacucaaauguaaggucuauuuuguccagagucuuagcacuggaauucugauuguccagccuccuuggucauacacauguaagaguaggcucuaguaaugugugacuaguggaaacuauuaccugcacauccauccaaggaccugcaaaggguauauauauacagcuaguggcagcucaauuaucagggagaagcaacaagggguaggccucuguugacacuuauuuuaaaccuuauccuuaaaucuuucucccuuuucaccuucaugauggacauaaaauauggcaaauuauaaguguuuagggccagagauuuuuuucaguugugauuucuuuuuuauuuugggauacuuacauauacauuaugauauaucuugagggcaugcccaaaucuaaaaacaaaauucauuacauuuuauauauaaguuauagucugaagcacuuuuauaauuuuuuaaaaaaaauaauuuuguucaugaaacaaaauuuuauaaaacaugauaucauuaugucagugauaucaucaaaaacacuuagguucuggagaauuuuagauuuuugacuaggaauucucaagcugaauacuaguauucugaccuacuaauggagguugagcgugcauggacaguuugucucucacguauaaagaccaggauuagaucccaagaauaacagaaaauugcaaaacauuucaaccuaacaugcauaaucuaauuuauaaggaaauaaacacucaagccuuuuucagguugagauacaugacaggaaagacuggaaaccacugauuaacugugaggacaaaggacaaaacagccagacaaauccaacugaaagcccaggucucucaugcacugguccccugacaguuaaaccaccuuccuuggcugugagguggaacacacacugaaauccuucuguggggugagcacugacaacaggaugacagggagagcccccaaguaaggguuacagggaagacaaggcucaugaggaagguccaguccauguggaacagagagagcagaacaugcaugguggagcuaacuaggacacagagaaaauucugcagacagagguacuugggucuuccuucacugacagaggaucugauaagauguucgaacuggcaaaaauccaacccuuacuuugagugccaccaaagcccuuacugugugacagcaguugauaccauccaggcccuuucuccuggaaaaaguuuucacucuuuucucucacagucauuuacaacauugcaguagcaccaagagcuccaaccagucccaagguagauagcuguguuaguuaggguaaacuguccacuagagaaacaugggacucugaccaugucuaaggggaauuaucuuaauuaauugagguggaaagacaugcccacugugaguggcaccauuccacaggcaguucuauaauccugggugauuauagaauauagaaaacaaccugagcacuaauauguauauaugcacugauuucuucuucugacuacagaccuaaugugaccucccugccaugacggguucuuaacuuggaacuaugagcuaaauaugguucucccuuaaguuucuuuugccagaguauuuuggugcaguagucguaaaacaagaaauccugaucagccccauagccuuccuacagaaggauggaauaaaaucauuauauugcaauaacaaaccaggguucaacugaaaucuucacccuuuagugcugagucucuucuuuccugaggaagcuggaccuaugaauguagugugcagaaagagcaugccuuuggcugcaucucucucacaagugaaccuuauauucuuguguguugauugccuuuguaaaacagagccacucacaaccucacaccugccagcugcuaagggcaaauuuagagucagaugguaagcacacagugaucacagagguuggaaggcugugauaacuggggcacaggugcacacucauucucuuuguuccuaauugauagcauccauugcaaggucuuugcaauuuuuucaaaaaaaauguacuacauaguggaagagggcagagggggacucaagagaucuugugguccuaccauguccaugaaucugggugagaacugauuugaccaaaaccucaaagcuauguuauaaccauguuauagccaggcuucacucagccccaccuacugcccagcuccauugccccuaagcaguguaucauucuacccuuuuccacucccacuacauuuaggguuagggugggaggucuaccaagaugauagugggccucuaaaggcaucucuggcagaaugguccucccaccagagcccucaacuggaguuucaaaacaccuuuuccccuuuaacuucucauacuguagccaagaaaaacaccacuggacaccaauggcacgcaugugaggguugacugcaugaguaaguuugagugaguggccaaguuaaacacaguugcuaugugugucuguccuccccaaggaaacuggacagaauucuggcugcagguuugugacuaggauacagcaacacaacuagagcuaguccugcagcauccguucuaagaucguucaccccagcaaacaggcuccuugugcuucaaagaauacaguugcauagcacgagguucuuccuacauggaucaauuaauaaacagcaugaacaaagcaucccuaaagacacuuguauagaaagcuuuuaaagcguagguugaaagaaagcuuuucaaaagcacuuuguuuuguaaaguauagucugagaguguguguuuuaaacaaaagugucuuagugaauuauggaaggaauuggaaggcaagaacagagggguggcuauuucaguagugucuagaaaaugaggcaauaaacauggaaaccacaucugucaacaugacccucacugcaaagaugcuguccugagcuaugcacaggagccaagauacuaguggauuacuaagcaagggagcauccagugugauucaaccaucuccugcucaaaaguccuacugagcaaggauccacaggccuggccaggucucaucuaauaccuagacuuguaggagucugcuuuuucuucuugggcugaggagucccuuugucacaggagcaaaaccugccugcacagauggugauguucacugauaggguagaucuuuuuuuuucccucuguuacuucaccugcaaguucaaguuuucucucauggugacagccagugggcaguuccuuuguaaaaugauguuuccaugacaggagugcuuaaugcccacuaauauuguguugagggugagugacacaaacaugagagccccauuuugcauguauuaaaacagaagcccagagagauuaaaucacuucucuggaucaaaaccuaacuggugcaggagacagaucucacagcuuacaauggcugcuauaccagcucaccuaaggucaaaugucauccagccaggcuccuccuuagguucuaucaaugccuucuuuccaugcuuuuccagugagccaacaggaagaggcagaaagacaggcagccccaagccacagaaggcguggccuuaaaugcacaauacaagggacagggcuccaacagcggguaucuaguccacuggcccaguuccucuacucuuagaaccacagguuuucuucugacagccaagaaggagaguguuggguguccagugcuaagcacuuaagauccaaacauucuacaaaacaucucugugguguaaguguaggccaggagcucaaggccucuaguuuuuugauguuuuggucucagcauuauaagaaggcuuuggucugauuccauucugccuaacaacucagguuucuuaccucaagcaaaaagaguuuggccuuugauuuuuguuuuuucagugucuacuacaggacuaccuucuaaagugcucaagaaucugagagagggaagaaaccuuuuagagcuauauguagacaugggccacuuuagccuacuucuagaugcuccuauccuccucccacucuccccccacaccagcccugcucugucaacuucucaggcuagcaagagagacgaaaggggggaauaaaaugcacagcaggggccaucgcuuucuccaaaccacagccacaucaccauaaagucugaagagccccaaugcauaccauuguucagugugggcucucguacacuauaggucuuucuauagcagagcagcuacuucucauccuacucuguccaaaugacagcuacauuuaccuuuccugaauauguauugugcugugcacaggucauauggagcaccucaaccauccaauccccuucaaccucaaaaggucuccuuauggaccccgucccauguguguuaggaaggaagcccagcuuccacaucugucacggaagcagacuccuggagcucaggcuccauucauuauccugcaauccuggagcucacucugugugcuuaacugcaaagggucacaaugccucugccaaaccacuaggagaacagcuagguuggggaucagagcugucacuuagugaggcaucaagucacaaugcaucaaccaaagaaaaguauuucagaaauaaucuagcaaggguuuugucaauauuccaauuuagugcagacucccuuucaaaccaacggccccuaagugagccccauaguguaguauuguguguaaagauauguauaugcauagacauuuugcucuuccuggauucucggcacgcauagguucuccuuaggcuguuuucuuugugcacgguaaucaaauaaccugccauuugcucuggucuagggauccauuccucuauuucaccagagagcucaaagugugucuuucuagugaaauucuugagccagaguuccaaggucagagcuauuauuuaggaaugacauccuggcagcugcugcugcaaagcauggacugcagagacugagacuacacagcguaauguagcagcuugggaaggcaacggaaggagccaagcuuuuguguucaaacugcaggacaggccagacacagcguguguguguguguaugaaauaacgcagguaggaagcagaaggcacaugagguagacagucucuggagccucaaugcugggcuugcugugugacuaaaaagugagaccucucuaaaccuagauccucgcucggaagacaaagaagcaaccacacagugcuucaagcauggacccuuuagaacccagggaaaucuuaggacaugaccuaccucacaauagugggucaaaaggucuauucuacuauuacucuguauuagucagguuucucuagagucacagaauuuauggauagucucuaaauaguaaaggaauuuauugaugacuuacaguuggcagcccaauucccaacaaugguucagucgcagcugugaauggaagucuagcagauacucagucucacgcagcaagcaggcgaaggagcaagagcaggcucauugaguccugcuacauggacucaauaagccugcuggguccuggugaggaucacguucugauugcacuagcaguagcucguguguacagguaaacaguggccaccauuucagggaacguguaccugaacacacagggucagagagacuucagaggcaggacugagcuugaucgggaagugacuagaccacuaauaaaacgcugucagucaagacccagcccaggagaguggagagaggucagaacuaaaccuuucccagugcucgugccacaguuaacugaggacauuggguggacagugcaaucagaggaaaauuguucccuuugcuuaaaacagugcucaugcuuucugaugcaguuauuucacagaugcagucuuagaaauacaggcuuauaaugcggcagaaaagcaggggcccaagccauagaugugccccacuccuccaguccagcagcacccugcccaccuccaacacaaggucaggcuucuaaacggacucucagcagaucugugcuugcuauuuuuucauuaacugugggaacaaagcaaaccaaggcccggcucuuuuuguaauguaaaacaaacaccaacuugggaaacacaagauaucucuuccaguggaaauuagucuucccucaaggaaauccuauaauaaaaaguauauucuagccagggguugaaagguguucuuucacuauuucuacagaaaaaaaaaaaaaagaaaaaaaaaaaacaaaaaacuugaggaaaaagauucuucugucuuggcaacuaauagcuugacauuuaacacaucucuaaaaacaaacaaacaaauaaauccauguagcacaaguucugaauauuguuccaucacagauucuggcuccuuaugaugcccugucauucccagauuuuaguaauuagcacauuaauacacagacagucagcuuucuggaagaauggagccauauauuacugagccaagguucucuucuacuauugcugauuuuuccggccggaaauucaucaagaaaaggcacuuuccaccucugggagcagagugagcuugaaugagcucauggagaugaccaaugugacugacacugcacauggaguaaaguucccucugaaaauacacugaugguugaauugugccucuuucaaaguccuaugcagaacuaccaaauaugacuguauacauggaacaagccuuugaagaugugaguuaaaauggaguguuagaguaggcccugacccauugugacugucuccuuauaaagacaggagaugaggucacagaggaaagaaccagugaagacuaaagaaauggcuacccacaaacugaagagagcagcucagauggagccaacccuaccaagcccuagccaacccuaccuugaccccuaacguccagucuccaggacugagaaaauaaauucagguuuaaguuccagaauguguaauucuugauuuuaguagucuaaaauauguguguaggagaccucagcuaugcugcccauaacuagagcuguaaaaacccuuagaucuggcagcugaaacacgucagcaggugucucuacuccuagcuccuccagaccgaaagugaaaaugagcagagaugacugagcagugcugggcccugcggucuagaagcugggauaugagccaagaguaucauucauaccuucauaugaggcaucacuuucucuuggcaagacacaagcugccuuucuccuccauuccgcuggacauuuucuguuaagacuuaacgggugaguuucuauguugcuuagucuauguugaaagaguuggcagcacuuagguuccagaggaccaaaauguacaauagucuugaagucauuagcacaagaaaagacuuccugaacagaauuccauucgcauauguacucagaucaacaguuaauguguuagugaaacuaaaaagcuacguacaccaaaggacaccaccauucaaagguacaggcuacacauuuuuuaccaacuccaccuucuacagaggaucaauauccaaaauauauaaagaacucaaaaaaaaaaaaaccugaacaucaagaaaacaaccaaauuuaaaaauaguguauagaucuaaacagaaaucucaaaaggagaaauucaaaugacugagaaacccuuaaagaaaugguuaacaucguuggucaucagggaaguguaaaucaaaacacuuuugagauuucaucucacaucagacagaauggccaagaucaauauaagaaauagcaagucaugcaggcagcaauguagaguaaggagaguauucauccaaacuuguacagcaacuagggaacucaggcuggagguuccucuggaagcugggaaaggguuuaccucaagauccagccauacuacucuugaguauauacucaaaggaacuuucauucuguugcaaaaaacacuugcucaaccaugguuuccuuuugguuuuuguuuuuuuuuuuuuuuuaacuuuuuguuuuguuuuguuuuuuuguggcucuccucauaauagcuagaaacuagaagaaaacuagauguccaucaauagaugaaaggauaaagaaaaugagauacauuuacacaagggacuauuacacucacuguuuaaaaaugaaaucaugaaauucauggguaaauacauguuacuagaaaaaucauccugagugagcuaaccuagacccagaaagacaaauauaguaugcauccuccuauauguggaugcuaguuguuaagucauugauaaauuacaaaccauauaaucacugaggcuagguacagaguaaggagguagagaggaaggcuguaucuuccuaggaauaagaauagauaguuaaggauggacuuguagaugggggagugaaaugggaagaucaaaugggggaaggaggaaagagagagcaagagaggaaauacagagagggaugcuaaaacuaagggccaugugagggcucauagagaauccuaauauaguagaagcuuccuacuguauauaaauauauaauggagauuuaaaugauaucaccaaauaauaggcgggagagaguccaacugaacaugucucauuaccaaagaaaguucccagucuggacuuggcuacaucuaauugaguugcugguuaauagagucccaugggaaucuaugaguaagaucagugccuugcucagccaucagagacgcuuucuccuuuagcaaaugggaaugaauacagaaacccagagccagaaaauaugcagagaauaagagaccuugaaauccuccacaauaaaugggaugccuccaacaaaucccucaacaacaaaucucaaggcucauggaacuugguggaagaggagguggaaagugugugagccaaagugaauggagaacaaggaaauauggccuuccaagcacagcacaagagaugcgcauaaaaacucagagacugcggcagcgugcacagggccugcauggguccgcaccaggugggcucccagagcugaaaagagaaauguacacauuacugacccaaaaucuaucuccaacuauuugaaaaaaauuaguuuuucucaaagggagucucacugaagaaacaaaacacucuuaagggcaggccccaugcucagaaguagacagccaacaaaaaugaguucaguggcauuuggggagggucuuugucucauaauguugagucagagcaucuuuuuaaaaaauaaaauaaaauaaccaacaacaacaacaacaaaaaaaccuuuauagguccuuugcauauauaguuuuggcuucccacuuuaugucuccaugggauugcguguaugcaaaccugugccucugcauccucuugugcuuuuucuuugggucuuuuuucccccguuuugugcuaucccuacugguuugcuuuguuuuagcuuauuguauuuuguuauuguucuuuauaugcuuguuuguuuucuaccaaggaucugcgagggucugagucugggugggaggaaagauagggaggaacugggagacguaggcggaaguaaagccauaaucuggauauauuguaugaaauguauuguauuuucaguauaaguaaaaaauuaaaaugucagugcacaccugggaaagggugcagcacccagugggugaagggaguauagcuggcacugcuaaagggugaagguaucuugccacuuuaucagaaaaugucacaguguagacuguacguauccccuagauguuacagugaugccauuggaaccugauagaaucuauaagacauugggccaguugggagaagucacuggggaacaaugggaccacugaccccuuccucucccucuucucuuucuggccaugugugagugaguuuguucagucugugcuccuacugcaucuacucaaccaauagcucaugaacugacuccuccuaaaugauaaaucaaauaagccuauuugguuaucuuaaucauguguuucagugaaagacaaggagcccaggcuagccucaaauucacuauggggcugaggaugagcgagaacuccagauucucuuucccacccccuccaccaaaaggggggggggggcuuugauuucugaugcuuuaacagucuuagacucugacccugaaaaaucccguuccagccuuucuaagggaaaugacaacaguccacaguacauaggaucuccugagccaaggaaaaaacacaggcuucagagucuacucuggagaauuuccugcuugguggucaaggcuccucguacuugauaaaggccggaugagcaaaccaaccaaccauuugauguuuuguccaaaacaaacguagauguguaagccuuugaaguugaccuaaguuagccuuucucuccacacaaugaaaagcuuacuuucagcccaugacaggugccacugaugaaagucagucacgccagguaaacaagaacuauuuguucuuuuaacucgaagacaaaguuuaaauucgacauuuucacuuaguugaaucuuuggaguggaagugggaagcauauugaauuacugguuguugaucucagggcuucauacacccuaaguguccacuagugaaggagagagacagagacagagacggagacggagauggagagacagacagagauagagagacagagacagagacaaagacaaagacacagagagaauaucuuuaaagggcucugggccaauuccagaccuaugaaccuuuccucugauauuuccauguaacugacuuuggagcuuaggggaggccacuucucaucagucagugacacccacauuucuuggccuuuaguaggugaggaacaguggggaguaaggcauucugacacauacacuuuaguaugagugacuaaaaauugcuuuacugaaucugacgggcuagagaaguuuagauuugucccagucucagauuaguuaagauucucaaggggcccuuaagucacucugcagcacaugagucauucauuagcauaaauaaaguggaaggcucugaauucaucucacuauugaaucccagauugauccugucagauagcacaauuccauccacaccugcguaggugacagcuuuucuugaagucaauuucaugccuuguaaggucugcuuugcauccccaucucacagcuuccaccuccucuaucuaccuguggaugggugacacuccaagacacgcucucaccacagugagaacugaaacauagcuuuucucuuggaggccacaugcaaacuaaacaaaccauguggagaaaugcagagguacaccuguagaccucagaaacaauggcuauaaguaaaaugcagugagcuggucccagcuauguucuaugggcauggagaaguuucugcccauaggacacuuugcucacaaaacaacugagagacagaugacagcagaaagggccccuucaacaaagagcagaguguucuuaaguccacucugcaguggauggagaaucugagcacacugaccuacagccugcauccgcaggcgugucaacgacaagacugcaggcccuguuccucagaucauuaucugagagacccacuguuucuagaacacguuaucggugcagaaaagauuauuuaccauucuguaaauuuaaaaguaauacaagucaggugugcuaacacaugccuguaauuucagcauuuaaugaagcuaacgcaggaaggucacaagccugaaguuaaccugagcuacauaaccagaucucuucucuaauacuacaauacaaaaguacugcaaauauuugugcauacuucuguacacacauucuuguguacagacacacguaaaaacauauacaaucacacccacuuauaaacagaaacuuauuaucaagugggacagcagauccacuuaagaaaaaccaucagaacacauagcuuuaguaaaucaacugacaaagaaaccacucauagagggcucuucuccaacagaggcagccucuggacuggccugcccuccucuucccaccaucaucugaaauuccaacccacccccacccccacccccaaguuucaugacucuacuucuguuuuauuuccaccuuccaccccauucacuuccuuacauagauaauacgaaugccagaagaaaaugcuucuaguuuugauuaaugcaccuuugaugcuuaacagaugcucuauaaauauuuguugaauuguguuaacaucugcaaaguuguauaugacuuguaaugcuuagagaauaccuuauucugcagagcugugcauacaacuauuacuggugagcuagaacuucuucccugggcuucaguggaauugacacagcuucaggcuaggccugcaggucugugugaaugguuggaaaacccagagaaauccugaaugcuucugaccccucccugaugguucagacaguaccugcuuguuccagcuccaccuggaccagcaguuuuaaauaugguagguagaguaucugcauuugccuuauuuauuucacacugguaacacaaugagaugaucauuauuucauagaauucauuguuuuagagcaugaaaaauuuuaaaaauaguguuuacuggaucucaacggcaaaggcauuauaagagaccauaacaaaugugaugcgcaaauaggaauguaauuuuucacacuggaauuccuuucugaauucuuggaugcuaucauuaaauuccaaguuuuaaaugaaacauuucucuuuaagucaaaaacucuuaaguuuccuuugacagagcuugaugauggagccaucugcccagucuggacccucacccauauauuaggucugaguggggcaugaccaucaccuccuacccauucuauagccccucgaccauguucaguuuuauucagucaucgucacugaacaaacacauuuccacuucaggguguguguaggucugugugacugccacagagagcuagugucuuaauauuccuucuaacauucagauuauguucaagguccucuuucuagaaacauccuugacugcugaagauggcuacuuucuccaguauuaggcccuaacagaagcaucagcggguagaccucuuuguuagucucucaacagaugaacacuucaucuuacaugaaugacaguguaagagagaugcuaaauucuacauugucaguagagggcacuggugggagguggaggaguaaaugacuaaauccaaguuucaggaguaggggaaguggagaaagacauuguuugggccacuucaagucacuagucacuuucuccaugauuuauuucaggauaauaaaacugaaaaacuucucugagcuaggcucaaaggcuagggcuccguggcacaaaugucuagaaagcaucugccugucuugauuauggcucacugcagcugccagggcuguccaccucaagaacacauaguguagccuccccaguggccagugaucagagggucccgugguauccaagcuuggcagcucucuaugauccucugugguacauuuccagugaguuccaaaauuacaguuccucauuagcccuccccaccaccauaggcuauggaagugcccugaguagagaaggcuguguuuugucuuagaccugaugcuugcaacagccacuccucuacccaucagccuuaucccagauuacauuugcuuccuguguggcacugcaguuuucgcuucaacagcagaauaccuggccagugagacaggcauccugugcuccauuacuaccaccacaagaacacauaaaaguccuugauagacuuucucuggugcaaucaugugugacuugucuccugacuggacucugaugacacacuccuccccuguggaaauggcaaggucauugguuauuaaagaaauacagacauaaaaaucccuucuaauuuaaguuuuccugcagucuacuccuuccaauuuacuaucuaucaaauggguaaaauauuucugugacucuuauauaaaucaagauuggguucauucuucaucuuucuauggcuuaaaaacaaaagaaacaagcaagcaaaaacaaacacuuaaauacagagaacuugcauuguaaugcugcuaugagacacuugucuugucaguuguuggacauuuagaaccaaagacuuauggcuuuuuacuuucaauaaaggaaauaaauacauaaauuucagaauuauaguaugucaauauuaaucaugaaaaugaaaaaaauacaucaauaugaaaaccaaaauguguauacaucuugaagaauuuugcugcuguccaagaaaccauuaauaagaagucagaguucccuaaauuguuagugugaccuaauuugacuagauuaugacucaguucuauuugcuuccucaagucucccuagagggugauagagaacaaccuucuguauuaguuacuuuuccugcugugacaggcacaugacagacagcagcuugaggguuuaucucugcccuucuacagauacagucuaccauggcagucauggccaucauggcagcagauacaugaagcagcuuagucacacacacacgacauccagagucaggaaguggagcaugagggaugcuugugcugggcuugcugucuccuuucuagucaguccagaaucccaggccagggaugguauuacccacagcuaagcugggucucucacuucagugaaccacauaaucccucacagacaucucaaagauuuguuuccauggagauucccuagcccaucaaauuaaaaagauuacccaucauaccaacuuugaaucuuaagcaucccacuuacaucugacuuguuuauaggaaacaugaugaagcuacaaagugucacaguugcugcuugagaaauaagagggguuuagaagaguucagaaguugaagaauaaaagacaugaaaugauuaaguucuuuggaguuagcuaaggagucaguccguguccaucccuaccaccaugcuaaacauggccacuauacucuuggcucuacauaucaucaucuuucccucaauuucagauacucacacgugcucacuuaggucugccucauccucuacacacugcacuacuucugugcugcucguuguaccgggccccaccucuuccuuccuccuggugagacacugaaaacuggaaggggacuuguguccuuugcaacugucauugcugcacaguguuaucuccccacacaucaucuacuugucuccugaagagaaggcaggaguuucauguucuaggacagagaagccagguaggcccaggcuaauaggcauaagccuggcuuacugcuaagacuuaacacacugcccugcacguggucucacacaacuaccaucagaaagcauaauuaucaggcaaggucagaaauugcauggaagagccccuaacaaacagguuugguagacuuccugucccuggauaaaaguguuccacuuaaacaaaugaauguguacuuuugucugguauguauauguguauguauauguaggggguguacauauauguauauauguaguacucuauauauguuuauacauauacauuaaguuucucaugguuauuuuguuuucaaugaugucuucuuacauagcccaucugcgcuuugagcugucccucuccugccucaguuuccaucagcccugauuauaaacaugcaccauuacaauacaguaauuuugaaauuuuaugucuaugguuucacaaaauauauuugguagacaaucaaagagguuuuuuguuguuuuuguuucuuagucuuaagcgggaaaauugugauggaaacaggaaagagcaggacaccaaggcaaagacuuguaauaaagugacauccauggaggcagcuggcucaaacacuccugccacaggucucagcauuaaucucucuuugaggccuucuucucagagugugaaguggcaucucugccagcgauggugaaugaaauaaacugcaagauauugcaagagugggaggcagggcuccuagacccucagcaauccugaucaaggaaucacuucauccacaaugacugcuccaccuuccuucagauccauaaacuaucaaacaaggccaguugcuaaaaccaggccccauggacuaugcuucuaaaccacaucuccuaggcaaguggguaggaugacgccauguggcagaaggaaucuccaaugacaucuucuuugaaugcaguacucacuuccuucgacuacuuuucaaagcguccucaguacaugcaauggccagaccugaaggacugacucagacaggcaaugugagacagaguagguauggucaggaggagguuuccucacuuccuuuuagacaguuccggugucuggggacuugugucucaugauuucauucaguguuagcacuggaugucccugcauaggcuuagaaggggcaacccuuauuaagaacaugcauggcaaaaccccuuugggauuuuuuagcuuguuuguggguaaaaccucccauuccuauuccccacucaaccccauucuuagcuguuguuuaacacaucagaggcagagcucaacuuuggaagccccgaggcugaacugaacagguccuuugaagagauaauguucccaaccuacguaagaacaggucgugauucugcuaugcugccauuuggugaccuagaacaaggacucaguaaacgcugacuguuucagaauguccccucagaauucuucaaagacuaaauaucauucugagaaacucauuaaguguacacuggaaaucacagucggaaaaagcccaauccacacaggaacagguuaagcaugggcuuaggcaugaagaagggcuaucagacucugaguuacuaggaaaauugguccagcccaauaacagaggcuuucagacgagacagaugccuguggugcucugagaaugcagaccacuuacaagcuccgagaagccacggaccacuuggcgccgcuucagguuggucucuccauccagguuagcagucucgauguggcacaacccgucagggucacuggaugacagcagcaaaauguccgcagguaugauuucauugcagcaaagacggacaaagucgcccacucggauuucuuuccaguaucgauucacauacuucuuuucuucccuagugagagacuucgauuaacaugguugacaaaauccaacuaugcugaauuuggccaaugaguacuugagagucauuuaaauuuuuucuacuuuuuucacuauaaaaaguuauuuaaagaaaaaaaaaaaaaaacaagaugaaagcuauaacugugcaucacuguuggaauuggccagaauagacagaacuauagggacugauuguggaaagcuacugugcuggaaggagggagaugaagagugacugcuuaaugaucgaggagggugcuuuuggguugacaaaauguucaggagcuagagacaaugaugugggaguucaacacuguggguaccauauaugccaugugcuucuucacuugaaaguagucaaaaugacuaugcccaguccuguaccccaaagaagagaaagcaaagauuccuacagaucaccuguguucauugugguaugacaacagccaacauguagaaucaacccauccucccacugaugaacaggcagacaaauacagugcacauacagaggaauauuacccaaagaaagcuagaaugcaggugaaccuugaagauguugugcuagugaaguaaugauucucaaaaggacuaucucaucccuccacucauaagggacuucaagcaggcauauguacagaggacaaaagaguuaccaaagacugggggaccaaggagcugaaggggucugcaacccuauaaguggaacaacaauaugaacuaaucaguaucccccagagcucaugucucuagcugcauauguggcagaagauggacuagucagccaucauugggaagagaggccccuuggucuugcaaacuuuauaugccccaguacagggggaugccagggccaagaagugggaguggguggguaggggagcaggguggggggaggguauaggggacuuuugggauagcauuugaaauguaaaugaagaaaauauuuaauaaagaaaagacugggggaggacaaaaauauuucuucauugauauaguugcuaccuggugauggcaaaguuaugaaaauagugaugaugguugcccugcacagcuucauuaaugcuaccaauguauacauuuaaaauggucacaauggcagauuuuugucauaugccauuuuucuuuauuucaaaauguaacuuaacuguacuggcaaucuuuauguuauguuuauuuacaagaacuaaaaagaacaucauuuaaaaaacuuuaaacuagaauuauauugcaccuguuuaacaagacauuggguugucuuagagcucuugcgggggggggggggggggagugaucucugagcaaagccacaauucaggaucuggucugcaaaaauggacaugaggccagguccauucuccccacugaaucaagaagaaacccaugacaccaacuacaguuaccaaccucuguagccuucagaaugugcucacuaugucauccauaugaccacugggaaaagcaaacuucuaauccaacacaaaugucacuuuuaacuguuucuuggauguuuuguauacaguguaaggagcuggcugugaauauauccaacugucuuaaauuccacacuggauuugaggaaauccccacgaacuucaagggcuacaggugccgccuucggauucuuguguuucccuucccugucucucuccucucaucugucucagucugggucacggucucuugauacagaggcuuuguugcccaagcuggccucaaacuucuggacucaaaugacccuaccgcagaaacuaaaguagcuggaacugcagguacacaccaccacuccuggcucuuccuccauuuuacaccucuauuuucuuauguuuuacuacuucaagauccaccaaaccaaugaugcacaaagugcagcaauggccauuauaaaguaagauuuaaauguagcuucuauccucgaauauaaacacaaagagagacacaaucacuagagagcauccugugggcuguaccaaucaagcccauguaguugaucauacaccccauacaacaauacaugcuuccauuuauguccaguguaaugauauauagacuuacuauguuuagccuagggaacuguauggcccacuaaucacacuaagauucccugugcccguccccacccuacccagaaauggguagcuaugagacagcacauagaagugacacuccaucacccaucacuccauccuuuuuugguaagagaauuaauugaucagugucccaccuuuuagucccuuacaaugggcauuaaauuuccuuguaauuuuuuguggggucugucuaauuacagcccagaccuacccaaugggaagagguggacaagaaaacuuucuaaaugcagaagccuugugucuuagucaggguuucuauuccugcacaaacaucaugaccaagaagcaaguuggggaggaaaggguuuauucggcuuacacuuccaugcuacuguucaucaccaaaggaagucaggacuggaacucaaacaggucagggagcaggagcugauacagaagccacggagggauguucuuuacuggcuugccucuccuggcuugcucagccugcuuucuuauagaaccaagacuaccagcccagagauggucccacccacaaggggccuuucccccuugaucacuaauugagaaaaugccuuacaguuggaucucauggaggcauuuccucaacugaagcuccuuucucugcgauaacuccagcugugucaaguugacacaaaacuagccaguacaccuuggaaccuccuauaugaggacagcuggcaagacucggagcagacaauacagcuaaucccugcuggccauagaaagugugaugagaucauguuuguaugguguuuagcggcuuauaugugugacuuuuauuacacagccauaaaaccaacacaugucaucucuaacuccuacaccaaggcuagggcccuccagcccuuccucucugcucccuuuuccucuuauuccauuuucuccuuucuucuuuuccccucuucucucucccaggcagcuccauagucuauauauaccaagcaguaaacaagaaauaugcccaucacauagguuuacaauguccacuccugagaaagaauuaugucaugaaaggaagugugguucaccagagggugaaaugacacauaaacaaagggacuugacaguguacagcugugaagcaugagcugggauguggucacacaucauaaaucauagucacuccagaggaaugacaaccagcucuucuguuagccaggcacaccaagauucaacuaacugaaaacugucaacccaaggaaaguucagagagcaauuacaagagagaauauguguguguguuucuugacauucaucaacuacugauggcuggagauauccuagacccuagagcagugcuuuucaaccaucuuaaugcuggaucucuuuaauauaguuucucauguuauacugacccccccccaagcaaaauuguuuuuguugcuacuucauaacuauuauuuugcuaauguuaugaagaauaauggaaacauguuuucugauagucuuaaaugaugacuucuguuaaaggguccuuauacuucucccucaaugggguugagacccacagguugagaaccacugcccuagaggcuaacuuucugccucuuuucuaaaccaauuaacuuucuaacuguucuaaauacuuacuguuaaaccuacagauaaggguagcuuuaauuccucaccaaagaagcuucuuuuuacaacaaauggugaccauuacagagaacaaauggagaccauuacagaaugcauaacucaucagacugcacagaauaagugacugugguauguucagccagccgcaccugauauauuuacaauguacucuuuacauauaaggcucaagacauauuggaaaggagguggaaauauuguaaaccagaagacuaagauacgggcagcaaaacaguguuaccuagacaugacaaggaaguuggcacccauaacaucuuaaaaacauggaugcuuaaauaagacaugcaucaugacaacaccaguggguguacugaugaagaugggagaaaucccacaagagcugcaagcaaucagugacagcugaaagagaauuucaacuuucuccaauggugagcucccugauagguuaucauccaauccgaaguaaucaucccuuaacacauguacacaggaacaacacuaaauagacucagugguuuguugcuuuuguugugugugugugugugugugugugugugugugcgcgcaugcacgcacauacauguaacaauaaugaagaagaggucaugaauuugaggaggucacaggaggaguggguggaagagaagcaggaguggaaaauaaauaaaaguaguacucauguauaaaauucuuaaaaaaauagauaaguauaguaauaaaaauaaggaacagaagaaaauuggaauagaauguuguaugcuuaaaaaagccaggccuaagguuaaaagcauaagcaaguccuuucaagcaaggugaauauccuguuacccucagaaugggguagaaauguugccuggucagucugccaucaaucaucuguaucccugugacaucaccuuucagucucuguuugcacagcuagaaagugaagguguaaacagaaaugagggaaugugugguuucuguaguuugcuuccagagaaaaguuguuaacccuuuauaauccagcacauguugccuucuguugucaucugaacuuuauuugucuaucauagauacuccagggcugaaggaaucugcucuaagaauuagaaugaccaauuucacuuaaaggaaaaaauaaaacacgcucucccaauucauuauucugaucauugguuuaagcuuggcuaaaacuacuuuauuuauagaaaucauguuucuaagacuauuaaaaguaauguaaaauuuaaaguaauugcucuauccagcuaaaagcacuuuuacuuaggccaggaaauugauauuacuccuuugugguacauauauacacacacacacacacacacacacacacacacaaugauuuccacuuaguacauaauucuccuggcucuccagugucuccauagugagaggggucucuacugugcauuuacuuaucucucuaaaguagagaugaucuauuucuaguaugaagcauggaggaaacccuaagaaaaacagagauaguucaucuccauugucaauagaaaugaauuuugaaucacccaggagacacaccucugggagugucaaucgaggcauuucuagagauguuuaacugauguaggaagacccuccuugggugucgcuggcaccauuuguggacuguagugacagacaaaauaaauggaaaaauucagaaagcaggaccaguaaccuggucucuguacuuccugacuguggaugcaauaugaccagcugccucaugccucugcuaccauaacagacuauacucucaaaugguuagucaaaauccacucuuucuuccuuccauugcucuuaacagguguguauuagagaaaggagagaaguaacuaguacagaaaauaaaagucuacucuucuacuucaaugaauugcucucaugaggauuuacauuaggcuauuugcccucagaaguaagggaauaaaagguuuguuuuguuuuguuuguuaggugaaaucagaaucugauguuucuuacaacuaguggccuauugcuguuccauguacaugaaaagucauuguaauuguucgaacugucauuaucccuguguccagcauggucucugaauuuauaaauguaauaguuucaucucucugaguuuuucuaugcuacacaggaagagguaagaauaaaaagcacacucacuucggacuugguagucagucccucugucccucuucauaacauugguacuguuuguuaucagcacaaagugccaugagcuuuugcaugcuucuccaugcuucugagaaugcccauaaacauugcuugggacuacaaacacccaugcaugucucuucugagauccuuagaaggaugcgggggggggggggggagguagggggggagggagagacaggcagaggugagccuugaucacaggauuagggagcguugagagaacagacagcagcagacuagaacuaugaaagaccaaaagcagauucacagugaggccuagauuguagguaucugggaagcacuauagcaucaaaaugaagccaaaugggugagggauaugcccacauuuggaaggcgagcauaggauuccauggugccuacccauguccugggggcacugaaagcaaaagacuagaaugcugugcguucugcauacaaacccugccuuauccuuccaugcugagagaaugcagcugcaaacaguccuggaaugcauguguggaguugccacauucuccaacuuuuggaaacuguagcucccagcgacucacccgugaacacagagggucaucuuugcaaacaucuggcaugcauuuaucuccucagagacuuacucagcacucaaauauaucagacuguuuagucucuugaaagacucaacuguucuucagaaacagccuucucagcaagggccauggacucugcagagcgaccagugcuuuuauuugaggucuacagcgaacaccagcuggucuaggcgcuuuacaucauaguuucucucagcacugagacuccaucaucuuaguccuggcaguaauugcaaccaaaaaagugaacacagcucccuccacaccacaccagaugaggucaccacacagugcacucuccaaccugaaucuuaggaaacacucuuuugguccuaacaaugauucuaaagagacugagcagucuguugucacaaacacauguuacucugggauucaugauggcgaaggagguuuaaccuuaaaagcacaucugaucuggaggccuaaagaagggacaugccacaaagacuggaaaaugcuaaacaagaaaauccaccuccccugccuauuugacauugcacagccaaagacugguggagucugagaaagcguauuguuaugcaugcuaaaaacaaaagcaaaaacaaaaaacaaaaaaacaaaaaaaaaaaacaaaaacaaaaacaaagcaaaaacaaaggcagcugaaaggaacaucccagggcuugagaggcacagaacagcaacucuaguucuuuuagucaaaaacuccuacacauuuuuuaaacaauuggagggaccucauccaaggucaaaagacaucaaguuauaguuugugcuacaaauuggcacaugugcccuaaacaggccugagcagacugagagauaagccauuauucccgggaccacagguguccagacccaucugaacugucgcuauagaaggacaguccuccacugcguccucccacucugggcacuucccucugaaguucucucugagguggaaagcuguuuuuucuccugagugacagcucugagcucugcuuucuccuuagacaaauccaaccugacugcagaagaagccacagaccugagguuugaguaccaugugguauguauucucccaggauucgucuacaaagccucugacuucggagugauugcucccaucuggccauccuuucacuuacagccacacagccaggugcguacacauucuccucugagaugugacucaucccuagaaccaggcucugaguucugaaugccucgccuccugauuuauaacagaggaggcuaagcuacuucaguuucccagcaagccugccccuucacacgacuucccacaacccuuaaccccugcccuauacacuuuaccgucuccuggcaccugacagcuggacuucaccuugcaggcugcuuugugggugacuuuuccccaaugaugccuuugaagcaaguuuuuucauuuuaacuaauaagguuagaagcccccaaaugauccaggaguugccucguauaguugauuugugguauggaauuaaaacgaaagcuggcacacuuuuaaaaugugucuuguuuacgagaaagacacugccugcaacuguucacaugguuucaaugaaauacaacagagagguacaucuccaacauaaucauuaaaauaugacuacaugguuagggucuucucuuuauccuauuaauugcaauccauguaacaacagggaucuuguaucuucuggucucugucaccuuguauuuccugcuaagacauccugcuaagacauagugggcacauuaccacuaaagugauugcauuuauuaaaccaaaagaaacuccauuggccaagcaugccuggauguguccaugcguccuguuuuauaagcagccagauguguuuauaaaccccaaaguacaucguggccugguaaauuuaaagguaaaacauauaguaagguccacagaagaggcauccaagaaaauggaaagcacaaggaccagagcccaucacucagaucugcucaucugaugccucccaagcacccugaaauggacugaauuuuuuuuaaaaaaaaauuuaaaaauuuuuuaaaacgucaaggacugcagaauguggggagagugaauaaaugcuuuuuuaaaaaggcacagauaggcuauagagauuuacugagaggagacagaccacuaacagacauuucagaaccugacaauccauuacaggaugugaaaagugcuacagagcucaguucaucucggaugccgaguuuucagagauccacaaaauauacaagcacaaccacuacaucagcaucaggcuucaccugcugacccugacgaagcgcauacccacuaucuccaaauuugcaaccuuaaucugcucucaaauaaaacugucuuugcucuauuucaaccuugucugugaucucuugguuuacagagacucgcgaaauaaguagugagaugguuuccuucuauugacguaggaaauccucucaugugauuuguuuuucagaugauggacagacagacaaguguagguauauaugacugugugccuguguuuacaagaggaaaaauggagaaacaaaaaaacagagauaaagagauggaguccaaaagaaacagaaauuuacacuuuucaaguuaucuaaacgcucuauacccucauuacucaacaaacagggagacaggaagccuagaauaagagauaagagcuuuagaggguuucacaguugcaacaccacugacaugcugagcugggcagcucuguuucacuucccacucccaggacuggauauugagcucaggauucacucauacuaaacagguauuauacuacugagaaauagccucucuuucuacuuuucuuuauuuuuuuuuucuuacuuuugugacagggucucaauaaauugcccaggcuaucuuugaaccagccauauuacugccugugccuacccaguagcugggagccagguaguaguugccuggagaaaggugucuucauaucaugggacacugaauaguaaguacuccugcauucaaaagaugccagcacccuuccuccuaacuggagaagucagcuguagaaauugccaaaagccucucaggcaucagaacuggcccugauugagagguguuacauugaagcauccaagaaaaauauucuggaaaaugaauuauuaaguaaacauuuacaggagcaacauauuuuaaaaaucauguaggugcgaacucaucacugaaacagaaugggcaaaauucgaagcagaaaccugagccaaacguguuauauaacacccgggaaggcucuuccuucuaccacagcucaaacaucugcucuuucagcaccaugugcuaacugacucaggagcugacaugaaaucagaggcagugaaagaugacgccggcggguggcucuucugaaccaagccuucuaaaacuacuaaaaauaccaucgccugaacuaucagcaugaaauguacuuucugaucucacauuguuaaaaacugaucucacagaaguagggaagaggggggggggggggaaaggcaacaccagaugaggaagggaugggagcucagagaggcagaaaagaaagcaguggacauaagucaguggggagguuggaggaagaauaguuugguagacaugugcuaaguuuugguuagacaagagaaaugaaugcagucuuguacuacauagcuguaggacucuggauaacaaugacauauacuucaagaaagcuaggagaauggaaugaauuuuuuaccaccaaggagauacagguaaauggcaagacccaugcgcacccucugacaggacguuacccaauguucauugucaaaacaucaguugcaccccauaaauaggugcaacuuuggcacgccaauugaaacugagugaguaaaacaaagaaaaauccauuugcuaaauuauuuucuaauugcauguaugcuaaacacaacacaucaagaugaauggcaaagcugaguguggaagcacacagcuacagauaggcaaaggggaacugagucugagcccagcuuaagcuacuggacaaaaccaagcucaaaaaaagaaaacaaaacaaaacaaaaaaaacaaacaaacaaacaaaaauaagauaauuaaaauagugggaaacacugucuacuccacggugaagucagaaagcucugugcagugucccagaagagcucaagcagacaugaagccccuuggcuucuuugggagcaggccagcaggccaaauuucccagacaagaagagaacagaccaaacuauuuaaagagcacaauuaugcaugccaaaguggcacuguucaguaacacccaugauaaaugacuuuuuccuaggaaguacaccggcccaggaaagcaaaaggauaccugaaccaagauugcaauacaaacucugucagucuuaaaacaccuuuggaugaucauuucuaagguggucauucuuuugauaguaaggaauuuucaaaaaccacaccgguccuuggucuccacaggcacuuagccaggacaucacuuggauacccaaaucuguaagauuuaaguucaccugcacaccuccuccuaacuuccguuuugcuuuguuuuguuuuugaccccugaccuguggaagcauuuacagguaaacuagaaaccuuucucuguuucccacuucucucccucccuggccccaacaccucucuugcauuuuggugugaguuguggugugacucauggcuuuauauuuguagaccauuacaugcaucugaugucuccgggaggaacucuagaaacaucugggcauggugguguuuccuaguuuccuuuauuguggggugaguacaagacuauuuuccuuaacuacauuuaaacauucaaaccauuugauacucauuuuuaugcuaaaacuugagugagggucuauauuccuuuucuugcugugaccaaauaucugagaagaacagcuaaaggaaggaggguuguguuuuguuuuguuuuuaaauccgugauuucaaaaggauauggcuaccaugguggagaaaggaucugaagugugagaugugugaaguggcaagccacaucauguccacagucugggugccaagggauggaaaacagaauguggggcugaaguaucaccauucagggucugucugucccacuaguagcccacuuucuccagugaggagaaaaccuuguaaagguuccaaaagagcaccauuagcugacaaccaggucuuuaaacauacaaaccuacugagugcauuucauauucaaaccacaacaguguccagcacacuguuccuggccagccaguucuuuuaacucuaguuauaaaaccaucuuuucacccagugaauggaaaugccccucuguucuguauagaauuguuggcuuugucuacuguauucuaauagucuaucucuccucucuccucccucuccucucucuuccucucuccuccuccuccuccuccucucucuucucuuucuuucuguucucuuucucucucucuuccucucucucucucucuuccucucucucucucucucucccucuauugcuauguuuuuucaugucaacaucauacuugucugaccaaaagauaucuaaucaauucuaccauucccugggaauagggaagaauuuucaggcaaacugacugagggauccccuuccucuggguaaaagaauucucaagacagugcccuugagacucagagcaugugaugggugagcuucuacauugcuugcuuuggaauauuugggagucacccugauuucaauaucuggugcaaaaauuguuccuugucuuuuaaacaucuugguaauacaaccuuccaggugggaccaaacaguguacauauaggcuuguugcuguuccucccuaaaugcauuccuuccagucuaucuaacccaacccacaccacucuggguguuaccuucuccccacaaucaggaaucagacauuauaaaagcaaacucuuucccacaacaacaaaaagcuuucuaaaaaugucaccagagcaacuuuucccaguaacauacuuauugcaaauguccuaagucaugacaagcuguacacuuaucaucacucaaggucuauaaagaaacacugcuacgucgugauggaugcagacacuugaguagaaggguuguuacauaugaauugaaugugcuacugauaugcaauucuuucugaucccacuugugaaguaacaagacaucucuguaaauaccuauguagggccaaggaagaugauauauggucuuacucuuguucacuucuuaaaauauacuuuguaguugacuggggaaggggcugaauauaguugggaugggggauguaauuuccucaggguacacagcauccuaaguuugauccccaauacuguaagaaacaaaugcaauuuggagggcuuggggagggggguauuguuguugcuuagguuuuguuugauugauugauuguuuguuuguuuguuuguuuguuuguuuguuuguuuuuaaauauaagucuucugaguccuugugcagcuuccagugacuuggaacugaccagggcagugagggaguagagacccccagacagacagaaaagcugguauugucuugacuguguucccugcuggacaaacaacagcacccuacacacuugguguguuuguuauauagaguugaacaagggagucagggcuauugugcacagcagaacaagaagguagaguuauuacauaaaggagaaacaaagaagccagauuaguaaauacaggaggauggaggaggcuggguuauuacaugaagguagaucacaaaaagaggguuauuauccgcagaaaaacaaggaggcagaguuguuauacacagcuggauaaagaagguagguuuagcuagucucaggaggagcagucucuguggaggaacagcuugcauucuauaaacaucccagagggaaaagcuaugguggacauauucugcacgcaauacccacacauggacaagaagggacagcauugucauuguccucugcgucucacugccagaaaaauagguauugccauguccuccaugagugugaggcugagauccuggacauggcuauacccaugucaacaacacacacugccuuccuccucuccuuacauaguagaguccaacacuggaacuguuccacuuaucucucaguaaugucuuuaguccuuucugucaaaagcgccuucaccacuuccccuucuaggugcucacugcccuccacauuuuugugaauauucuuaugaggcuugucuucacuagguucuauugucugacuccauacucuccugaagcagccaggugcccuaugccauguuacccuucuugcuuaucaggcucaggcacugucugcuuucugacaugaugccagcuucuuucccaaggcaagcugaaguggugucccaagaauagacaacuacagcuuccuguagguccuucuggcagacucugccaugaaagcaaggagaaucaggccaggguggguuagguagcacccuugcuuguaccuuucaaagaauuggucccccuaaucucugcaggcucugcuccucaggucugaaaguaggguuccccugugcaugcuuauccuacaaucaagaaaugugacuaaugcugcccacaaaccuguaugaagucaaggucuuucccagaagccuggacacauggcaccccuguaugcaguagaagaacaguuaguccaaaccaccauuuccccaauggcccuguuuccuccacaucagaacuauauguuaaaggacuugauaacaagagccuuuccucccuucugccuuaugagaagacugacagccagaaaggcaaaugagcuuucuuacacacaaagaggagcagccugcauucaugauggaggugcuuccugaggcuugcuggagucccucacugagagcaccccuccaacccaccccaaccaacgccauucuaggugcuaccuucucuccacaaugcagaauuaaacauccuaaaaagcaaccucuuuuagacagaaaaaaaaaaaaaagcuuucauuucuaaaaaugccaccagagcaauaucuccugguaauauauuuacagcaaauguccuaaaucauggcagccuacacaauuaugaucacuaugggaucguaaauaaacacagcaugucuuggugaaugaagacacuggaguagaagcguuguuacauaugaaauuuaaaagugcuacuaggaugcaauuccuugugaugccacuuguggagugacaagacaccucugugauuuaagcuuggaguucaccucccagcuuuauucaguaaaguaagagagguggcagcacagagagaaaaugcucucaucaauuauacgcagagaauaagcaauggcacuagaguucacagcaaacuuuguuucccucgcugcugguggccacacucuaaaacuggaggccaugagcagagacccccccccccccaagauaacuacauuguccuuauuguguuccugugagcaagugauagccucccuccaaggaugaagauacugagaggcaaaggaggguaauacaacacccagcugcaagucauugacagcccccaaauaaguuaacucccaucuucuaauuuuagguugucugacuggaaagaaugcugagaaaugcaugaugcuaagcugcuguucuugccuauaacuuugaaaaacuacauuucccuuuccuuagagaaaguaagugcuuuggaaguggcuggggcaugcaaagacaagccagauguggcgguacccaccuguaauuguaacucucaagaaccugaggaugaaggaugaguucaaagccauccaucacaaaugguaucucauagaucuagcugugacccugugugcauccccagcuaugacuggaaccuggagagcuccacagugggacuaugguacuuuuagacuuacacagaugccuugaagaugagucucuagggaggacuaucauccuccaugggcacugugggacauagccuguacuaauggaucaaucuacaggugacccucacaguuagaaaggcauuagcagguggcaaugccacacacauccuggacagguguguucuaacugaacacugucuguuuccucugggacugacuggccagguauagggacaauuuguggcuggagaaggugguagcagcaugaguuccuacuggucagauuuucuucuucuugcauuuugagaaauaauucuuccauuuuuuauguuuuagauuuugaaaugauuaauaacugucaaaauacauguauggguacaaugugacauuuugauauauaugcacagugcagugaucaagacaagcuauugaacauaucaaucaucacauaccuuuguguguuuauagagggggacaguuaaaaucaacucagcaaucuugaaauagauauuaaguauaguuaccagccaugcugugcaacagauaaccaaacauucaugcaaugucuuaaaccuuggauacuuuaaacaauagcuauauauucucuaauuuuuaaucacauuuauuuugugugugugagugugugugugugugugugugugagagagagagagagagaaggagagagagagagagagagagagagagagagagagagagagagagagagagagcuugcaauggagcugaacuacagucugcagucuugcagacaagcaccuauagccuccuguacuggcuaguguugugucaacuugacacagcuggaguuaucacagagaaaggagcuucaguugaggaaaugccuccaugagauacaacuguaaggcauuuucucaauuagugaugaagggggaaaggccccuuguggguggugccaucucugggaugguagucuuggguucuauacgagagcaggcugagcaagccaggggaagcaagccaguaaagagcaucccuccauggccucugcaucagcuccugcuuccugaccugcuugaguuccaguccugacuucuuucagugaugaacagcaauguagaaauguaagcuaaauaaacccuuuccuccccaacugcuucuuggucaugauguuugugcaggaauagaaacccugacuaagauaccucuggaccaucuugauaguaccaaggcuagguauucucccuccuaccuccagccccuggccacccuacucugucugucccuguguagguuuuuuguuguuguuguuguuguuguuguuccacauccauacuaagcaccuuaaccagaacaugggaaagcuuuugugugucuccacaauucuacaagaggaagauuuuuuaaucaggauucaugugacauguuguagucaaagcaaaaguauguugagaacauugcacaaaauuaccuuuaugcacuuggggcauacaaaauaaauaaaugacaaugacauuccugcuuagacuugugcccuagcccaagacaauucauuguguguacauaaacauccaagucuggaaaacaaauaugaaaaauguuggucgagaagggauccucaccagucgagauaagcaguguuuguccauagcuagauuauuucacauauguccucuagauucuucuguauuacagcacacugucauguuuugggguuuuguuguuguuguuguuguuguuguuguugcuguuguuucagaaaaagauucacaaaauacaaggcucuggacuccuugugccacuggucaggauuggagaagcccuuauuagcccugugugugugagggcaggggggaguuguuacaggcucuagacccccacacaccuuucaaugauuauguucaccucaccucacgucccuccuucccuucucucccacuuugcaaguuuauacuguuauuuuuuuuaauuuagauuacuauuuuaaagacucucucacagacuugagauaucuucaguauagucuagcaccugacccuucagcacuggacaaguggaagugggaccuuaggcucuacagugccuagggcagauaaccccaagaaaguuccucugcguaaguacuuggcacccauaacaaucagcgacugucuucucaugcgaaaugggaaccuaaagauaccuugucugaacugcacagcaccgucaaccaucacuuucacccugagcauggguucuaugucuaggucacacucuaugacaucugucaaaccagaaagaucacccucugcuacaucagguuucuaugacgaaugagaugacacauugcugugguauacuugaccuuuguaaaaaugcaaccccuauaaagucuguuggaccacaaacuugggaagcuagacucuuaacagggcaagggaaggccccucaaauggcugccuuccucuucuugucacugauaacaaauaaccuguuggcacagcuugucuaugccacccacaguggguacacuuggccacaacaauccugccuacuggaaaaaaaaugaaccccaaagccaacaaaauauucugaucucccuggggcagaauguacauuggaaguaccuggaacaaugugucccuccugcuucagggcccgaaucccaggaaaggccacacccagaucaaucccauguccuccuguguagagaggggcagcacauacugucagcacucuucuaccuuuggccagaagucuggagggucucccaggacccuuaaagauagcuguauagaucaucuguuauagaaaaaaggcccauaugaaugacauaucauggaaagacacaaauaucaaaagguaugggagcgucaagguaucagauguccuuccacagccagucuggacaguuuacagaaugaccagggcacaccagaacaaaggggagcuucaagucaccagcagaaaaaggggccccuuuuacugccugugaagugcuagauugcaaucuggcacgacagcuuccagguuccuauggccagagaacacagcaaucuggggacacacagcccagccuccaggacauccugacaguuugccaaauccccucucucagaucugacacguccccucagaucuacaagccagaaagaauaaucccaccuaaagaucccauuuguaccugcagguuuccucugcuucaccugaagugguucccuccguuacugauggagggcugagcaugucuuagguagccagcaacuugagaugaaccacaaaaguuaaaaaaagaaaaaaacaacuuuuguuuaaagcaagaaccaaacaaaacacucaacuaaguggcaucaacacacucuggaaagaaauaaaagaaaaaucccugagaauacauggcccaggaagagcagugugagugggugugacccagaucaacuggaaggguggauucacaaacaaacucuaaggucuagaccauagcgccacaccuucuggccaucucccaacagguaagccaaccacagagaguucagcagcagaccacguucagggccugaugcucagccaugcugcucagaauccagacaguuuugccuguuuacccgacaaggcauccuauccacuuauagaaguuuaaugcagugcuuccguaaauauuugcauugagaaaucuuuaagccaaaacacuuaaucaauacauccaucgccuccaauccuuuuuagaguuuuuguuuguuuuugucuagguuuuuuuuauugcuguuguuguuguuguuuuguuuuguuuuguuuuuuuuuaaacuuguuaguaagacacugagcucccuggggccuggguagagcagaugaaaacacugucacagugaaaaaaaaaaaaagcaaagggcaauauaaggugcaacaauuauauuacuguguaaaauuuuuuaauagaaaaauguuuaaauguaugcaaaauaacacugacaaagaaaacacugaaagaaccucaguguaguuucaguggguccugggcuccgauaaacuucucaggccuuugaagcccuggacacaugagaucuuucucuguuuacucaaacuucuaacaacuucacgcccagacaacucuucguccccucagggccucagucucucugucucucuuucucucugucucucugucucucugucucucucucucucucucucucucucucugucucucucucucucuucauucucuucccccuccuucuuccuucucucuccacuucuccaacuuacuauauuaauaguggagugugcuaugaugugauauaugugugccauguagaauggaaggaucgagcuaauuagcauaucuaucaccuuaacagcaauaauggauucuuucucucuaacaauuuuauccaucagcucuaacucugucagcccucagcuucuguuaaccuuccuacaacucccugcugcuauaagcuccacuguuuuagauuccacaugcacaugagauuauacaagcaggaaguuguauuucugcaucugcauuauuuugcuuagcgcacacuccucuggguucauccuugccuguugcugcaaaaaaacaggaucuuauuaagugaaauaacauuacaucauggcuaucuagcacauauucuucaccuacucaugugcugagggcugacuccacaccucgguucuugucaguggugcccuaauaacaaggcgcuacagauaucucuuccauacgcugacuuccaugguuugaauucacagcccaaagugggaugacugggucauauaauucuauuuuaucuuaauuguuuuuuuuaacugacaggagacauauuugugcauucuuaauaggcaugucuuccucuuacuuaggccauuuugcucuuuccagaauuaucccaguacuagagcaugcuauaaauaaccagagagagaucacuggaagccuuuaaggaauggccaugguguucuuuagaacuaauuuguguuaccaccaagagugugugcaaauucuacacgcacaguuggaccuaaggucacagaaguugugcuuacaaaugagagcauuccugaaaucacuugaauaaguaauggcuaagugaguuauuggugcuccccaacugugcauacacagugaccuuggacuugaguagucugcucugggugaaaggaaaugaaaggaaacuuguuccaauugaaauaacuaaccuuaaaagagagaaccguuaggugccuccagggagacaggcguucaugcagagucuucauaaaaguaugcauucauuuacacugugcccuguacauuauggaauuuaaugcacaccucuaaugagcaggccauucagaaaacagcaacccaugccccgggugagccaacugcaaagcaggaaccagaguacacagggguuauuucucuacuuaaacccuggcaugagaagucaugagcugcacagcccacugggucuuggacuaagcauccucaagugcaaaacagguaaggaggauaguacagugugugcaucacagguaguauggcugguauauauauugugugacauauagaaguuugugagucuccaagacacacaaaagcacucugcacaggcccacucuugcucaacucccaggaaguaauaccaacagcugagcuccuauuuaucaaaccuaaauuuacucgugguguuccuuguacagucugguggagaagaacugcuucuucagaaagcacacauuucuguucuucgcagauccuagaggucacugcaucuacucuggccuguucucccugcaccccacguaauagggaaacagugguaucauagcucaccagagaaaagccccaauacuuauuucugagcccaacuuuguuggcuaaugaaaagcacaaaaaucaauccagguuauuaaguagcugguugccagcacugggcaggaggcuggacacuuccugguacuccaaagccaaaggucucaucagcauucuuaugaacaaagaagacauguguuccacaugacuggguucaacaagguucaacagaaaacacaaaacuguuguuguucauuggguaagcuugcuaaaacuacuuuccuguauuaaguuaguaagaugcugcuuaagccagaauuacuugggaccucuccaucuggauacguuccuucuuggagaacagaacagaaacugcaaaaaugcacuguggaaauagcauagccuaucauccagggcucucggggcuacaucaugcuacagggagaaugccacugaguugugcacccugagcugaagcuugaaucccuggaggagcucuucuguaucucccacuggccuuucuugaugcuauaccagauuuugacaacccuaguagguaauucuuucaaauguacugucuacaguucucuaggaaagaaucccaacagaugagcaaauuuaagaucccagaaaggaauuggaggcccacgcaaggguuucuuucucugugugucucucucugucucucugugugugucucucugggucugucucugugucucuaugucugugucugucucugucucucucccucucauuuucuacagaacaccucuguucuaaugugcaccccaucuucgaaaccagcagcagugccaggucccuccuugagcuggcaucucacugucuuucucuucaguguuuuaagaaugauugcgaucacacuguccuauccacauuauccaaaacaaccucccuacagaugguuaucacauuaacgccuuccuucgcucugccaugcaaaccaauagacucgcaucuucuaaagaucuggucgugcacaucuugaaggucacugugccuaaaaugaaccauuagcagaacuuaccuauaucuauacuguacacuuugaggagacguggcugaugccugcuggagggcacuguguuaaugcaguuucccaggacccaacuuuaaccugauauuacaccauauugcauuagcuauugcuauaagucuuccaggaauaauuuaauauacacauaugaaacuucagcauguagauuuggguaccuaaaguugaaaucaggggcccugaaacaaacccuacagauacugagaaacaucggccuuaaaagaaaaacacugacuccaagcuuaaaaauugaaggccaaauaagaucaaauucauuaauaugugaagauuauuggacauuucacaguaugcuccauucgaacaaggaccuacauucacuuuaaaaagagagagaagggacacacucauagugugaccgcucauaucuacaaucccagcacucaggagcugaggaagguaggucuugcacuuaagauuagucugagcuacauugcaaguucuagacccaccuggacuacauaauggaacaaaguccagaaaaaacuaggaaagcaaaagguaggaggagccaggcagugguggcgcaugccuuuaaucccagcacuuuggaggcagaagcaggaggauuucugaguucaaggccagcuuggucuacaaagugagauccaggucagccagggcuacacaaagaaacccugucucaaaaaacaaaaaaaaaaaaaaaagcuagaagagcaucccuguaaucucuacaaucucccuagauuuuggggagaugagaacuuggaacuagaagcaaugaacauuuuccaaaacaguuuccccaaucaacuuaucauaaucguaagaagaagccccugauacaaacagcauacagaagacacugccccaugguggaacauuauuaaauuuuuuaaaggaaaagaacauguagaguaaguauaacaucuuacucucacauaugacaaacacaucaguggucugagaagauguuccuucuaaucgagcuuuguccccaugaacaauaaucacagcucuuaauucugcaaaugacaguaacaggaagccuuccugcauauuaaaaguguucuccaguccuaaggcccauucucauguggccuuugcuuacaucacuguggcagacagcuuaagcgauugcuucagcacaacccacagcuguccuccaguugagcucaguucccaggugggaagacaguccacauacgugaccacuacaugcuauuacaucaccgcucucacccacuagguuaccagccagaaucucuacuccaguuacaugacaaauacugugccacuuugagggaaauuugcagaacuuccugaauguagaaggcugagcuucaccucaguacucaagucacaacagacuuucccaggcuuagaaaggauccccaacauaacugugaggacaugaaacucuccaguuggacaguaaaacacaguaggaauaagagaccauaaggcucuagguaggcagccuugggaagggggcucuggauggcuacaguuuccucuauacucugcagucgcuuccaggcugcuugguggaugguguggacagagaagaauaagaaaaagucaauguaaggagggaaaggguccagaagauaccagguggaaaagagccagagagaugggccugggagagagcucgugccuaggaggugaugcuucagagagauuuggugggggucggggaauggaaagcaugcuuuuuguucuuauuuuccucaggaaugcauuuccuuuuaaaaaccaaagaaaaaacucacacgacgugucaaagauuaacugacgaaacccaugcacuucaucagaaaguugcugugagcuuuuaagaaugaacauguaggacauuuauacaagaaugacuuuuccuuuuuugugugucugugcaauaaagcccauuuaaaguaauacauaaauuauauuugugcuuuaacugcuucauuuuuauuucauuuucauuuucuacuggggaaaacuccagaguccuucucauuccauaugugcaguuugugccugagaguagguuucccagcaaggaaagcuggccaggaggggccuccauaccacacuccuucuguaauccuaggaaugacaccauguaacuaaagaaggcuuccugccaaagaccccaaauauaggaccaaugagauacagaaagaaaagagaagaaagaagaaagaaaaaaugaaaaaccagauggcccccuuuccugugggauuuccucucaguuucaccucugcacuacagccacccaggugauaauaacagggcugaucauccaaaggggaaguugagcuucuccaccaaggcaagcugucuugugauugcccacgcuggggaauacaaacacuucagucaagacaagccugacaaacugucugagcagaagaaauuaaucccaagguuguuucuuccuuuuuuauaacacccaaaagaguggcauuuauuuuggggacuugccuuaaaagucagcauuauccaaagggacuguaacaaagucacaauuuggcagagugcuuagcaucugccuggcccucaguucaagucccaaggcacacaaauagaaaaauccgaucauaagaugagagaacacugcugagcguucccuuaucauccucuacagugcacagcaaugugagggaagaaaugguaacagaaggaaaggaauccucaaagaucuuccacaccccaaaccuuucugugugaucugcugccagauaauccaaaaaccuggauccuagucacuucauagugcagcuguuugcuauaauaggcaauggaguugcugcggauagguaccacagcagaaguccccaagcucagagaagcuuccuaccaccaccgccaccacccacaaaggaacuggagguggcugcaaugcucagccuauacacugcauccagucugaggccaggcaugguccgaugcuuuuaccugucucuuacgucauuuuuuacaucugagauauucuaggaaaugauuuuuguguacuugcuuucaaaacauagugaugccuguaggggucuggauacacugacuguucugaaaacgcuaaaaguucuccuugauggauggcuggcaaaagcaagccguagccaaacaaaccucaaaucguggguccaauaggguuuuccucgucacugccuuuaauagccacaaaaucuuugggauguguucguaccaaaugguacacacagaguaagcaguuccaaccacaggaacagacaagggaugacgucauucugaaucuaugaaaguccagugguaagcaucgaagugagggagaggagagugugggaaaacacaguaaauuccaugagugcuaaauggcagucacucugcauccucccugcuaccuacagcaucacuauucauggcaggcagugcaggagugguacccagaccucugacacuaacaagcccaguaagcugugcuuucaaaccugguuuuaauacguuuuauuuauuuauauggggagaggggcauggaugugccacaaugugcauguaaaggucaauacaaacugcaggaguaaacucuccccuuccacgguaucccaagggucacauucuggucaucagguguacugacaagaaccuugacacacugagccccaaccuggaccuguuaaaagggucuggaauuguaucaucaggcagaacucacagucuuccauccugccuagaggaagucauggcaagaauuucugucaugguauuuauuaaagcacauaaauacuuguaaguuaucuuuacaacaauaggcucaugccaaccauaacucacugagaagcagacaagcucaaggauguacccuguccaaauccagaagacucuccuagguggaauggggacauuauaggguaucauagccuguaaaacauacaggaaccucugagacagaagcaaucuuuucuuacagacuggaacuugccaccaagaauaaagaauuccucacagcaaaacacacagcuggaaacaaggagaugauggaacuaagaaagaacucugagguaaagaccaaggaaagauauaagggagcaucaugaggcaugcugagagagcucuaggacccgccaguauggagacuccacacuucagugacuccucagguuuuucacaguagcucccucugacccagcagaaaauaagcaucccuuggagauggugcauaugcuacuguuuuuacuuauuuccuuauuuagagccaaucucacuaccuagcccuggcuggccuaggacuucugcuauuuuuaguguuuguggcaggaugauagguagaaaguaaugugaaaacuuacaagaaaggagauuuuaaaagcuuuugugagaugacuggaagacaccaucagugccugcuaugcuugaaccagcaucccaacaaugcccacaacagcccagccuaacccaccuggccuccuaaggcuuccauggccccacccgucaagccaggcuggaccucauuaauguaaguacuaagacagaacagaaugcccuagugccagaggaaaacagacaugcuaccagaaguuguaggcagggugagugcuauagcccuguuagauacacagacucaaaugagaugcuacagacucagucaacgcuugcucucauagccuaauucaacaccuauucccucugaaacggaucuaaucauaauuaggaagaaaauccauucacagucauaccuaguugugaacucugugaacucuaauaaugaccagcauggcaagcuauaucuauggguauaagaguggcagccgggcaugguggcgcacacguuuaaucccagcacuugggaggcagaggcaggcggauuucagaguucgaggccagucuggucuacagagugaguuccaggacagccaagacuacacagagaaacccugucucgaaaaaccaaauaaauaaauaaauaaauaaauaaauaaauaaauaaauaaauagaagaguggaauguacauuuuggggguuaaaucuucuuccuuauuaaauuuaaagcccacaccacaagaaggaaacacauaccuaaguacugaaaaucugaccaauaccacaugcuuuuagagcucauagguccagggaugauccuauuacuauuauuuagguaaauggaccuaguauuaaacuguucccugaaucauaucccuccagcuacagauucgugcacucucagacuucaucagcaaaguuuguugaugcugucaauagugguuaacccagaaacuuaggacuguucuaagugaagagugccaggggagagcuuggccaaguuggugaaucucaaucacacuuucaucucuaagacuuaaagaccaucaugcaagaggaagcagaaagaguguuaagagccggggucuggggaggaccagaacgaaagugucuucuggauaugauaagaccacuauacucauuaauucacagcaucagugguugccugcauaagaccugcaaaagaucaagccagucaacauuuuagcaugaaauaaaaacagguucugugaguucccaccccuggcuggggagcuaugguuaucuaaugguuuuauuccauuccauagauaguuuuauuuauuuaucaaucucaauggauagucuuacacacacacacacacacacacacacacagauuuaaauaaaugcaauauggacuuauuuaaagaggaccgcaaguugaggggauagcauagagagauuggauggauuaggaagaagaaauggggaagaguuggaaugaaucugaucaaaauacaucauaugaaauaauaaaauauucaauaaaauacuuuauauguacacacacacacacacacacacacacggcagagugaauguuuccuaagauuaaaacuggaaacugugggcugggcuuggcuccuagcugaaagguaggaguuaaaaccacaaucauuuuucagguuaaugucuuuuuuuuuuuucacugcucucuuaguuucugaguauuggcuggcaaagaccacgguauccaucacacucaaaacaacaaagcaggaaacaggaaccggcccgaagcuucuugccugccacagagagccucuguaguuucauaucgugcucuguacacgggacaaagcuguuuguuucugcuuuguaauaugcagugcuguguucuacugcugaacaaucacucuaaggaaauauuacuauaaaaauaaauacauuucucuuuucauucaaagcggaggaagauaggcagggcgccgugagcacacccacaagccuuccccuagaacacuuuacauuuguuccuaagucucuaagaauguuuugcugauaguaucuaagucuuaauuuaucuacaaucaaccugauucaaguacagaggaaaaaaauacucauuuugcuccguuuuugguuuggauuuuguggggggaggaggggagcagguugccuuuauuuuucuuucaacucaugggaacacacuauuuauaguauuauuuucucuuggcagucaaauacauuauuaaccucugaacuggauauuuuuuaagaaaaaaaaaacaaaguauaauucucuuauuuuugacaggaucuacuccaacuccuuccuagcagaagaugaccuuggcagacacacacccacuuccacuucagagugcugguauuacugguaugugcuaccaauguccuugguuuuaugcgaugcuggggacugaagcuagggguucaugcauguugcaaguacucuaaaaaguggucaagagccccaacuccauauaaauuauuuugcagcaaugaccacaccucacuucugacaaagacgccauuacagcccaugaucuacccaccuacaacaaacaagugacacauuuuuaacuuguguuuuacacguuaaaugauagaaacauagauaaugauucuacuguaaggccaaaagcaugucauuuucaugucagcccauuuccuuuccuguagucuucuggaauaagacaaggagcauggcaguacccuggucucaaacucagcaaccauagagcuuaggguauagagggagcaagggagcaagaaguugcagagugaagcccuagaaaguacccucuuggggucuucagaggguuccaccggagcuuuggccaagucuuaaugaggaaagagaggagcaggagucagagaugcugaguugagcaucuccacaacaguucuaguucucaccagccaggagagauaaaucagacauuucagaggccaacaggugaacugguagauacuaucucagucguugggaaaaguaagcccaggagaaagggcugcuuggaucccaccuaggcaaagugcaaaggaggccuccagagaaacaaacagaguaugcuagcugauucuaaaaccccuugggagucuacagccauaccacccugaauguacccaggcucaucuaaaaaccacucaggaaucugucuauacuggagcauaaaugaccacaauucaguaaggcacagugcaccaugggagccucuaaccaaaagguguuaggcaggcaugcaaaaaaaaaaaaaaaaaaaaaaaaaaaagaggcaggaaauuguacacacuacagaggguaagaaucuaugagagaaagauacagaaaugucacagaugguagaaaugaccugacagggguguugggcagcugauguguccacaugucugaaaugucagaagaaaaauucaagcacguucagacaugcauagaaugcauuuuuaaaaauacuuuuaaggaugugaacuaacuguguagauuuaaaaaucuauaaagauaaaucagauuaaccgauuauaagaacagaggggggagagagagagagagagagagagauccugaaacugaggaagcaacgugagugacaugaaaaucaaaaagagcaagaacaguaagcugaugcaguuguaaacagaaaccaggcuggggcuaaagaaauaauuuucaaaaauuuccaaauaugaugaaaaacuacagccacaaauuaaaaauguuccaugaauuccaaaguggggaagggguaggggaggggaggggugcuagacccaggcucacaaaacugcugaaaauuccacaacuagauuguaaacauacaaauaaguaaugauguucaaggagggagagagaaagacaauuaccaaaccuccuaacaaacaaugaagcaaaaggagacugaaaaaaaaaaaaaaaacuuaaugaaaaaaaaaaaagaaagaugaauccuauaacuuucuacauuaaaaauguauguucaaaaugagagaaagauaaagacauuucuaaacuuauuuaaaaaauggacauaacuuauuaagggcaaacuggcaagauggacaauuaaaguuaguccuuuucagcaggauuaaaccagucugcaagaaucugcaagggugccagggaacagaggguaccagacuggagauggugccaucuaccuaguuucucugaaaauggcugcugaucaacaccaugagucauggauccaaacccaguugucuuucaucaucacugucugagguaagugggacucugugaaguaucuauuuccuugugaucccuagagaugcugaguuguaaaacuggcuugacgggagucaguuucuucaaacaagcuauugcacacugcuuuuggcacuauauucuuucuaguuugggaagucauuuugugucuacgacaaggugaaaagaacuaguuuuaauuucccagacgagggcaaggacacaauaaagauggagccugcuguaucacaugguacuaugaagucugucagagucugggauuguuuuugaaaauagaugacaacaugugcaaauauuuguauuucuuuuguauguacacaaugugccuuagaaacuggaaauauccaucugguuugugaacaauaagguuguaagaaaguucucuucagggaccagaauguccuuuuaaagaaaaugaugcuacaacugaguuccagauaguuuaguucugcauaccugaacagaauacccuccacucccuauacccaagucacaaagcagagguuuaauuccaugaaacccaauuauccaguacaaacaucaaggccagagauagauguccaccacacaguaauggucagcuuuaggauucugacuagaggagauuagcagcacccuaaaugauuaccaugacuuccaaccaaagaucaaggaacugugugcaagggcuuuauaccacagacagggcauucacauguuccagaguccacauggauucucuuuguauauguacacagccuucucaugccacacaagagagaauguagcacaaguuucugagucuaccacuccugagaccccauacaaggucuaucauauggggcacuggggcacuaugauaagcagucaacaagcccaaaguccucuaaaaauggcuaucaaaaacauacuuaugaaaaucuccaugucuaauuuguugggaaacucagccaauacugcaacuacaauaggcccaucucccagagugaacugucuuuuucggacacacagagccaaggccccuguuccacaagcuaaacucucaaaguuucauacacacacacacacacacacacacacacacacacacacaccuguccugggcccucacaacacuuagaaccucccaucaauucaaaacuuuccugugacaugagugaccagucaguaagagggaacacuuuggauugaggguguggcucaguaguaaaagugcuuguguggcaugccccaggaacagggauuuaaauauaucagcgucaucaaaggcaaaguaaaugcccaaaacauuggauuacuucuacugguuauaauaggaacacaugcuaaggacuuugaauguauuuuugaaaaagaaaagaaaacaagaguuuaaaaugacugcauauaugaaaaauggcuuuccuagugaaaauaaaaaugucagacauguuaaacagcagacuucuuucacuugcuagccauuuagggaaaauagcuacuggcagccucccucccgcugauacauuuuguuuuaaauggaguaauacuguuuugcuuuaauuaacucauauuaguucugacuuuugugagcacauggaaauguuaccuuuccgauucgaguuggaggauccaagacuuaauuuagaagcauguauuauacaaaaguuuuaagaaaggagaaaaauuacaucauaaaaauauguucguagcagagaaacuaaacuagcuuuaaauuuuaauuuauagggcagccagaaaaauuaacucaaggaaugccuacuugauucuuuacuagcaagaguauuuaaauuuuaggguuugaaauauuuguaguugcugagaauuuggcgagcaaaaaaaucaugaaugaaauaagacucauucugcuuucugacauugcuuaaaaaaaaaaaaagacgaaaaauacugaaaccuacauaaagucaaugccuuugacuuucccuuccaauauagccuaaagaucaaacugggcuacauauaaagcaaaaauucacauuucuguuaaugauuaauucuagggcaaaaaaaaaaaaaaagaaaguuuaaaacuuguguaauuuuuguuuuuuauuugccauuuucaaaauccugcaaauccauuaguaguaccuuugaaaaaauaaaggcuaaccucugucucaguugcucuuccugucccaacagucagggugcagauuugaaacaguacagauugucuuacaagaaauuaaugagaggaaaaaaguaaugauugucuuacuuuuaaaacaacauuaaguguuuuaauuauuuuuugcaggguuaggaaccgaacccaaaaccuccuauguauuuguuagguccucuguaauugagcuacaacacagaacccucgcugaucucugagcugugcccuauacacaaagucaacugaucgugaagccuucuccucacuaggggaaaaugaaccccaaacgcucaauuugagaaugaagguugaauuccugcugcuguucauguugcagaccacugaaaauaagugccucuggcuuagaauuuguuaauagaauuugauaaaaagacaaaaaguaaaagacaaaaaguuuucugauugaaauuuguaacucauuucaucuaugcaauccuauguaccuauaaucaaauguuccucuauucuuuucuaagcaugcaaaucuguacacaauuggaaaguaagucaacauuacucaauauagacauguaaugaaggcuuacaugauaccacauguguagguacaccaaucaaauuuaaauucaccgggcggugguggugcacaccuuuaaucccagcacuugggaggcagaggcaggcagauuucugaguucgaggccagccuggucuacagagugaguuccaggacagccaggacugcacagagaaagccugucucgaaaaacaaacaaacaaacaaaaauuaaauaaauaaauaaauaaauaaauagauagauaaauaaauaacuucaacgccaggcauaguagcauauaccuauaauaccaauacuggggaagugaaggcacaagggucaagaguucaaggucauugcuaguuauauacuaaguuggacaaccuguguuauacgaguccugucucauaaauuaacaaauagcuaauuaaaauaaacuugaaaaaucaaauuucgguaauagaaagauuguucaaagaauaugcuagccuuuucaacaaagcacacacacacacacacacacacacacacuacuacuacuacccauguuuggaaauaaaauuucacuuagccuacuucauguuacaaaaguaucuaaaaacuaauuacaguaauuaacaugugagaauacacaacagcuguccaaauguacauaagcuacuuccacuuccuuuccaugaacugccugcccacccauuucagggcuacaggauaccaaccacuauuagauuuaggaagacagugacaaucacauucagcucaacccuuaacagauguauaaccuuagacagacaguuuuuuaccuuuccuguggucagacuucuuguaucuaaaauugaaucguaaggauuacugguacuauggugaugauuaugaauggacuucuacaauacauuucuacagauaacacacauacacucauuuuucuuuucuacuagaauuuuuuuaacuuuucuuuucuuuuguuuuguacccccuucccuucucccucuugcucgggccccacucgcuccaggcuccacccgcuccagcccauaggguuuuuauuuguuucucauuacagaugguuguaagucaccauuugguugcugggauuugaacucaugaccuccggaagagcagccaaugcucucaaccgcugagccaucucaccagccccuucacuagaaauuuuaauguuuuacuuaacugaauucuauugaaauaccugggagauggauguuccugagcacaugcaugcacacucacacucacucacacacacacacacaauguacuguauauauuguauuauuuacugcuguguuauugugaucaaaaauuaaauauauuaaagaaagaauggcuuauuuuuguccguaguuucagggagacuucaguguaucguggugggaaguuauauauggcaggagcauauaacauaaauuccucauaucacugagcagccaggaagccagaggugggacuauuaccuucaaaguucugccccuaguggcuuauuucuaugaaucaggcuccaccuccuagagucuccacagcuucucaaaacacuggggaacaagcuuucaaaacaagagccacuagaccccaaagcucacagcuaccuuaaagaacaaauaacucauauauuauaccaccaacucaaucuuaaaucccauaaaaaucaccuuugagcgaacaauauuacuauugaauguuucuuugaggcaaagucacauacauccuaggaugaaagugaaaucugcaugggccacgauaucucugaauuacugauucuucugucucuacuucccaagggcugauaucacaagcacgugcuaucuaucauuccuuuuuauggggaucuggccacuaauccaugacauuguucaaacuaggcaaguauuuuaccaaccuggcuacaaucccagugccuauagggauaguccuaaauggccaguuuuaaccuuacaauauaaauugaaaauguacaaaaaauagaccauuuuaaauuugaaaaacauauuauuuguccucccuauaagaaaauccaagaaaaagcaguaaauugauguuaaacauuuuaaaauagaagaggguuaagaaauaaaccaaauuauagaggcaaaauuuuuuaaaguauaguugguagaacuaugaucauaguuaaaauuuuaaauagaacagucugauucucaggacuagcuucuuaaguaccagcaacaacuagcucaaaacuccagaagagggaucaguaggggugcagggacagugauccauucacagcagccuaaaaugacaaagagcaaagaaagaaaacuuaugugcaguauucacacugagaaaaugacaguggucuaugcuguauaacaagacccuguugcaaauaaagaaauguguucacccagcaugcuuuuugaacuggaaagugugaaaaaaauaacauggaauaaucaaucaucagaugcaagaagaaagugcuuucugaauggcuuaaaggggcuggagaaugaaaaaaaaaaaaaaaggaacacacacuucucuauaccagguugauggcagugcuccuugugugagagaacuaaaucagaccugaugggacacuugacaguagauauuuuauguggaaaaaaaaaucaauagauaaaaauagauaaagacccaaucucagugauggaaauuuucaacaucaugcacuacaaaauuuauaaauguauguucagguuguaugugauaguaucagcggcuagaauuagaaaaagaaugucuacaaauuuaugugcaaucuccauacugauaaagacaauagagguaacaauuuuuaacugaugcagaagagagaauucaauaaaugcuuaugcagaagagagaauucaauaaaugcuuccugggacaauucauuacaugaaaggggaacuauagguaugagacaugaaacccaggccacggcuccugucugcagucccaguacucaagaggccaaaccaucaggaucagagagauccaggcuaaccuaggucuacucagugaagucaaaguuagucuggacuacagacccuauuucaggauggaauugaaagggaugauggcauucacuucauugguagagcccuugcuuagaaugugcacgguccuauguucaaucacaagcacugucggcgaaaggugacaaauugagauaugaaaagaauaagacaagaaaacuggguagagcuagaaaugcaugaguagacaugaggcucugcauccaaaaaaucucuaguaagagccagugggaccgcauagcaucacaaguuagugucuguccgcuugacacagcccaaaguuaccuuagaguguguuaguguggagaaugacuggauaauacuggacuaugggcacuucugugaaguacuuuccugacuuguuuuuguuuuguuuuuuugguuuuugagacaggguuucucuguguagcccuagcuguccuggaacucacucuguagaccaggcuggcuucgaacucagaaauuugccugccucugccucccaagugcuggguuuaaaggcgugcgccaacaccacccggcuacuuuccugacuucuaauugauacaggaggaggaccccacacugcaggaaguacugccccaaggcaguagugggccaguaaaacccuuucuccccuaacuugucuuugaucagaguguuuuuaucacaacaacaagaaacuauaagaagacccuucaggguuucaaagaauauuuucagguucugguuuucuuaaaauauagaaaacaaaauguauaagcuuaagcaaaaucaaguuuucauauuuacauggcaaaauauacuuacugguguuaaugaugaugugcaaaacucauaugcauugugucuacacauuuacaccacuuagacauaaaaaaaaaaaaaagaucaucagguuuuaaaaacccagaaguguaggugugcuugcccagcacgcacaaggcucuggauuugauuacuaacaccuuucaaaauucagaauuuuuaaggaaaugaaaaaaaucaguuuuuuuuuuuaaaaagaaaaaacaaaauguaacuaaugaccuuaaagaaacaguguucacuugcccuggagacacagacagauaaacauaagccaauaacuaguaugucuuggaggcagacuugauuugagcgcuagggaaagguucugagguggagaagauauuucaagaggagacacggaauaucagagaggaagcuuugcuugggcuaaacaagcaaguaccaagauuucaggguuagggagauggcucagcacuaggcuugacaaucaaugauggguccagggaacccacacaaaagggcagagugcugcaaucccagaacuccuauggugagagacaaagauagaugaucgaauuuagaagcuugcaagauccaaggcagcagcagaaacaagcucuaucuuagcaagguaaaagaggacuaacuucuuaaaguuguccucuaacauguaccacaugccuccacaugugccauaacacauaacauaacacacacacccuugcacacacacacaugcacacacaaacauacccauauggauacacacauacaaguacaaacagguacauguacacauaggcacauacaugcacacacaauaacacaauacacacauaugcauguacacacacucacccaaccauuacuacaauuugcaaccauuacuacacuucgucaauagugaaguaaugauaacauucuuguaaacagaaacuuuguagucuuuaaaaaugacgauuuuaguuggguauuguaguacaccccuuuaaucuuagcacugggaagcagaggcaggcagauuucugaguuugaggucagccuggacuacagagaaacuuccaggacagccagaguuauacaaagaaacgucucauugaaaaaaaaaugcacucgugcagaauauuuuaugacacauaacuauaaucauagugaacugacagggauacaaagcuccaaggaugcacaccaacacaggguggagucaguggccgggaacuagcccaucaaguaaucaugcagugugauucagacuguggaaucuucaacugggaacuguggccaaaacauguucccaucaauaacaacuuguauuuauuucagcaauacauuaaaauuuuaaucuggauguauaacugugggagacucuguggauuuuaugugagccauguccuguccuguuccugguaaccaaaggaucggaguaccaagaucauacgaucgugcucuaccacacaauaaggcuaugagaaaucaggguauacguuucauacacagacaacaaugaaagucaucaccuuaguagcaagggaaacaaaccccaggucacccucccucccaccacauguagaccacagagcugucacacucuucuucccacaaauuguuucucuugcuccugccuucucucacacaaucuuuaaccuuuauacaguguauuaucaguccacagcugaacacauuuccuucucucucucucucucucucucucucucucucacacacacacacacacacacacacacacacacacacacacacacacacacacccaaccccgccucuaggcuggccuacaacuccagcugcuaggauuuauaaacugagugaauguuugacugcgguaaaucaaagcuaaucaaacuaaauugcaacuucccccuaaaauaaaagcaaauuaaguucuuucuuuuucuuuuuuuaaauuagauauuuucuuuauuuacauuucaaaugcuaucccgaaaguucccuauacacacacccccacccugcuccccuacccacccacucccacuucuuggcccugguguuccccuguacuggggcauauaaaguuugcaagaccuaggggccucucuucccaaugauggccaacuaggccaucuucugcuacauaugcagcuagagacacaagcucuugggguacugguuaguucauguuguuguuccaccuauaggauugcagaccccuucagcuccuuggguacuuucucuagcuccuccauugggggcccuguguucuauccaauagcugacugugagcauccacuucuguguuugccaggcacuggcauagccucacaagagacagcucuaucagaguccuuucagcaaaaucuugcuggcauaugcaauagugucugcauuuagugacugauuauggaauggauccccaggugagguagucucuggauggcccauccuuuugucuuuagcuucaaacuuugucucuguaacuccuuucauggguauuuuguucccuauucuaaagaggaaugaaguauccacauguuggucuuccuucuugauuuucuuguguuuugcaaauuguaucuuggguauucuaaguuucuggacuaauauccacuuaucagugaguacauaacaugagaguucuucugugauuggguuaccucacuaaggaugauauccuccagauccauccauuugcccaagaguuucauaaauucauuguuuuuaauagcugaguaguacuuaugagcccauuguccuucacuuaacuuuucaucuauggacacaaacugcacaucuaugaaguuuugaaccauugagccuacacaaaaauucccaaugcuucugcaaugugcaaacuuaaagauguuggccaacuauugguagaaauaauauuuguaacauacagcauaauuuuuaaauucuaaaauuucaaauuuuggaccucaguuuagaaauccuguacucauuuugaguuaagaguauucauuaauauauauuuaaugaaaguuuggcuucaaaaaccuaaaugcaaaaccuaaaauucuaaaaucaaacaaacaaacaaacaaacaaaaaaaaaacaaaaaaacacucagguggaacaaguuaacaucucaaugcagguucccauuuucaagguaggaucccagagcacauuaagaacagugaaaagcuggcaaaugagauuccaccagggggcuguaucauggcucagugguuaugaguccugacuguucuuccagagguucugaguucaauucccagcaaccacauggugguucacaaccaucuguagugggauccgauuccccuucugguuugucugaagacauuggcaguguacucaaauauauaaaauaaauacaucuuuaaaggaaggaagaaagaaaucaaucaauuaaaaccaggagaucccaucagacugaaauguuccuccaaagcuaaggggaggagcaacugaaaagacaugcaaagaauggguagguaugaccaacucccacuugacaaaggguuaauauucagaacgcuuaagaagcuagaagaacuuaacaaaauaagaaaacacauuugaugucauuagcaaucuagcaaaugcaucaaaccauaaagugaugccagcucauuccagucaaaauggcaauuaucaaaauaaauacacaaaauguuauguuaauucauaauaauuaucacaaauuauuauaaauaugauuuuauuauuauaaagaucuauaauaaauguuacuuauauuaaacuaacaauauaaaauacgaagagauggcucagcaguuaagagcacuggcugcucuuucagaaguccugaguucaguucccagcuaccacaagguggcucaguaccgucuauaauuggaucugaugcucucuucuggcacgcagguguauaugcagauagagcacucauauacauaaaauaagaaauaaaauaaaauaaaugcugcgaaggaggugagaaagaucucuuauauacuacuguuaagaauguaauuaaucuagucacauagagaauacuauggaugguacccuccuaccauccccuccaccaagaaaauaacacucaaaauggaucugccagauggucccauaauccacuuuugggcauagauccaaaacaaauaaaaucuguuaucaaauggaccccuauguccccauguucacuccagcacuauucacaaaugccaagaugcagaauuaacaccugccugugagaagaugaaaggguagggaaaguguagcgaauggacagacagugcaaucucacgaagguguaaagaaugaaagccgguucccugcaguacagcacacagaacugggcaacauuaggcucaaugauauaagccagacacaaagcaacaggcagcacccauucucuuuccugugaggagacugaaggaaagaguggauugcucgagauuagaauggguggccaggauacgugcgugcgugcauaaaccccuuuacuaccacuauuaauacauguugguaaaugaauauuugaaaggcaaaauacuauaggcacuggcaacagauggaaaucccuuugcaucuucuuuauauacauaacgauauuguuaguaauaauaguaaugagcaguuuuuaagcucuuacaguguaugggggguaaucacacuuaugaccucauuugauucacuuauucuaaaauauuaagauucauucuuauuuaugaguauguauaugucuguggguacuugccuguauguacaguuacccugacagaccagaagaggacaucucauucccugggcuggagguacagccaccagaggaccacuugacgugaguacauaaguucuaggaaccaaaugcccauccucugagagaugcuuucaaaagcaagugcuuuuaaugacugagccaucuucccugggccccgcuuucugguuuuucaugagaguuguauaaugccaaucuaauaaaaagagaaaaggaaaaucagaagauagccucccagcccaaguucacacaccugaugacagaaaguuugagccuuuacacucccccccccaaucuugcaccuuucuguggaaauaaggccccuacuaggcauuccuccuguuuugagacucaaaucuaccauauuguaguucaaauguuaaaauucaugcugcuaaaccaacuuguuuccacacacaagcuuucaaaaaauauaaucuaugcagaguguggaaaaacauuacucaaauuaauucagcuucuguugaucuuuauuuccauaaggaaaacaaaacauuuccauaucaaaaauguucugaugaauucauucuugaauguagcaauaugcaaacuaaguuaacauauuucccauucaggacuauacagaacaaauagugggaggaaugguacacaucuguaauccccacucucagaggaugaggcagggaggaggcgggaaggaggcagggcaaauucaaggaauauauagagguuuugaagccagccugagcuacacaauaaggcccuguaauauuuuucggggggggggagggaacagcacuuggggggggggggguaaagaguccacaugaaccacagaaguaaugcaaaccacuaacuuacuucguucuaguugaaggauuaacaggcuuuguucaguaagaaccuugagccuuucuauugcaccugcucaccucugguucugcaagaaggaacaggcaaagauguauuccaaggagaguuucuugacaccuaccaauaaccaaagccuugcagcaaagugguuugcauaugagcacaggcuccaaagccagcacuuccugcuuucaaagggaaaggcuugcuaaaccaagcggcagaaaaacuccucauuugcccuccuuucuuacagcuucagacuuuucuucuguguuuuuaggucagggucuuucugauuacugugcuaaccaagcagagagccuucaguucuuguguagaaagagaagaccucaacuuccagaauuuguacuuuguuuuacuuaaaugugguuuguuguuuucuuguuuugucuuguuuuguugagagagaaagagagagagagagagagagacagacagacagacagacagacagacagacagacuuacucuguagcacuggcugaccuggaauuuacuauauaaaccaguuggcuucaaacucauagagaucuaucuccuucugcuuuugaguaugcuggcauuaaaaguauacaccacuccaacuggcucaaaugucauuuucaacaaagaaaagucgugaaguccagaauuguggacuacuguuguaacccacaauuccagaggguucgcuauuaggcugggccauauaaugagacccugucucccugugaaaaggaaggaaaagauuaauaagacaugaaaauacacaagaagauauaacucauguaggaaacacagcccaggggccagcacagcacugaauuuacuaggccaaacaauuauauuuaaggaacuaaaagucuaaagagcuaacaagaaguaugauaaucacaucuucggaaauggaguguaucagugaagaaaaacauaauagagaaagaaaacgaacggaaguucuggaguugaaaagcacugaaaggagagacugggggaauugcagcagauucccagugaggaaaaagagccaucagcugaggcugcaggaagagaagagagucuuccacagaacccuggaaagacaugcaauaccaucaugcauacagaugggugaacaguuaguguucuaggaggaacacagaucucagugacugaaaauaugauggcacugucacagaagcucaguggacaacucaagacaaaguaaaaaacuaaacaucuaaaucgauguaccucacagaccaaugggacaaaaccucagccucggugcuccguucuuucaguaacagaauuuucaagaagcacgagcuuccugucuugcugugcaaggggcaccaauaaacuuaacaacagauuucuggucagaaauaauggaagacaaucgggaacugaguggcacuuucaaaguacuaagagaaaaacuaucagacacuaaguccacauccaaauacaacuauugauaggaaaaaugugaauuugcgacucauagaucuuuguuucaagcacuagggaagggaguccucugaauaaaaugaaagccaacaggacaguaacuugaguaucaagagcuacuaaccaccaggaacugauugcuacauaaacagaagacuagaacuguaacuccuaacaacagcaugaagcaauacuuagcaggcuaugcuaacagacuuagagguguuaagaugugguguguaucacaacacaggccaauggagagcugacacugggagcuuccaggaaaaaagccuucaacugugcugcagcccaagcagaguuaaucugaccugaaauuaagauguuaguuauucucaacaucaucacuaacuucuuaaguuaugccucaaaagauagaaaaacaaaacaaaacaaaacaaaaccaagugguuagaaugguauucuaggaaacauauguuuagcaaaauaaagcaagaaaggagaaacaaaggaacagaaauguaugacauaaugaaugcacuuaaauuccacauucuugguacagacaguuaguguaaacgggucaaacucugauaaagagcaagaacggcuuguuuuaaaacaucaaacauguucaguauaaaagacagaugacguucaaaaacaaauaaaaaaauguauauggcaucgagaaaguuaucuagaccggcuauuugaaagcgaacacagagaguagagacaaaagaaacucuguaaugauaaaggggcacucuauagagaggucaccguaauuacacaccagaugcaucaaauaaacuccaaaacaccagaaacaaauggcaaaaucaacagcauagggauucaacaauaacugaaguuuucaugccuccacuaacaacaaaaauuagucaccaccacuaccaucaucaucaucauguggcaagaacuuaaacagaaugaacaaaaucauaagccagucggccugauacggcuauagacuacucugcccaacagcaguaaacucacauuuuucucaugugcaaaugcaacacaaugcagcucccaaggcauggugaacaguaaagcagccucaauaaguauaagaggcaaauuccacaccauguggaauuuauuggaauacauuuauaaacgaugguaacagcaauagcaacuuugagggaagcauaaauauaugggcauuguuaaauaaccaaugaaucaaagagaagccaccaaaauaaauuuggauacuuugaaaugaaugcaaaaugcagcacagcaaaucugacaggaugcagccaaaagcaaugccuagagaacuuaauaucuuguacuuaauauccuuuguauuauuguauccaauuuuaagcagcuccuuguaauuaaaaaguuguugaauauaauuuaauaaugagacaacauccccccaaaaugaacgcaccauagcaucugguuuugcugcuuuaaaauggguuauuuugguacauaaauauuuaacugcauugugggauaggguagcauguaugugaucccaguacuuaaaagguugaggcaggaggauugugaacucaggaccaacuucagcaacauaucuagacucugccucaaaacacaaacacaacaguagaucgcucuauggcuguuuauagcaagcaaccuuggcagcagagcuaagaccacacacacaguucugaugauaccuaaaaggggauggggcaguggguacuaaaacuccaaucugccugcagaagcaggaacggaaaaggcagagcuggguguccuugccuuuccaguuuugguuuuuguaccacaggagaacaugguaaaaugugccuuuucacagaagaaaagaaaacuaugaugauuauucaaaucuguugauggaaaggagaguuguugguucauagguucucauggcaauagaguaaugcuacuaaugaggaugacaccucuugccuguguccauagaccaaucagugucuuguaggacuuugcauuaaguaccccugaacuuacauuagguacauagcaucagcuagaacuuuaaaucaaccaaaaugggaaagccagcaaaauauaaauuuggggaacugcaagaugguccaggggguauaggcaccugaagcucagacuaauaaccuggacccaaaugguuaaacucaagaacuacuuccuuaaaguuguccucugcuuuccacccaggagcuguggcacacaaacacacacacacacacacacacacacacacacacacacacacauccuaaucuucuuuuaaaaucuuaacuuuaggaagaaauaaauacugauacuauuauuaguuauucaaauacaaacacacauacacacacacacacacacacacacacacacacacacacacacacagcaucuuuuauguggcagguguuuucuacuauagcaaccaggcacgcagccacaaauaaaacaaaguucuugcuccugugaguuuacauucuuacacugagagagguuugggaacuagccaagugcacaaaucuguaaaagggcagggaagugguaugugcuauaaagauaaauaaaacccaguaaggccgaguuuguaugagaaagaaggucccucuggaaacaagauauugggauguaugaaagugaagucagagucaggcaaaagcugggggaagguuccaguacaaauagccacaccgcacucugaaguagagcuggccuuggaauagcaugaacaauaaagaggacaugguguggcauaauuagaaguaaggagugaggcaccaggcagauggaugcagaguccuguagaccaaacaaagcuugggucuuauuccaggggccccuggcaguuucccaugaguacucugggauguuuucuguuuucaggccuuacucuggccgaaugaugaagaguguugaacuccaggguggagauaagaauacagguuggaggacaaugaggggccuuaucauauuuaggaacaagacaaugguaguggaguccaagaaagcagaauaguaaaggcucuuuggguaacacuagaagaagccagagcacagcugggugaugagacagagagacagggaaccccagcaaaaguguguauagcccaaggccuuccugucuuccucuccugcaucucacagagaguacaccuggcugucugccagggugcuaauggaaguucuugcugucccuuuagagugcccuaagaauugggcaaacccucgaaaauuacacaguuugcuggagaauguacaucuuaagaaugcguacagcuacaccauuuccagugucagaaccuggcuuggauaauaaguauuuauaauuccaaagaaaaccauguugaguugaaugcuuuagagauucuagaacuggcccucaggguuccuccaagaagugcccuguaggaccccuccagucuauauaaaaucaacucucagcucaagggaagagauaguuuauucuggagccaaauaugagugaaaauggucagguaacacacauuuaaaucuaucaaaauuccacguuucaacaugaaagcaguuuaaugauauuuucauaguaaaauaacaaaggcagcaauaaaucaagauacacuuuaaauacuucagugggaaaauuagacaguuggguuauaccauauacagaaaacccauagaugguuucugacagcauuuuuuuuuugccuuugauuauuagaaacuaggggucuuucuaugcauugcaaagaauuuauaucucuuagucacagguuagguccaacaugaagguaaguaaagaauagcuuugagggagggggcuacaaauuguccacauuaagcugucauuuguuguugaaccaacaacaugccaaucucuuuacaucacugcaagccucaucaaucagcugcuguagacccagcuucuuuccaggaacucuuguuuacucuuuuguuucuuuuacuguggcaucaucucuaagaagcagccuacagaauccuucuguuucuucucucacgccaucucugagaaacacccuucaguaccccuucccuucucucauuugauccugggaccuuucaucuaagcucuacccuuacaacgauuuuccuacaucugcacugcccauggaggaauggcaccuuggcaugguuaacucccuuuucauuucugcuaccacaccuuuucaaaacacacaagcagcuuuaaauaacucugguaccuaaugagaccuguagaacauaacugucaugggaaccaaugucucaaacauaaaaauucacuccccagaacugucagugaagccagagaaacaguuagcugagcuaagaaugcuccgaggaagcucucagugcuuucuagaaugcauccuagaguugaaccagacugaacuucauuaacauuauucaaaagcaaaauuacauuuggggugagaaaggaacaugcaaugaaaugcagacaaaugccuaccacccacccaccuucccugucacacauucagcggacaggccguacacugggucuggcccagcagcccuuuuacuauaucugagcaucuggaucaucugcacacgcccucucucauuccaaagcugugugugguuuggggcauccagggcuuuuggggacuccucccuuacaagguccuccacacugcaguuguacauuguuugacaauuacuacaacuguaaugggcucuguguguuuaugcuugcccagaaaaaugcugacuuuauccuugcacaguuaaucuacuugauaaaaacguucagagaagggaauuucuaaugggguggggacacaucagcacaauccaaaacaugcuguggaaagauaugaaagcuuuucaucaaguuuaaacgacucaugcaugcuguaggauaugcuccaaguaucacagucuauugaaugaauguaccacuucugaguuucuagaacucacaggaugugccagggguagaguugagcuauccugaacucacaagucccuguauaugucuagaaaauagcaauaccacguauuuccaaagaaccauccaaucaucugcaguuaauaauucauuauuugguacaaaaggggaacacugaaugaaaugaagaaagaaaaagagaaagacagacaggcagacagagagacagacagaccaggugaaagaaaaagaaaagacccaauguagagauuucuaauugucaauuacagucuauggugauugugcugugcugauuagcaucccucaauaacugauguccaucuggcacauccgaauguguccuuauuaggaaacaaggccucugccgaugugaugugagcuguuaagaugaggucauaauggauuaaggucggcuuuaaucuaacgagaagauaacacagacccagggauucacaccgaaaaaaaacagagagagacugaaacuguagugagauauccauaagccaaggaacaccaugagacagggaaagcuucuaggagccuucugggagcacauugcugccaaucauggcuugcagaccugcagcuuccagaacugaagcacaauuccuguugcuguaaggcaucccuuggaagugacaggagaugggaggucuguuugcuacucuccccuacccagaccacaggccucacugcagcaggagcucugcagcacaccuugcucagauacagcacuacaaagauugaagcugcaggaccuaagcaacauuaccaugugccuaagggaggaaaggaaaggaacaaaagauuauaacauguaggacuuguucucugaaggaccuuacugagaugcugcagugcuguuacuaagcaaccagccagggaagcacaguacuagaagcugacuggacagaagcagucuuuugacaguaggucacaucugccaaauauucuucuucccuugaaguuaaaaaaauauacacauguuguuggcuggcuaaaccaaggcuuuuggggguggaacaaacacuuaaacucuauuguuagcaauuuuaacguauaugucccaauuaacuaguccaccaugaacacuuacuucaaaaugccaagcuacacgccaucuucauucaccgaaaauuaauaaaaaucuuuuaaaauuauacauuuccugccaggcgugguggcaugaucugccagcaggcagaaucugggcagccugugcuacacacuucucaagacuagaaagccaaaauuaaaaagaaguucauguaguaugaaaguguuucuucuucuucuuuuuuugagacacacccgcagucuuagcauccugagcugacuuugaaaugcuauguagccaaggaggaccucgaacuuuuugguuuuccucacuccacuucccaaguacuggcauuacacaagccugugccacugugccauguuuauccaggucugcggauugaacccaggcuaacugcaugguaggacagcacucgaccaacugagcuacaccccuaguccaggaaaguauuuucaagucauaccuaaacuggaaugugcaucuaaaagcaaaauuacuuauauauaaaauaaaaugacaacuaggaaauucguuaaaagggacaaugaauagauaguccucuaaaauacacauguaucauuguucacucaacacauaggagccucaacaucaucagcaaugaagaaguaugaaaaaucaagccauaauaaucaauucauaucucauaggagcgcuacagucaagaagucaggcaaggacacacagaaauuaaaaccuuaucugcugcuguuucuuaacugaaggcuuuacuuuggaaauuucuauuacccaucaacuauagcccaaaaauaucacugaaaauucguagaaaugguucccaaauuucaauuugcaugccauucugaguaaaaugaccauaucuaacaacugucccacuccacguaucgaaucuauugaggugaccagccuuuuagguucacuuaucaguuuauacgcuugugacaucacagugcuugugcccccaugaaaaucuuacccugauaauagucgugaagcaugagaccaugauggcaauuuggacaugcaaagagacgcuguaacauguuccauuuugugaaguggugaaagcuucuauguguauacgagaagcacaguacacacaggguuguguaauaucugugcuguaaacaacagcuaugagccucaaaacaugugccugcaauaggagggggcuacuguacuccacuguaacauccccgcccccauccuguauaucccuguucuaucuuucccagguagacauccuugagggucuuuuuauguauccuuucuuuuuguuuauucucuucccuuuggaauuuccuuucacuagguuguuuggacuacuuucuuguaauggguaugaguuggcaaagucaaagcuucugaccauagaaguaacaauaccagcaucaaaacaagaucuauacuuaaagcacacaggggcaggaauacagaacuugggcuaucacauguggauguucuauaaccaugacccaccuaccuauucaggcccugagauugcucugaaacccaccaugaauccaaccuucuccaagacaucuuccucagccaaguagccaaaaugacuagccaccaguucucacaguguucucaucuccugagcagauuuggggauaguccaucucagugacaggucuauccuagcauuuuccaagcacugucucaugagugguauccuccuccacaauacuaggacagcagugauguuucaaccuuaaagccauagcagaccaggggccaccuagccgguaaagccauaagugcaugcauccaucacacuuucagucgcuaagauucucaaagacaaaggccagggauuuugccuuugugcccauguagcaagugacauggagcuuucuuuuauuuucuuaaaauuauauaccagguacagugguaggguucugaaaucccagguacugagcagacugaagcagaaagauuguaaauucaaagccacccugggugacucggugaaacuaucugaaaauaaagugaaaaaaaaaagagagagaauggauggaggugugucucugugacagagcacuugccuagcaugugugagguccaggguucagccaccaacucuucaaagauauaucuaaacaauacacuagagugcuuugauaugcauauacacagcaagaugacaucacuagaaacaggcagauuaacauauccaucauuucuaguucguuguugcuuagcuuucaccucccaaauaugcucuuuuaacaaacuuuccguuuacaacacaauauuacuacauuauugaguauaaucccccauguugucuauuaagugcuuaggcuuauacauucgucucuccccauuucacugcaacacuauucacaauagccaagauaauaaaucaaccuaaguguucaaugaugaauaaauaguguggcuuguaggcaccgugaacuacuacucagaaucuaaagagaaagaaaauuugucaaaacaucacaugguauuuuagagauuauguaucuauuaccaacaaaaaaaauaaaaggaaauccuaauauuuauaacaacauagaugaaccuaugaauuaggccagacacacagagacagauacuacauaauuuuacucagaaauagcagcuaaaaaucaaaccaaacucauauauauagaaacgguagaaagguggcucuggaaagugauacaaguacuaagaagcuguaauaauuacagaacaagaaggccaggggggaugucaaggccauagagaugggcaacacuaugacuugcacagggaagaguacagaccuacccuuauccucaucuagaguugccgggaguccaccucacuuguuagaaggagcuagccacuugaaaaagcacuuuauacauguacucaaccagacaugcagguuuuccugagguaacauggguacucauuggcuccaauucaaacauaacagaaacagguauaguagaggaucccuuauacgagaugcuuggaaccaaaagugguucacacuuaaauguuucccauuugggaaugcucauguauguguagucacuauacuguagcacugugucuuaggcaugccaucuguccuaguuugcuuucugcugcugugauaaacacugagaaaaugcaacuuggggaggaaaggguucauuuggcuuacacucccaugucacagacugucacugagaggagucaggacaggagcugaaacagaaaccaugaaggaaguucccuccccgcuugcuuacuggcucguucucaguuagguuuucuuacacaacccaggcccacuugcccaagugacgagugacggugggucaggcccucccacaucaggcucucacagacacggcagcagaccaaucagguugaagcauaccuccaguugagguucucucuuuuggguaauucugaguugugucaaauugacaauaaaaacuagccagcauagcucccaaguccaaauguauuuauaauuccccuaaaacaaacagcaugaagugacuuuuauucauuacuugagugcaccuucccuuugaccauagucuaucauuguaacacuuucuacuucuggcaucgaaaaauuucuaacaacugaauccacaguccaugcuugcaaucgaagcacucguguggcugagaggaaaagcacucaagcucaggagugagaccuagcuaggcuccagggucagcagcagcucaagagcaaagggggcuuuguguugugcucugagauguuuggacuaaggauauucacccaugcaagagugguuuuuaaaguggacuuuucaaugcacaacuaacacaucccaaaaguaaagagugcauuacucugaaaaagaauucaagaagcuuaaggauauauggcucguugcccugaguuaccugucuacaaacacaggaagaagacacuagaacauuagucaucugccuagccauccauuuccuuuaacaaauggaguacaggugccagaaugucagauggaaaagggcccacuguauauccagcuaagugauggugacacagcccuacccccauaaagccacuuuugugugaccuuguggccacauauuagugugcaaguccaagaggccuuuccgcaaaaggcuguacaguguuagaauuauaaccucaggguuuggcucaguucucccagcuaucccuuucaucuccagccuggaauagacuuuuucuuuaaaaaaaauuugauugaacaacuaaguguuaucacucaacuucagaucaaguuuuaaauuccucucauucaaguacuaaucaggcccaacccugauuagcuuucaagaucuggcaaguucacaguguuguggcuguaaauuucaugcccugcaucuugaaagucauuaugcaguaaaggcccuuagggauucuggggagaagcaccccucuaagaacuguggcuccugauaauaguacugucugugauauguccuuaaacuguuucccugagcaagcaagagaaagaugggaaacacugcagagcacuaguguccuaacuaaagcagccuuccucaccauuagugaucagcacgguuucagaaaccuccccaacugagaacuuucucacccugcucuguguucaguauauauccaucucaaacaguaggugccucucuacccauaagcuuugcauuucaggaacaucucauaacacaauagaauaguauuucucuaugaaugcuaugucuuguaguaaguguguuaacauguuuaccuggugccaacagugguucauauugcccuccccucauuaacaguuacaaugccaacaucaagaguaaagggcuguggcauuccuaaaucagcacagggauaaugagcaguguuugugcauuagcacaucucuuuauaccauagcuauuugacuuguacagaaagguaacauacuggaaccuaugggauggcucacaggauaauggagcugcccggaagccucaccauaugaguuugacuccuggaacccacaagaaccaauaaguuguccuuugaccucuuuagaguauacaggagcacacauacucauggauacacacacacacacacacacacacacaauguaauuuaaaaauuuuaaaacggugagauacaagaugaugacaaguacucaaaauucaacauuaacaaaacaaagaacacaauuugaaaacaagcaagacaugagauaauucucugaugaagacaaggguggaacaauaaggggucauccugcugacugguacccuagcugugaaccugacaugagguacccuggaucuccauggggccuccacaguaucuuuuuuuaagcugugcugugaaugcuuuugucuacacagacaagugguucagauucugaucuccugugccuaggcuggaugcaccuggaguuagaacagaagccccggacaguuguccucagauccuacagguccccugcuauuauuaucccuuggcuuuugauuguagccuauugaacuacuuccaaggucaaguuguacagggaggagcagguuaaagugaauugauaccaucuuguucuagcaccaaaagucucuguuuucacauuuuucuauggugaacugacaacaauaauaggcccagcccucagacaucuaccucagucugggcugggucagcuacauuccaaguuuuaccacgccagcccacacuggggugugcugaagcuuccaaggacugcagcuccaaaaauguuaagacucagagaccggaggaaauucuucaguucgaggugugcagcuuaacccagguggaggagugggcuggagagauggcucaaugcuugcuacaagagccugagaaccugaguucaguugcucagccccagcuaacagugacuaacaguagguaucuaucaccucagcauggguggcacagaauauugcuugccuuagucacuucucugcugaugugaucaaucacgaugaccaaggcaacuuauaguagaaagaguuuauuuguggcuuauauaaauuuagaggguuagagcccaugaccaucagagugaggaagagcacuccagcaggcaguagcugagagagugcaucuggagacacaagcacaaggcagagagagcuaauugggaaugcaauggcuuuaacguuugaaaucucaaacucuuccuccagcaacaaaucuccucuaagaaggccacagcuccuagucauucccaaacagcuucaucaacuaaggaccaaauauuaaacauuugauccuguaugggaugauuuucauucaaaccaccaagcugguagauccuuagggggauugcuggccagcaacucgggccuaauuaguagacuccagauuuaaugaccaauucuaucucaaaaaguaagauggaaagugagaaaagacaacaaaguccuccuugggucuaaggguggcucacaaucaccuauaauucuagcucugggggguaucauaaacuucuacccuuugugggcaccagcacucauaugcacauauccacacagagacacagaaacauaauuaaaaauaaaagaaaucuuuuuaaaaaugagaaaggguacacaguaaccaguaagagccuggcugaacaucagcuccauagaaacagauggaagcucuugggacaucagguggguaagccucucugugcucugaucuaccauguguagucugugucauagcaaaagcacacuuguaaacccugugguugcaaagcuucuagauuguagacuuguaguuauacagcugcuuuucaacauuucuccaaaugcucucaucccauagauccccaucuccucuacuuauccaaagcauggagaauagaauaaaguuugggagauauucaggagaaucuuguccccacaaaaaaaguagaauaaaauaaccucacagccauaaauaugaagccccuaacauuugagcacucugcuuuucugccaggcucacaggugccaaagcuauuucuagaggagcucuuuccaguuaaagcaagaaacucuaaguuccaaaacaagcacaucauauaaagggcagggcuguucuuuguaccuguuucuuccauuucccggucuugagacacaauuguggaggauuuucauaaaaugacaauauuuaacuucuugagguaacucaguaauggagccguugucugcuaugacccaggcucuggguuugauucucaacacuaccaaaguauauauuuguagugaagauacaagaacacuuaauucauuuucaauaugagacacgugccuucauuuacugucacacacacacacacacacacacacacacacaccuauaacaugaggaagccagauaccacaauggcacaagaacacaaagcagcuaagaagcacuaaacaucaccaagguggcuuugauuauauacuuauuccuugcuacugguuaugggauaccauugcaaucuggugaagacucaguaaaaagaaucuggagauaggaaggccacaucuguaaucccagcaccugggaaguagaggcaguugauagugaguucaaggaucauguggugggauauuaaguuagagugaaaacuaucauacaaaagaaaucagugaaagagacugaaaacccaauuaucaaggcugcauguaacacagcaugguguuggggaacgcugugcuaugcaagugggaacaggggaccuggaaccugugaccuuucuccagcucaggcccacuuccacccucagaaguaccuaacuuugaacaggucaaacucacacaaaagagaggguucauaagcugugacacugagccuuguuguuccauuugaguaugaucauuccuccuauuggcaucuuggagcagaguaccuuggccugguaguaugggauacuaagguagucuugucaagaauaagcagcaaaucccaaaucagggauaaaguggagcuugcaugcaaugugguaaacauugauccagagagauuguuaaucuauccauggccaccaagccccagaaucuaugaagaaaugauaggaagaaacaacuucucacugccagaccaaagccagcuugaacaaagcaacaggcucugagaagaauaaaugaaagauggacgagaaauacuugacagagcuucugaaagcagggaagccuucaaaaugaaggcaucagcaaggaccuuuugugugcaagcgcacaugcauguguacaaaggaaaagaggauuucuuaacaacccuuugagauacaaccugagagucacuaaaagagugaacaugucuaaugguaagacaaauaacgacuuauucuucuugaagaagccugugcuuacacuuagcuagaucucaccccauucuccuuuaagaagcacauacuccaagcuagagugugccucauuuccuuccaccuguuucucuuccgcuuagcccuugugcuuucgcuucuacuaauauacaauucccaauucuuucucaucauaauugguuaguccugaaauuauuuucagcaugaaagccacguacccuaguguggccugaaacaaggucccuacaaaguuucaaagacacuucagaucagugaggguggcaguguagagcuaugucucuguccuuugguauugacaaccaccuugcucauccuguucuagauacaacuuccaaaaagagcauugaaacuaaauccaaaaacaagaaagaaaaaaggucuacaugcaugggaagcaccaauucucaagcagaugcuaguguaucuaugugcacagcugcacugacaagaauagccaaaauuuugcucagcucauagcuaaguagacaagcagaaugugguauauccauaaaauaaaagauuauuuggccuuaaggaggcaaaugcuuacacauguaccacauagaccuuaugcuaaaugaaacaagccaguaccaaaaacauaaauacuauauuacuucaccuacacaaaacauuucaauauccacuaaaguagaaacaaaacuucuaguucuuuggaaaguuauuuaugccaaauguuguuuuucugguacacacaagugaaaggaugucuugcuaaagcaaacacaugaaggacuguuuuccugaagcaaacacgggugaaaggauguuuggauauagugaaaggacacuugaugaaggaguauaaauaugaccccacagacagugggggaugaccacugagcauugguuugguuugcucuaucuugcuauucuuugcuaaagacaggcauguauugguuagccuuaaauagcauuguugagcucaacuugugauaaugccgccauugagagaaacucgguuucuuuaggauucaacuacaguugccuggugucugcuugcugaaagaacuagacuguaggugcuaguucaugccuagggucugccuggcuggaggauuggucuacagcugcugaauuguauuugguguuugcuacaagacuaaacuguugccaaaagaagagcaagcucacccccccccaacccccaagaacuauugcugaacagguccacauuccccauauccuaauaauuuuucuuucccacuuccucugcuggguaguaggcuagaggagggauugaaaccuuauuaaaaguagguugcaaaaaauguaugccuacaauccacagagacaaacaguagaaagugguuaagagggaccaggggagguagaaaggagcugccaguguuucauggguacaagacuucacuuggaaaauauuuuggagauggaaaguggggauggucacacagcaaugugaauauacauccuuccacuaaaguuaacagaaugauaaaugguauguuuaugcauuuccuauaaugaauugacuuaaaggaaagcacaaaaaugcuccagggggcucagacucucagcaacaaugacgaauccugugugugcaaauuauaagaugagaagauuugaugcuuaaucuuggcuaucuauuugacuggaucugggaccaauacuggacaggccucuggaaaaaagggucugagaggggaucucguggaaggauuuauugaggaggaagacccuccaccaauguuagcaccuuuucuucagacuucuuuauagcugggcugccuacuccaaggaaagcucuuucuccacugaucuccacacaugcaccacagcacaguggaugcccgaguacauacacacacacacacacacacacacccuacaaguaaaacuuuuuuaaaaaauuguguguguguguguguguguguguguguguguguguguguaugaugaagcaaaauauuuuggguguuggguuuuuucuguauuugcauuuaugugugguaugcacauauguauguuuaagcggguagaggaucgagguuagagcauugaagauaaauuccucacuuaauucaguccucacuauuuaagcaacuagcuagcuugcuucugagacucccugugcuugcccgccccgccccaucugcacccuaggauuauaggcauaugucuuuuacuugaguucugaggaccuguccuucauguccucaugcuugcugggcaaauacuucauuuauugggcccucucaacaacccagaauaaauuuuaauacauauauucuuuuguuuuucaagugugguaaauccaaaaaauaggagacaacugccacugagaucaaaaacagggcucucaguguaauucaggggaaaacacuugccugaccugagacuaagagagccucuggauuugauuucuagugcuacugaaugaaugaaugaaugaaugaaugaaugaaugaaugaaucaugugauuagacaguuuuuaacuaggagcgacucucaagaggaggaugcccacugccccacgccauagagguccaagagggaccuuugucaauucccuauagccagagaagauuaguagagcaaaucaguuuaguggucuguguguccgcaggccccagacauauggcccacagcuauuuuuguagugccugaccugagguaaugaagggagccuaaugaagguggccagggaugaacucaaauccugucugcauuccaaaagcaugcuuucaaaagagcuauuugcucucuaagaacuauugagcccuggaaaaggcaguuccuauuaagcccagcaaugucccagaugucccagaaucaguagcaaacugaaaagacacggcuaaugcaggacugguacacuaagaugacacugcauuaagaugaacauuaagaugucacugcaggcaggaggugggaauggagcuggguauuacauacauguacuugcacucagaucugccaucuucaagccuugcugcauuaggaaguuauuugcuacucugcacugccagauaauucacugauaaaucagugaaaaaggaaacugaaaggggaaaauaggaaacauggagguugauggugggaguggugaaugcaaacacaggguaaggaaacccaccugcacacacuaucaacuacacucuguacaagaacgacuugcugguccuaagcacauaccugcaaugcagacuguagagggcauccaugcuggccuugauacaugcuggccuugagaacuugagaacauaccacuaacuacagacaaacuguacaggaggaaccugcuggccccauagcacauguacacacacacauacacacauacacauacacccuaauuacaaaguaaaaucaucagaucucaacuaugaaucagaauuuucuauaccaaagaaaugauugggaagggaggggggggggaaagcaaguaagagagaaagaaaaagagaagauaagagagagggagggagggagggagggagggagggagggagggagggagggagggauagggauagaugauaggaauaggcaguguuuaccuaacacauuuugagauccugaguucaauccucagcauaugaccccacacacaacaaauuauaaauaaaaaauuguucagugagaguaauaaugagaaacagaagccaagaaaaaucucacauaucugucacagaaaaaaagguguaaaaaaaauaaugacagcaauaaccauuauaauauaaaauguuauuacuuacuuuucuacaaaagagauccgaggggcaagacguaugcaauaaaaucgcaguguuuaauaaaagcacuauuguuuacuaaauaaaccccacauauauaaucuuaaagacuguucaggagagaccaguuaugcagugguuuccccucauucuguguaggaucuuuucacucuguugacuguuuauuuugcuguguggaagcuuuugcauuuaauacagcccgauuuguucauuuuuuacuucuguugccuuguuuugggagcuauuaccaaaagauccuugcccaaacccacauccugaacuguuuccucugaguauuaucuacauaagacauucagagaaaaguugccuucuguguaaaauaacaaguuuguucaggguacaucccguggcagccccugggagcaacugccuccucuagguggcccacucucuuccugcacuaucuuacucaaauugcucugaguuccccuaguuagcacauuuucugagccacugagugcuggaggggacucaaguauaagaagucugguauucugucacagaagugacauugggcuucuugguuuugggggauuugggguuuuuuuuuucaaccaacaggaaaagaccguagcagaguguguugcaaucuccacaaaguaugacugaaacuucgagagaacagcucagagaaggauucggccacacccucuggcuuggcaauagucagaagucuccaaacgguccuuccaugugcuuaggagucuggagaauuggauggacuacagaacaagugcuggugucugguugaagcagaccagagagcucauguccuccucccuccugagucacaguggcucacuaggccagcuggccagcuugccuaaugugagcagucaugggagaggcauguggaaauagagacaggauacaauugucaagcucaccucuuggcuucaccugagguaaaucaaugucgcugagugaccggauaccagacuuaauaacuuagucgucuccagcacacagugacucagaaaaucugcuaacacacggaacucaguacaagguucccuaagagucauaaugugacaaacgguccuaccaggaaccaaaacauaacuucugaaugcguguucuuaacaauuauuagaaguacaaacacaaaaugcuuaacaauagugaaaucaggcgggcauguagcgcagcuguuauguauguaccaagguuugguccucugcacagcaaggaauaaaaaaaacaguaauagcuggaccuagucacauacaucuguaauggcagcucucagaaguagagaaaaagaaucaagaggccagcuaguacaacacagaaagaccuggugucaaacaagcaaacaaacaaacaagcgcccugagaacuacagaauacccagagcgagaccuugucucaaaaaaaaaaaaaaaaaaaggcaaagcaaaagaaucaaacgaagcaaagcuuuuugaaugacuccauucaaauaugacacauuaggauuccugccauuucauuaacuccucugguguggaauuccuuuagaggcugugauuucucccagaggaauacugucugguuagggaagaaaagcagacuggggaguuucauuguggggcuuggucacucagcccaccccugcaaagcuguucuuaccccgaggacuuucuaggaaagcccuacaguucccacaagccugaugcugaaguacaaauaaggccugcccucugagugcuggcaucugcuuauuauggaaaaggccucagguccccagaggacccguguauuccaugaggcuucccacagcaucuuggugacgaagcucccucccugcaaggcugguccugauuuauaucccuuuaagaaacuagagacuuauguuuuugaguuuucauuuuuauaauuauuuguaggcagaaaaugauuauuuuucagaaucagaagagauaggagaaaaccaacagguaagcuuccucugaccuacacacacccacacacacacacacacacacacacacacacgcacgcacgcacacacgcacacacacacacauuuagaaagaccauuucaaaggcaccauuaaaugagucagugaauuaaaaucacuuuauguuugaaaaaaaaaaagcaauuaggcugaggcagacagauuacagccuugacuacauagugaguucaaaguccuccagggcuaaauaagugagacucuuaagacaaacaaacaaaaaccaagguauauuuacaaaccaagucaucauauacguaacacuguuaaacuguuaauucaaacagugccuugcuuuuacguuuucaaaaagauuuuaugugcaguccccacuguuauaccugggauugugugcagucuucaaagucacccuaggauuacaugcaguccccacagucauccugacauuaugugcuguccauacucuacuguguugcucaauaaagcuacacaagcuaaugguagcuuugucuuggcuggaagaacaucuagaccacauugaagaccggucauacugugauguaaagguuuugguaaaacaaaaauugcaguauggaacuaaccaauacacccccggagcucgugucucuagcugcauaugaaucagaagauggccuaguuggccaucaauggaaagagaggcccauuggucgugcaaacuuuauaugccucaguacaggggaacgccagggccaggaagugggagugggugcguaggggagugggugggggagugugugggggacuuuugggauagcauuggaaauguaaaugaaauaaauacccaauaaaaaaaagucaaaaauuaaacuacaauaaaugcuuugcuauauuuaucccccuccccccaaaaaaaugcaguaugucuacaaagaggugcauugggcauaagggcaccugccugucagaugaucuguacccuuucaguguucagggccuuauuccucacaagacauggaggggcuuccaucugcuuagacaguaguacuccucagguuaaaaugaggagagugauuguaaaacgcugcaucuguccagcaccuacccgcuggcaggaguucugcuuuauagagauuuuaauuaucccuggcuaauuuaaaguauauaaaagaauuccuuauaagcauguaaaaacaacuuggucugagaaguauuucaaaacauaauuaucuccaguggaagaacagccagagaauuuguauggggcaauguauaugaacuuuacuucugcaaaugcaauccaaguaaacuuagaaggcuaaggauguucuaaaaauguagaaaucaaaauagcaucugcgauuuuuccuguaaguuauuucacucugcuauauauagcaaggaggucuugaacaaacaagccuucuggguuccccuguuccaggaacccagcaggaagaagcuggccaccacgaacucugaagggcaaagagccugcaggucccaccaucucagucucccacagccaaggaauccagauguguggcuaagccuugccuucagaauguucuuucaaaaaugcuuuuuaauaccugcccaaaugauguucagaagugggacuaugucaaacagaacaagaauaucauauugcggggguggguggguaugggggacuuuugguauagcauuggaaauguaaaugagcuaaauaccuaauaaaaaauggaaaaaaaauaucauauugcgcaguuguggcucaugagcaucaagucacaggaacuauggaagucacugugauagcuaaauauauggcugcacaccuaauaguguugacccucuaagaugagaccaccugaacacucucgucaggaaagacacaauccgcagagguugauagucacuauaaugaauuaugggcucaagccaguccaugggagcuucaucuauaaaagaaauacauuagaaauaacaaggccaucuaugaauccagucaccaaguagaaaauauauaagacaagccugaaauaaagaccaaaggagaugaucgggguuauaucagaaggcuuuugaagucaagucaaauguuuucuacugacuaaagaguaucaguuacgaaaauaucuucagggcagggaaggcaaauagcuaggcaucaaguuguuugccuaccauauacaaagcccugaguuuaacuugaaacauacaaugauagauaaauagguagguagauugauagauagauagacagagauagaugaucgauugaucuuuacuuaaaccaacuaccuacuuuaagucucuaaauuuauaauaauaaauguuuaaaugaaauagugccuagaaaaguggcugacugcaaacugaagcaagcauuguuggugggagugcaaaccacuccaguaauuaaggaaaucagucuggaguuuuuugaaaacuagaaguaagucuaccacaugauucagccauauaccuaaaagaugcuauauucucuuuauccauguucauucuucucuauucacgauagccagggaauggaaacagacuagaugcuccucagcugauaaacagauaguuaaagugugguacauaucacaauguuauacuauuuagcuguuaagaaaaaagauguuauguaauucuagagaugaauggguggagcuggaaucagugaaucagagugaaguaacccugacccagaaagacuaacaucguauauucucuaucauagguggaugcuagcuuucaaccuuuggauaugugaauaccuaaauuaugaguacacacagaacucaggagacaaguaagagacaguagguagguaguuuuuaagagagaguugagggcuggagagauggcucagugguuaagagugcucuuccaaaaguucugaguucaaaucccagcaaccacaugguggcucacaaccacccguaaugagaucugacuccuucuucuauaucuaaagacagcuacaguguguuguauacauaagauaaauaaauaacuaggagagagagagagagagagagagagagagagagagagagagagagagagagagaggauugauagaaggcagcuggcaugaagggggaaugggaacuaauaaaggguuaaguagguuggaggaugggaggaaaggggaaagagacgauagggccagaaaacuaacacugaagacguuugaaaaacucaaauggaagcauucuacacacacacacacacacacacacacacacacacacacacacgcacacacacacacgcacacgggguuuaagugaaguuacucuauaauuugggggggggacuuuaauucucccagauaccaugggcuagcaaauaaaaagccaaaugucaggaauuacuucuuuucauuuuguuugucagugacauucaauggaucccaaacuauaggcuguugccauugcucugaauuauccugcagaacuugaugguaagccccuacucugaaaaauaccacacauucaagccagagaguauggugaaaucaggcucguacugaacugcaagcuucaugccuacuggcuagcuuucacaguccuagaaggcauuaugcucacuuaccuaucuuuaagcuguaauaagaaccagccuggcaaaacaugucaucuggugcaauaguggcaugaauauuacgggaacaaccaacaauuuuaugauuggauuuacagcccacuccacaaggucaacuuauuccagcuacuacuaauagugccaagaaucugaggccaggcaucucauagacuucaaggaagagccuacuguucuuauucugcuaaaucaacauaguauuaaacagacucccaaugacuuguguagcaauagauuagugugucucucaacccucaucagggaagcuucuuuuuaccguagauggugauucacacagaggcccagaacucaucaacaugcaaagaguaagagauuguagaguguuccgcagaacgugagacacaugaaucacauacuccuccucucauugagguggguagaaugauugugacugcugugcaugacuacuacacagaaacagugcuuuccaguuacaacagagcaguugcacauauuaauugugacaaugguugugauagcacacaugauaucaaagccagauaaaaucccugcauagaaagaggcagcggcaagguguugcacccuuagaugaggagccguuggcaagagacggcaguuuggaaagguaguuuucuucaggaaaauaucuccugaagaugccauggaugcucuagcaaaugucccuacagucaugcacauacuggugauagcaguaaguggauccugugggaggagugguagacaagggguaaagaguuggaggagagggaaugggaguuggaugcuuguauggaauucucauucaauaaaauaaagccaaaacauauuguaaagagugccucuaucuugcauguggaggagauauggccuugcugggaggaaauaugccacaggagguaacgucugaauuuagcgucuuaccccaagagaguuuguucuccucucuuugcuucauucuuacagcuaaagaugugaucucccagcuuucugucccugccaccauggccgcugcuugcugccaugccucuacccugccaugauggucucuuacugcucuggaaccuuaagccaaaauaaacauucucuuaaguuguuuuggggcauuguguuuucccacagcaacaggaaagaaaugacauauuauggaucuaaaagaauucccaaaacuaaguacuuacucccuccucccacacaucauccugucaggaaaggcauagugaaaugaauaguguaucacaaagaaaaaaauauauaaaugaucaauaaacaguugagaagcacacaguauguuuacaaaucagggagacaccaacuauaguugcugugagaguccaaccucuccguggucaggauggcugucaucaccaaaaagaauggcaucaaaugcugcuuagcauuugaaauaaaagaaacuuuauauacugcuggggcgggggagggggauagaagugauaacuagugcagccacuguacacagcaacaugcaggucccacaaaagccugaaaaaugagcuccugugcuaucuccagcuacccacucuuagguguauauuuaaaggauccuaagacaacaaacagauaccugcacauccauguuuacucacaaaaccaaaacacaggagccuagauguuccucaauaaaugaauggauaacaaaaauguggugugcaauacuuagcuguaaaggagagugaaauuggaacacuggaaaggauggaucuacaggggaagauggugaaagaacaagaggccuauggaauacauacagcaugaaagcuaggacuauuuagggagaggagagagaccagcaaaaggaagggagagaggaugugagacuggaaacaaaaauagaacaaagacuagccaggcagggguggcucauaccuuuaaucucaguacucaggagacagaggcaagcagaucucugcauuccaaaccagccugaccuacaaagugccaggagagccaggguuaaacacaugaagggagcaggggugggaguggggugagggugggggugagaguggggguagacauaguuuaauuaauguuuugaagcuggaaauagagcucucugauggagugcccagcaccaggggaaaaaaucaaauucauagcuuuacucagacaccagcuuccauuuugagccuuuguaguaaaacuggaggaaugggaaaauggugacaugagcucaaagugaggaagaggcucagcaacagaguaagcccugguaucaauacucggcauuacacagggagacuuggaggggaguaaaugaacuguacacaagaauucugcacuguuuuuauaacuugccuaugugucaaaaauuaucucaaaacaaaguuagcaaacacagcaagcuaacuguuucucauaggaagacaaaagagagaccaccagcaagcacuucuggcuuucugcuguguuuuguuguguuucuauuugagcuguacaaaguaagaaccauucccaccuuccagcauuucaggaggugcagggaaggcccccaagcauugccuugucacaaaacaaggaaacagcaugugucucuaaauaaaguggagauaccaccuguuaguaccaggacucuccaagcccuggccucacuaugugacccuugaccugcauugccaggccaacacccucaaucccacaacccacuuggcucaguuccuaccaucacugguguaaugucauuuucuguauaaauuaggggaucgcccccucuucucucuuucuuucuucucuuucuucucucccccucuuucuuuuuccucuucucugcccuucuacccgcuucgccgccccucuacgucuguacaauaaaccucuaccacguggaacaaccuuggccuggucugcuguuugguuuuuccgccauauauauauauauagcuugauauuaauuaauucauaaaaccaccuaugaacauaguuuuggccaaagcaaauuuaaaccuaagccugaugaaguucuaaggaaaugucuagacacaugguaagaaagcuacaggugucaccagcaagccacaggcccuauagcacaaauagcccaauugcugaaaguaaauucuaaagccaaaccaagagaaaugggcaggaaaaggauuauaauggcaauuuacauauugaaagaggucuaaaaauuuaccagcuaauugcaacaaauagacuuuauguggaucagauucaaacauacagauugaaaaacgaauccacuuaagaccuguggauauucaaaaacugggcuauuuaauaauuuaaagaacuuaagaguuuuaggauugaugaugguacuuuuagguucauuuacuacaacuggucagguucuuauuuuuaaagcaucuacagaugaaauuuugcaaugacugauaguugcuucaaaauaaguugagggugauauggagaacuaugcuuaugagaccaccuuguacuacacagagagacccugucucagaaaacugagaaggugagaacauagacaaaacaacucuggccauaacacagaggcuucacaagccauugagacuuugggcccacauccuucuuuucccgcuaacacuauuucccugaguaacacuagaguuguaaacagcuuugccacuccuuaggaguccaauuaccauaugaaaggugaaagaaccugggcuuuccccaggcccauuaaaacaaagcugccuccucccagucaaaagaauacaaugccagugcuaccucagggccccaaaacuacacacuaaggucucuuuuuuuuuuuuaaaguaaaaucaggcagguaugcuggugggagagaccucaacucaggaacucaaagcucuguagaagaagagaggagcucaccaggaaagagacaggaagguagggacacagagggagaagagcaguaggaagucaggauacagagcaaggcacuguggaaggagagaagaacaaaugcuuaggagagagucacauucucagcucuacugaaacaaccacccaggaagaucagugagcacaaguuagaagcugcccuggcucccugaagcaacugagaauaaaaguaaugaagcagggcaauuuccauagauagauagacagacagacagacagacagacagacagacagacagacagacaugacugaggucacacagcagacugaagacaaagucaagcacagaaguguaucucaguuguagaacacuuagaauguguaaaacuagguuuaauccccuguagcaggaaaaaaaaagauaacucagauaagauguagggaaguaagugaugacuuagguaggguuuguauaagaagggaugucgaaccuagcaccagggcuccaugcacaguggggcucauuuaugauauacuccucagucacuguugccuagggagguuugucuauggagaucuguugccuacagcugaagggaugagaaugcugguucuaguguguuagauugauuuuaaaagacagcuguuuaaagacaggaguaggaaagaaagaggcuuagccugaccuuacucauacugaaggggcaucuuaucgcccacaagugcaggugaccacaacacacacaagagaaggucccuuauauggggcagaaaagccuucuguaguccacaaaggaugcuaagaaguguaguccuucagcaggaaacuaucauuccuuaaucugagaggguagacaagcguggagaggcuaacuuuuauugcuauuauauaguuuucuguuaucucccaucauagaguauccuguguauguugucaaaguuaagucuaaaugaguguuaacauucugucuaagcuccacccacaguuaccuggcgacaggcaagcuccaccucacaguuaccuggcaacagccagguaugcuccgccccacaguuaccuggcaacagccagguaggccugacccacuauaaaaagggcugcuugccccuuccucgcucucuugcuuucucuuguucuugcuuuuccuugccccugucucccaaucccuuuaccccucuccaugggcucauggcuggccucuacuccucuacuccccuacucucucugucuuucucugccucuacaacacuuuugauuccccucuccaugcucugaauaaacucuauucuauacuauauuguccugugacuggucccuuggggggggaaggaaugccucagcaugggcccacuaaggcaacuccuuccuccacaccucaccacaccuccauagaacauaucccccaggaaaguccugggcucaggcaguucuuggaccuauccuuccagaguacauugcaugauagcuucauuacaggacaaagaggcacgggaauaagaucugccagaaguuggcugcuucugccucugaugcauaggucguguaggccaaagcaggggagaaaaagaccaaaaauaaaaccuccuuaucuaaagacgaauuacaugccaugucucacaugacagagggguggauucucuggcccaguggaggaucucagauucugcacccacacuguaaaugccucaaacaacagagaggcaaauagcaaugacucugcucucaguauuucccaaauugacauaaagggaugcugugaccagggcagccuuguaccuaagccuaccaccuaacuaacaugagaccacaugauaguucaauuugucaugcucuuuacccuggcauucaguucuuccucuuaagaaaagcuaauuucagggacaauaaccuaaccauccaaggccccucauuaaaggagaaucccaaauacuuggucaucaaacucacaguuuuggaaaauccuucagaauaccaaaauaguaucuuugacaguuuuauuuguagaauaacauaugauccaaguaguacaaagaguuuggcaaugaugcuauggauguuuucuaaaacauuccaaaagccaauacuaauuuaauuuuguuauuuugcuuuacaaauuaugccucuaaacaggcagucuaauuuuaagcaggaagguauuaagaaauacgcuuacuguugucaggacaugaagaccuaaagauuugccuguagacaaaaggaguaaagaguuggcuuuagccuucuuuguuaauucaaucuguaagguaaauucuuuauuacagacguuauaugacugauuguuuucaucuguuggccgaguguauggaaugggaagguagauuuuuaaaaaagguucucuuagugggcuuaguuuugaaaauuuuuguaaaguaaauaauuuacucuucacaugguagccacugacuuggguagugacuugggaugcucuaggauguucacugguucuaaagcugugaguuucaaucccuuggggaucgaaugaccuuucacaggggucauauaucagauauucuccauguuaaauauuuacauuacaauuccuagaaaguagcgaacuuacaauuaugaaguagcaaugaaauaauuuucugguugggagucaccauaauauaagguguauuaaggguuauggcauuaagggaguugagaaccacuguucuagaguguucucgaaaaguaacuguugaggaaaaagcaaggcagucacuaucucugggaguauacuuuuaaaauggaaauugaaaauaauuucuuuugggagaauacaacuuaaaauuacauuaacucuuuucacagcuugacauauaaaauguauuuacuauauaaccuuggguuuaacaauuugaugauagcaaaauauguauugccauguuuucaaauacuaugguaugguaugaucauuuaaggugacaguuccaaauuuuaaaauauuuagcuuaucaaauugugucugguuuuguucauuaaauaauagcugguauuguuaauauuuaauaauauuuaaaacaaauauacaaaguucaucauaugggaaagcaaaaaauaccacuuaaccauuguugugguaugaauagauauggcccccagacucauauguuuaagucuuggcccauaggaaguguuguuauuaggagguaguaccuuguugaguagguguguccuuauuagagaaagugugucacuguggggacaggcuuugaggucuccuauguucaagcuaggcccagucuggcauacaauuucuuucugcugccuaugaaucaagauguagaacucucagcuucuccagcaccaugucagacuggaaugcuucccaccauaacugaaccucugaaacugcaagccagccccaauuaaauguuuuccuuuguaagaaaugcucuggucauguugucucuucacggcacuaaaauccuaacuaagacagacacuuucuauucagauucauuccuuggaugcugacuuuauuuacaaagcuuccaaagagcuuguuucuuguuccuuacuuacaggagucugauguuaacaaacagcuaauuauagaacuuguauagaacuuggguauaaggucaauuguacaaccgauuuuaacucauguuaaucuugauguaaacauuuuucucauauaaccuugucucuuaauauuccccacaaaguuguacaguuauuaucuccugauuuauguucuauaucucugucaacuauuaaguuuuaucauaaccccuugcauggacccuccucugagacacucuuaauugcugcuucccuuaucacccuacugucacccuugaaacaguuaccaagagauaaaacaguucggugaccacuaaaaagggccuaaugaggcauggucaggccaacucauugcucuucuugccacucuagacauugauuuggggacucagaaugacaacagcuagacuggagccuuuuuugcauagauuaaccucucugucucacuagcucagaucagcuuaacauccuucaggaccaccuugacuccuugucugauacaguacuccgaaaguaaaaggcacuauauccaacuacugcuaaggaugggaaucuauguccuccucaaacauugcugcuuccgggccagcaaacccugguuugaaauggaaucuaaagacacaggaaccaggcaagaauuacucuggcacccucccacucugucuuucuccuuauuauccucauaccuaugauuuuacccugucuuuuaaauguuucccuucggaacuucacucucuacccaaagaaaauguaccauauaagcucucccaauaccuaucucccuacaaaagauccauauauuccuaaaauaucugaaaaaaaaagaccuuuuagaugcgguggcaacacucuggcuaaaaggaaccuucauccuuuuacccugucaauuuuuuacacuagcccucuauuuucuccucugaugcuuuguagcucccugcuacuucugcuagcucauuuugguggaacaauccugccaaugggaucagucacugucacccugaaucaacucuaugaacacucucucucuccucuauucuucccuaucccuccaacuucccaggaaaucucugauucuguaagcaaaccaucugcuugggggccucucauaacuauuuccagggucucuuuaggaauggaggaugaaaaucaccugauccagcauagccaaucaaguuaagacacacccccagcuacaugaccagaggacucugagguacccacucuaacaaagacucucuucaucagaaagcaguuauaacaccccuguccugcauuucuuuauauccucucauaguuagaaauguugguuuacugcugaaggucuauacuucagcuucucuugcagacuacggaagucacuuucaccccauaagaggccaccucccaccuucccuuggagacauuuuggccaucucauacaugagugacaagaugcccaucuuugugaauaaacaucguccuaccuagggucaggcaaaaccucuuuuuucuuuucuuucuuucuuuucuuucuuucuuucuuucuuucuuucuuucuuucuuucuuccuuccuuccuuccuuccuuccuuccuuccuuucuuucuuucuuucuuucuuucuuucuuucuuucucuuuuucuuucuuucugacuugucuauccacagcuguguccuuuugauaagcuacacugaucaccguccagacaauaguuaaaggguggguucuucuguuccuuuaccgcacagccaacccuccauaccugcagguuacacaucuaagggcccaaccaaccuagaauuaagccuaaacaaugcaaaagaacaacuccuuacauaguauuuccaauguauuaagucaucuagaguugauuuaaaguaaccaggguauguguguguaugugagagagagagaguuugaugcaaagaucuacacucuucacauaagguauugaagcauacuugguaauugguacccacauaaucccuguuggacacuucaucuguagauugcuaucagcuauacauugcugggacucuugcccuggacuccuaccagaacauacgcuaaugugggcuaucccgcucucucaaccccugucccagagacagauauuucucaagcccauuaaguguggcucaggggaucucccuaaauagagucugcaauccaguagaggauaaaacguguucagaacauagacagugacugcuuaaaaggcauagccuaggaagcugcacuccuggcaagcacuauagaggauccucggcgcaaggagcucaagagcccugugacugggcagcagaaauacaaaaugccauaugaagagugacaugucauuaauucaccuucaaggacaaggaccuggguaagggcuuuuaugcuuugagcucaaaguauuggcucucacccaucgucccagcuacucaaugacugaggcagauggguuacuugagcccagaagucagagcaagccugggcaccagacuaagauuacacaucucaaacacagagagagagugagacacauacacagagagagagagagagagagagagagagagagagagagagagagagagagagagaaagagagagugagagagagggagagagaaagagagagagagagagggauggagagagagagagaaagaaagagagagagaacagaucugauugaauaaauaccucauuugcacuguaacugaaacauggcaccuggaauaggcacaagagaagacagacuuccacauuuuacaguagccuguggcuuccugugcuuaccaagguacuagucagagugaccuaaccgaggucucuuccugagcccacugaauucggugacccaugagucaagguucauauccgucuucacuccauaugccuuauaauucauucuuggucucccuaugcccuggcccaugugcuacuccauuuccaccaucacugaucugcagcacccacagccucugcacaucucuggucacaucccucucugguccuuacauggcaacuccagauccuuaccuaucuucuucucuaagagguguuuccuaguaaucacucugcuucucaggauuaagagcccagccuagggccucgcucagggcccuaacagcagcccuggauggaacucagcuuccuccuccuuucacacaaagggcccgauaauaucaaucccaaacuucacagaauggaagaauuugaccugucuucccauaacaaggaagagaaguggggcauaagccuacagcucuucccacaguacggaagugauaaaggagggggggaggggacuucugcauuggaaugaugaaaggucaaagauggagguaagauaccugagguaaggcuccacauacacauaccaucucucucaagcccacaaacuacccaguuccuucccuggaggagaaggaaaacuuccaagggaaacuaagaaauuaacuuagaggcagggaguauggggaauaucauaggccucuuugaaggcuguacuaaaugcucaggaaccaacuggaaaccugaacuucaguagauguggguuuacaaugucaguucucugccucuguuuucucauccacagaauggggcggcaaaugacaaaugggccacacucugccaacagaaaauaaacuauuuccuaaagcuaaaguauuuuugaaaaggaggcuacuggaauggcaggcuggauagaagugggaaauacacauucccagaugcagagacuuguuagagccccaccuugacgugugcagaggacagacacacgguugccuagaguuggagacacugagggcuuuguaugaagauuccacacuggcuugcugaggcuucuggugcacaggauucaggaaauuccauagcccuucccauccacgucaucaugucuggugacuagccaaugagcgccucuccagagcaagcaccgggccuuacgcaaaugugggccaucacauaagcaucacaucuuugcuauuucauacucauuccugggccuauucccaaaucugcuaagccuaacacauugaagaugugauacuuuagaaaaaaaaaaaaagugccagugguucuuacaaaaagucuaaaaaccgcaagcauaggaaugugagaaaccuguuugaggcucagaccacucugcaguagcuacaaguuacuuaaccucucagaaccuuaacacugcucaggcagucaaaacauucaaguugaccuaggcaacacaacauggacccauaucaaaaacaaaacagaaaacucucguauagagaaaaggauguccaguccucuaaguuaucccaagggauaaguucaacaucaucacucauauguucaaggcucaacuugccacugaaaagcagggcuucuuaggguguuuucaggcauggugaaaacugaacaugagcuggggcagugguggcgcacaccuuuaaucccagcacucgggaggcagaggcaggcggauuucugaguucgaggccagccuggucuacaaaguaaguuccaggacagccaggacuauacagagaaacccagucucgaaaaaagaaaaaaaaaaaaaaaacugaacaugaagaauaucauccaacuaggaagccauguccaacaagguaagccagagacaaacaaugaacugaacuacaaaugauggccaagacaucauuuucuucaggggugcuccagcugaugaacagagagcuccaaaggugaucuaccuccauguggauauccagguggggaauaaagggagaaaguucaccaggaaacccuggcucacaucagagccuugggguucugagagaugacuuccaucagaaggaaguaacucucaggucaccaaccugggaagcagccccucaaggucucuuuuccacuggaaacaaguuuuggccagagggggauagugguggcccacacccuuaaccccagcacucaggaggcagaggaagguagaucucugaauuagaagccagccuggccuacugagugaguugugggucagacaggguuacauaaagaaauugucucagaaaacaaaacaaaaaacaaaaaacaaaaaaaaaaagaagaagaaggaaggagaagcugcuggucccugugguugaauuagggaaaaccuggaagaagcugaggaagagggcuacccuguaggaggacuagaagucccaauuucccaauuaacuuggacccccgagaucuuucagacacuggaccaccaaccaggcagccuacaccagcugauaugaggcccccaacacauauacagcagaggacugcugggucuggguucaaucagaaaagaugcacuuaacccucaagagacuggaaggccccaugaaauuuagaggucugguggggugagggguggggacauccuuguggagaaagggugggagaagguaugggauguggaaaagucgaaggguaaccaggaggggaauaaaaucuggagugaaaaauaaauuaauuaacuaauuaauuuuaaaaagaacuaaugaaagagaaaaagagagagaaggaaagaaagagaaaggaaaaagaggggggguggaaggaaggaaggaaggaaggaaggaaggaaggaaagaaggaaggaaggaaaagauggcucguggcaugucccagcacuggggaaacuaaggaaggaagcucaucacuaggucaucacccugagcuacauugagauccuaucucaaaaacacugcagcaagguggagaaagaagaagccuaagaaaaggagaggcaaaggaggacagagggagagagaggggcaccggcagggucagggagaaggagcaaggagacuaaaaaaugguacccagacuguggcgggaucauagcuaacuuaaauggauggacuguuguuuuugccugaccuucaaucuaaucugugcccgaugaaucagaacuuuuugucccaaaacaucuauuaucuaagaccaagcuauaaauuccuguguguuaaaugccauggugacuuggccaaggauugaggccaggacuucaggugaucauauucuaggcauaggguaagggcagauguggaugaaacuaaacacgugcaaccagaugccaaccauugguucguucuaguuuagaaauuaaguuuagugcuaaucuggaacaggggaccugugugcaccccugcaucuuugaggaugaaugauuuucaccuggcccaggcuacuccgcgggccauccuggacucgugcaagucacacucaacacccuuuuuucggaugcucaguuuggcucaccugcugaagacaaggcagcccaggugguugauuucaugguccgagcggugucggcuguaguccucccacaggucuuugauggcugugaccgccagaaugaagagcacaggcgccagugccaggcccggcuggaaggcguucacagccggcacaaaguugagcagcgcgaugaagacgaaguacacauuggcuaggcgguggaacugcucgaagagauucuugggcaagaaggacagcagcguguacuugguggucuugaggcgguugucggccaggugcuggaugcagccgcgcaucagcagccgcucgcccuugggggcuccgaucguggaguccucggugcccagaggcgguagcagguuggagcgcaccgugcgcguccugcccucccagcgccuucuucgcggccgccgccaucccgaggaugcggacucuucggccgccgggagcucccgcuccauggccgcgugucgccgcgcccggcuccucugccgcucgcgccagccuccuaggugaucaucgcccgccgcccgggcgcggcagcgcggacuccccuccugcgggacgcacagacaccacagucagcgugccgagccccgcccagcccgcgcagccuguccagacuuccaggucuacuaguccccgcgggcaggaggucgcgggccggcucggcgcucuuccccucgcaguccccucccgccacccaggcggccugggcgguuuccgccgagguggcuccucugccccgcccucacucagcgcccagauucagauugggcggauagcgggaaacaaaaagagcccgcgcuggaaacuuuagagagcuuuacuuucguuucucugaggcauccaguuuagucccagagaguuugcaaacucacugugccacuaagagaggaagacugaguaucaguucgccccauccccuccuagcccgcgcgcucuaacuagagcagacagacuugauccaggaccaggaaauguugucuggagagcugguuuaggaccuccucaaggcugggucauuugaaguuaaacccagaauccuuaguauaccgauuuuccaguuuccaaauuauguuuugaaaagcgcauugccaccuaaguacucuccauaaagucacuauuucuguccccccccccaaaaaaaaacaaaacaaaaaaaaaaacaaaaaaacacccuacccuccagcuugcacuuacuuucagauauaauuuuuuggugaacuggaaauuuucuuuuucuagaauuaccuucaacauucuuuguuccccaaauaggacuuuuuuuuaaauuucuucauagaagagaagauuauaauauagauccaaagaaacauuugggucacuguuucccugccugguaaacaaggacugagauucccuagggcaguuuuguucuagagaucuagaaaaagacugggcagagagggagccugaugggcagcugagggaaugugagcaaaggguuccuuuccuguugaugggagagaggaguuuacauacauugaauauugggaaauugaaggugacuuuggaaggagcugggaagcauacuacaggugaaguaggggcccacaacuuccacuccgugugccucuuuacagauacagagaugagaaauggggauauuuguggucuaggagagcauggcuggcaaauaaaugagaaauaacuuugggguacuuuguguucagauuugaggaccuuagccucuuccuuuaacaggcuaguccuuccuuucucucccuaccucagcaccauuugcuagcuuuggguacuuccucugaggguccugaucuggcuuuacugaaaaaucacuugucuuuuccuaucccucuuuuuggguguccaaccuugugcuccuugguucacaugcuacccagcuauuggagguuaucauccuugaccaagcccauaguagucaauagaauccagcauuagaagaguaaaguaacagcuacggaaggaaggaaggaaggaaggaaggaaggaaggaaggaaggaaggaaggaaggaaggaaaggagggagggagggagggagggaagagagaaggaaugaaagggaagaggagaggagaggagaggagaggagaggagaggagaggggaagggaagggaagggaagagagagaagagaagagaagagaagagaagagaagagaagagaagagaagagaagagaagagaagagaagagaagagaaaauuucccucccuaucaaauauccacucccaguaagagguucaaauuugaagggugaaaccaagauaagaaaaacauugggcuaaagugucugcauuucccccaaaagaacucucaucucaggguugacaauccuaagccaaagauuaggagaaaauccagucuuuaacaccugacucugcuuucaacuccaucaucuaaccuaguggaguuccaggucggccaguuccuucauuccuuggcggucgcuugucuuuacagauauuccaggauugccccacagccuucaagucaguugacccccuuuuaagaucugugcuucauucaguccccacugucaauguagucacaugagcacuuuauuucauuuccuuacccucaagcuccuaggaaucccccguugcuuucaaagucaaaugcugacuccucaggcaaaggucccuugaggaccucggggaacuggcaccagaugcuuuaacucugcaccuucuagucccugccaaccccagggugagaggccuccuuacccuucucagaacagaccguguccccccgucuacauuccaugcuaagauuccaagauucugugagucacacuaccccaccagucuggaaucuucucucacauacucuuaaccaauccaaauucaguauuucuaguuggucuuagcucaucuuacacacacauacacgcaugcaugcaugcacauacacauguacacaaucccagguuuugugggacuuuugagcuuagauguugcccaccagacgaaugcauagacuuuaggcuuacuugacaagaaacaaggcugugacguagccuggccaaugcuugccccucaaaucucuguacuuuuuuaauggcaccuggguucuggguccuggguccugggaagaucacugaacccaucuuguccaguaagccucuuuucaucacugguauuuacccuggcauuguugugggcagcaggaaugagaaggaaaacuguccaagucaagaaacauacuuacagcacugagaucccagcaggaagagaaugcaacccacaguaaaucuugagaaccacucaagagucauaagugggacccuguagggguauaggagagguaagugagagggagucuacagggcauaaaaucuggaugaggcaaaaucugugguagaaccagggacaggagauuauucugcacaaaggccucagagaaggacagaucuagaauugaaaucgacgcagguaggauucugucugccauucauucagaaacccacaguccuuccuccuccccaagucugugcuggaguaugagaauaccccaugaacaucaccauaucccaguguagucaucccuagaaggaagacaugaacaugcuggagcacagagcacaggacacauaagcaugcagcugcugccuccguggaaagaagccaggaaggagacuuuccaacagcccuaaauacaagccugaccaaggcuaggagugaugcagaugucaaguauagguagucauaggagucuagguccagcagggagauguaugucuggagcuaaguaggggagcagaaacgugacaucacauagguauauaaauccuggugagaauuuugacuuuaauauuaagugcaaagggaggccuuucagcaaaaaaagcaugucauuggacucagguuugugacucaaggaccagaguagaagcaaagggggcaguauaguaagaagucacagccgggcagugguggagcaugccuuuaaucccucccagcacuugggaggcagagacagucggauuucugaauucaaggccagccuggucuacagaguguguucuaggacagcuagggcuacacagagaaacccugucuugaaaaacaaacaaacaaacaaaaagucacugcagggcagauaggggacaguggcucaggcaggugguuauguggaggugaaagggggcugcuuagggcaagaggauuuaauauuaguuaguauaucaaggaaagaacugcauauggccaagcggcugaaaguggagcugucaucugaugugucagguuggggcuguuguagcuuucaaaucuacugggaaagaccaaagacuuagucucaacucacauuuaaauugacugaaucuauccuuacuucgagcaggcuagcagccuuagagucaaucagcaugcugugcugaagggggcuaaaggaaggguucucaaagguggguaucaacgauguacauuacaguuaucuaugaaaucuacaccuggacaugaaaauuguuuuacuccccucagcuguuucucuuucccacaauauaguaauaaaaaguucacucgucccagucccacagcaauaagugaguguacaaaagcaaaaagcaagcuguuaaauaccucauagcacaaacaccauuaucccauucucaucucaccugcaggccccuagggucucacaagcauuccagggcaacagucaauagcucuuaagggaugacuagugccuuauuaaguugcuuuagccaucacaggggacuugcauguaaauuauuacacaggucugagcacucuaggggaaguaucucuaauaagugggauagaacaguuuauuugggagaaggcaauaacacaguaucaucagguuagagcugacugucacauucccacagggugaugccacaggaaccgagguagacaggaaggucaagucuaagaggagaguuaaccagucaauaugcaagaaagagugggagagagcagaguugucagcacgcaggguuucgcuacccuuugugagggacaggguuugaaucuauauuugcugcaguugcauagaagcaugggucccccaugacaaaagcaaaggacaagaggaaugguuuguccuuuuuuuaauagauagaggaugggugcuaagcacagcagggucagguaaggcaauaaauuaggaggcaguuuggaaguauaucagccugccccugucaaaagauuuuguauuccaagauucaaccuaccauagcuagaaaauauuuuggggaaaguagauuugcauugaacacauacagauauauuucuuuguuauuauucucugaacaauauagucaaacucuuuccauagcauaucagcaauauuggguauuagaaaaaaagucugugagugauuuaaaauaucggggcaugcaauauuuuguaauaacuacuagacauuuugaauauaacaguuuuaagaaucuagggcuuugguaucugcauaaagguagaagacuggggagcaggguuugugugugugugugauuuuuuuuaaauauuuuuuauuacauauuuuccucaauuacauuuccaaugcuaucccaaaagucccccauacccucccccccacuucccuacucacccauucccauuuuuuuggcccuggcguuccccuguacuggggcauauacaguuugcguguccaaugggccucucuuuccagugauugccgacuaggccaucuuuugauacauaugcagcuagagucaagagcuccagguuacugguuaguucauaauguuguuccaccuauaggguugcagaucccuuuagcuccuuggguacuuucucuagcuccucuauugggagcccugugauccauccaauagcugacugugagcauccacuuugcuaggccccggcauagucucacaagagacagcuacaucgggguccuuucaagaaaaucuugcuaguguaugcaauggugucagcguuuggaagcugauuaugggguggaucccuggauauggcagucucuagaugguccauccuuucgucucagcuccaaacuuugucucuguaacuccuuccauggguguuuuguucccaauucuaaggaggggcauaguguccacacuucagucuucauucuucuugaguuucauguguuuaggaaauuguaucuuauaucuuggguauccuagguuuugggcuaauauccacuuaucagugaguacauauugugugaguuccuuugugaauguguuaccucacucaggauggugcccuccagguccauccauuugccuaggaauuucauaaauucauucuuuuuaauagcugagcaguacuccauuguguagauguaccacauuuuuuguauccauuccucuguugagggacauuuggguucuuuccagcuucuggcuauuauaaauaaggcugcuaugaacauaguggagcauauguccuucuuaccgguugggacaucuuuuggauauaugcccaggagagguauugcuggauccuccgguaguacuauguccaguuuucugaggaaccaccagacugauuuccagagugguuguacaagccugcaaucccaccaacaauggaggaguguuccucuuucuccacauccuugacagcaucugcugucaccugaauuuuugaucuuagccauucugacuaaugugagguagaaucucaggguuguuuugauuugcauuucccugaugauuaaggauguugaacauucuuucaggugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaaguuuuggaguuucaugaggucccauuugucaauucucgaucuuacagcacaagccauugcuguucuauucaggaauuuuuucccugugcccauaucuucaaggcuuuucccaacuuucuucucuauaaguuucagugucucugguuuuaugugaaguuccuugauccacuuagauuugaccuuaguacaaggagauagguauggaucgauuugcauucuucuacaugauaacaaccaguugugccagcaccauuuguugaaaaugcugucuuucuuccacuggaugguuuuagcucccuugucaaagaucaagugaccauagguguguggguucauuucugggucuucaauuccauuccauuggucuacuugucugucacuauaccaguaccaugcaguuuuuaaucacaauugcucuguaguacagcuuuaggucuggcauggugauuccaccagagguucuuuuauccuugagaagaguuuuugcuauccuagguuuuuuguuauuccagauuaauuugcagauugggaacagguuuuaaaacuaguauccuacauauauggaaagaugacuauguauuauaaaauuauguuagcaaugaccuuuucauaaaaacugguaauccccacccccaccccaaaaguuccccugagaaagcuuaaaaucugagaaaguaggccugugcuauuuuggagcaguugggaaaauaaugagguagcaucuugaacagguauggccuguauccaagcuggagauuuacagguagcuccucuccaaacuagcuucuuauuagugucaucaaaucaucuucuacgguugucauacuacauucaaagcugcuagagcuguuaaucacagugaccuacagguucuagcaccauguuucccaaagacuucuuggcugauugucaugagaagccagguuuagucacaucuguucuacaucugcaaugagcuugagccuacauuccagucaagucacuggguuuucaagaacaccugacagcauaaaagaaacucgugcaagugggauuugcucuuuauuaguaaaggcgccaagaaaaggagcacauaccugcaaccgcuucacuguaaauauagauaggucaggaguucaaggcuagccugggcuuugaagcaaauucaagacaucagcuguguuagaccucaucuuuaaaaguccaaaacaaacaaaacaaacaaaauaaugugguugaagauagaauguucuccauagagagacuggguuucaaacaaaucauaugaaaaacaacaacaacaacaacaacaaaaaaaaaaaaacuuccaaaacccuagagaagcaaaaccagcagaauccaucuguguaugagaagggacagaauagaaccagcaugugacucugcaggcuaaggugguaaugcuucauccucaaacuagggaaacagggaagcaaagcucugcaggcaaagaacaaauaaagauaaaugagcaaaauuuaucuagaacuaggaauguaaccguauugugcguugacaaaagcuaagaacccaauugauacugaaagauugaaagaauguggauuagaaaaaccauuaagcacuguugguugggcacuguugguugaauugugaacccauggugcuaauguuugauauagcuuguucaaaaauuaaauccucaaaacucaauauucucauuccuaagaaaauguacaaaggaauuuuacacauaaauaacacacucauaguguauuuucaucauaaaaugaugugguuguuguauucagacaauggaaaaaaacauauaaaaugaauguuaacgagagacacaggcaacaaaauuugaugaaacccaacacuggacaaaagcacaacuuuuaagaaccuacaugcagggcauugcuauuuuuugagaucacagauauuacuagcaauaauaagaauauuguuaaucauacgugauaauuucucauaaagugugcuuacuuuacaauagaaccacugcacucuaggacacuuaccuuagauaaauuaaaauuuauaugcacacagcacaauagcucuauccaugguagucacagacuaggaacagaacaaauacuuccaacaggcuaauggcuagcacauccuggaauuaacuagucagcaauaaaagcaagcuauugaugcacagaacuuggaugggucucaagagaaugauacugaguggagaaaacucaucucuauaggcuacauguuauaugguuucacuaauacagcccuuugaaaccaacaaauaauaaagauaagaguagcaugcugauuacuggugaugaugaaaaagggagggauagaacaguuaaugguuuuaaaaggaaacuuacuccagaguauucugguguuagaguuguucuguauuuaauugggguagcugcagguagcuauaagacagacucauagaacacauacaucugcauguaugaugaccucuaaauaaagcugauggauuucauuaguuauuauuuaaacauauacuuacauuuuauaaacuuuagguaaaguuacauuuaacgaauauuuauauuaaaguuauauaaacauaugaccaauauacucaaauguaauaauaaaccugacauuucauuagucauuaaacuuacauuuaacuaauuuuaagaauauuaaucuucugauugccauaugucuacauauaguuguuacacuucauaacuagugauaccuaauauauacuauucacaugcuagauagaauauucagaagauaagcuacaaaaaaauagagacauacauuucacuaucaaaauauaauaacacuuccuaccccacaguucugucugcuucauggaaguccugccccaaccugggagauacccagaugagacauccccaccccaacccccucaccugcuggguccccagcaagcccaacagccauaaguucugccccacccuaucagaccuccaucuuccuucuagcucacacuucuaccccaccccacaacuccuuugcuucccaaaaggccuccuccaacccuggaccccacagacagccagaugauaaaaggcaaaccaaagaauauaaucaacagaagucagugcauuauggcaacaucagaacccaucagaauccaucagaacucuccuacuacagcaagcccugaagauagagacuugugaccuucaaucccaucugaugaagaugauacgggccuuuaaagagaauauaaauaaaucccuuaaagaaauugagggaaacaguuuugccuguggucccuauguugcaggauuacaagaauccucuaccacauucaacuucuuuuuaaaugaaaaacauuuaagaauauuaaucuucugauugucauaugucuacauauaguuguuacauuucauaacuagugauaccuacuauauuaauaauaauaaugaaugcaauuuucauuuggguuuaaucuuuauguuuuuauuguacaugcucacuguacacgauacuaugcuuucauaaagcauacguuguuugcccccaauaccugaauccuccaaccuugcauugucgccuguauuucacuuagccacauucuuccucugcuuuuacuuuccuaucauacauacaacucuauuuuauguauuuacauaaaaagcaagcaucaaaaccaaaagaaaacacugagccggccgg

SEQ ID NO: 15 - RNA, 97978 nt, Mus musculus
aauuucaguaugugguauaaagacuguuuuugugguauuuuuggugaagaauguggcuacuuuuugcacuugucugaaaagucugccugagacuaaggugaagagacuuggauuaauugcauuaacugcauugacaaaagaaguuuuaaaaagcccagcagugacuuuguucucugguuaaguuucacaaagagaaguuugaacaagcauagcaagcuuagaaaggaaaaauauaaacuauaugguucgaguauuaaaggcauaucaggaagugaaauggaacaaaaugcuuuguucuaugaaauaacagauuaagggagugggaccuuggggcaagauccuacccagcuaaauuuagauccaggcaugguggcgcacaccuuuaaucccaggagacaggcaugcugaucucuguguuuaaggucaaucuacagagcaagauccagaacagccaagcuuaggcagugaaggauuuggaaaacagaaagccagugacaguguaauaguacaagcgggucauguucuaguuccugcaagcagcagaacuccgcagcuucaggcacgugauucuggcuccagaguuaagaauggaaggaacuacugggacaauugaugcuaguuagcuagagcuaagaaauuagcagugauuaagaagagaccagcaucacuaaggugaaaucuucugggaaguguuuucucugagcacaaagaagcuguguuccagagauagccaagguuguuccucgugcuggacuugguaauauguaagaaucacccaggugguacugauuuugaaggcaugaaggugucaugaagaacagcugaggcuuggcaaugugagaagucauggaaggccauuggagaagguauagccucagcuguaguugauggcccaggacugaaagggucaugcaaaggauuuggagcuuggcaccaugaagagagccuaugagaggcuauuggugaagucuagauagaauggaacaucccaguguauuggagaugucaguaccaugggaugaucaccaagaacagcaaccguaguggaguggaucaaccugagcuuagagugcuacagaggacagagcuguagaagugaugccagcccuuaggaggagcccaaaagaucaaguggaaucccagacacugaaacaagaagcuguaacaaugaaauugccuuggagacucaacgauguuaaagaugccagagccaugggauacaugcugagaaaagcugcuaacauggaguggaaccagcccaggagaaagcaguuuguugcagucaacaaagaugaaaaaggaguggagaucugaagaccgcuuugacaucagccagggagauacagaguuuggaguuugcccugcuggcuuccugucuuucuuuggggauuacaguuaagugauuaaaugaaucucagaagaaaccuugaacuuuggacuuccaauacuguugagacugcuauagacuaugaggacuuuaaaaguuggacuaaaugaauuuugcacuaugcuauguuuaaguaugucccccuauagacucauguguuugaacaagucuauggaggccagggaauggaaugugaugguuuguauauucuuggaccagggaguggcaccauuuggaguuguggccuuguuggaauaggugugaccugguuguaguaggugugucacuguggguguuggcuuaauacuaucacccuaagucagucuuccacuagcaaccuuugguugaagacguagaacucucagcuuauccugcaccauaccugccuggaugcugccaugcucccaccuugaugguaaugcacugaaccucugaaucuguaagccagccccaauuaaauguugguuuuuuuuaauaagacuugcccuggucauggugucuguucacagcaguaaaacccuaaguaagacaaggaccuugaaggggacugugagaucacacguggggcucgagcauagcaacuacaugaacagauaccacaggaaggugagcccuuccccucuucuguaacucuguagacaagcaaccuguccuuuccucuugugcuuuuauuuggcaccaugguguggauuuggacaagcugaagggguaacugaagcccccuagccagagcuagguauuggcugaaggucccucuggaccaugucuuaauccugacaggcauuggugaagacuaucuaacuucuucuuauaacaaaaacaaacaaacaaacaaacaaacaaacaaacacccugguaacauagcagcgacuuaaaaggcacagggcagcugccaguucuuaacucugcaggaaggcuuaacaucuuggaccucuguggaauuccccaaagccaauagaccaagggaaauguugccauuggacaaacguuucuccucuuuucugucauuggcaacucaucauugaauaaaaaaaauuccuccaggccagggagauauauacacuacuauaaucccacagaauaaaaacagccaagccuucauguuuuggaaggaauuccaucagauagcuccauguauggccaaugacaauauuuauagcccagcuagcugaaucaguagagcaugagauucuuguggguucaugccccaccccauguugggugucagcugccagucuacauauuggaagcuaucugcagagauagcuggacuggccaggugggaggcuucaagugaaagggaaagggcacuagcagggauggggaauugucuccaggucuggugaugcugccaccaccucugguguugcugcuauggugcugccaucccagcagcugcuguugcuccaagaugcugcacugaaagugcugagcugagccauguugaacaggcagcggccuggcuagccagcaaggugaaugcaguggagcuucugguggugaaaguuucagggagcaguucucuuuccauggaguguuacagcucuugugacagauacucucagacuaaggaguaauucucacacaccuuuauuccuucuggauaagaucuuauuuacaguuuugggguggguuguugucugucaguaggugcugccuauuggcuuggucugugauguuagggaugccucgucuucaugugcaggggcuuaugggugcugccccuaugugaugggggcugaggcuacaugaaaggggccugauacugggauagaugaaacuucuguugucucuucagggugcccaguucuuuaagccuuugcucgaccuuacuaggcuucuucuccuggucuaccaccccacagaggaggggaaauaggggaaguauugugggaagggcuaagaagaagggggcaguaagcaagauauaaagugaauuaaguaaaaaaauaaaauaaaaugauauuucaaguugaagaaaggaaugaacauagccaugagacuguaggaggaaacaaaaagccauaauuauuaaaacucgaaguacuccuaagaauauaacaauaucaacaaucaaccauaauaacuaccacacccauauuucaauagaaauuuuaacuaauaauaaaaggauaggaaaguauauucuaaucaaauggggacaggaaccaaguacccuucuaucuaacaaaacagacuucaaacugaaauuaauccaaagagaaaaacacuucaugcuaauuagguuauuuaauuaaauaauuaauuaaacuaguuaaaguuaaucaagaaguccuuauuauccuaauucuauauacagcaaaauaugguaugcccaauuucauagaaaagauucuauuggacuuaaagauacagaguaacaucaguggaucaauauuaggugauuuuggcauucuccuuuuuccaauggacaaguuauauaaagagacaucagaauuaaaugacaucauagaccaaauggacuuaacagaugucucuagaauauuugacccaaauaaugaaaaauaaaaauucaauucagcagcacauagaauuucucgaaaauagauuauacccugggauauaaaacaaauauuuacaaauucauugaagaaugaaauaccucuauguauucuauaagaccauaauucaauaaaacuuaauuugguaguaaaugaauacauauuaacauauaaacccaggaagauuaaauaacucuuuaugaaugaugaaguggagaaggaagaaaucaagagaaguaagaaaaggaaaaagaaaaaagaaaaaaucuucccuggaacaaaauaaaaaguaaagagcaaaaucucugggacacaucaaaaacaauaccaugaaaaaguauuuauaauucuaaguccuacauuugaaaacuagagcacaaauaaaugaauuaauaauuucacucaaaauuuuggaaaaaccaaucaaaacaaacuaaauuuuaauguagucaaucaugagaaauaauaaaagucagagcagaaaacaaugaaauauaaacagugaaaauaauaaaaagagucaacaaaucuauuagaugguucuuugagaagauaaaccagauuuagagacccuuggccugucuaagccaauuaaagacagaaaggacuuuaaugggaucugaaaugaauagggaaguguugcaacagaaacuaaagcaauccaaaauaaggggauacuuaaaagugugaaccccauuuagcugcaaguucaaaagaaauguaugaauuuuaagauucagucaaacaaccaaaguuauagcaagaagucaacaaucucaauuaacccauaaaaauuuggaaauuaaaguaguaauacaaagucuuguagcuaaaaauguccagcaccugauagaaucacagcagaauuguacaggcuuucaaaaaugaucuagggccaauuguucuuaaacuauucaaagaaauaggaacagaagguucauccccaaacuccuucaaugaagcaaagaucacucuauuacuaaacaagguaaagccacagucaaucuacaagucaauacaaugaugaguauagauucaaaaaauucaacaaaauacuugcaaacagaauacagagacccaucaaaaagauuauccaccacgaccacauuggcuuuauuuauucuugaaaaaccagggaaguucaauauaugcaagacaauaaauguaauaaaucucauaggcagauuugaagaaaaaaagaccauauauugagaugaugaauagaugcaucaaaaaacugugacagagucuaucauaagcucauuuugaauauccuagauaaauuaugaugagagagaaaauauauuaacauaaaaaagcuauauaugagaaaggcacagugagcaucauauuaauuugagaacaacuuaaagcaaucucaucaaaaucagaaaugagacagagcuguccacuauccucaguccuuuucaauacugugcuagaaauacuagcugguguaaagcaagagaaagaaauuaagaggcuacaaauaggaaaaaagaaaagaaaaaaauuugccauuuggagaugacaugacauuuuacauaagagaugccaaaaauucuaccagaaaacuacuacuaaaaacaauaaaauucacugauauaccaggauauaauaugaacuugcacaaaucaaucuuuuuuugguacaccaacagcacagauaagagauaguucaugggcauguuuccacucacaacaauaucaaagaaaaaaaauacucgggcauaaauauagccaaggaggucaaagaacauuacaaugagaaguuuacaugucuaaaggaaaagauagagaauaguauaaaaugggaagauaugcucaugacuugguagauuuaauuuuguguguuugaucauuuaaucgaaugcuuuuuacacauucacugcaacuugaauuaaaauccuuaacucauuucucauagaaauaggaaaaaaaaccuuaaaagucauaugaaaccauaaaauaccacagauaucccaaaacaaugcugagcuaaaagaacaaugcuggagaaauuagcaauucagauuucaaaguauuucaaaguaugagccaaagaaaacauuguacuggcauaaaaaagauaugcaaaccaaugcaauaaaauuuaaaucaugaagaugagagcauguaauuucagucauuuaauauuugacauagaugucaaaaauauacacuggaggaaaaaauaucuuaaccaaaugguguggggacaaguggauguugacauggagaagaaugaaacugaaccauaucaaucagcuuucaaaacaacaacaacaacaacaacaaugccaucuccaaaacccaaaaaacaaaaccaaaaaaaaaaaaaacaaaaaaaaaaaaaccccaaaaaacucugaaacacugagggggcuggagagaugacucagagguuaagaacacugaaugcucuuccugagguccugaguucaauucccagcaacugcaugguggcuuacaaccauauguaaugggaucugaugcucucuucuggugugucugacaagagcgacaguguacucauacaaauaaaauaaauaaaucuuaaaacaaaacaagaaaaccacugaaauacugaaacuguuagaagaaaacauagugcccucuaacauguagauguuggaaugcucuuagaggaggauguauggagacuguaagaauaugagcccacuugcccaagaauuaauguuaacagcagucaaguguuccuccauaaaacucaaaagcuucuccuggcaugguggcacacaccuuuaaucccagcacuugggaggcagaggcaggcaaauuucugaguuugaggccaggcuggucuacagagugaguuccaggacagccagggcugagaaacccugacuugaaaaaaacaaaaacaaaaacaaaaaacccucaaaagcuucuauacagcaauuccacaacaaaaaacacaaagcaaauucuacaacaaaacacaagcauguguacacacacacacacacacacauuccuuugcuuaaauuguaauucuauuaguuuuuaaguugugaaacaugggccaauugcucacuucucacuauaaauucaauuugcaaauauacaaaaugaauacuugccaagucuguugcccagaaauugugucaaaaggcaaguugaacuggaacaacgugugugugugugugugugugugugugugugugugugugugugucuuuuauccauggauucaaaggaagcuggguuggggcugguagcuuggcccauucuaggagcuuaggugggguaggaaaagauacaagcaacacauuagcacuucagaaacuugcuguuaacuacucaaauuuauauagaugugaucagcauccuaaacaaaauaaauaaaagcaacagaaaauauguugcuaagaaugauaucugucuuacuacagucaaaauguuugguccuuguaugcuaauagacuagguuaauacuacaaaacaaaaauguaagcuuuaauaauagaguucugcagcagugguaagaguuaacaaauaaaagaucauuucagcaauagaauuuuguauucugcauauaucagugucaaguaagacauugccuuuaaaugaaguauuauauucauaauuauugauuaaccagaugccuuuuuaaaaaagacuuauuuauuuauuuuauguauacaaguauacuguuggcuauuagcccuuucuuggauguaggguugguaaaaaucuuuucccaaucuguagguugcuguuuuguccuguugacaguauccuuugccuuacagaagcuuuucaauguuaugagauuucauuugucaauauuugaucuguccauagagccagaggcauuggugcucuguuaaggacauuuucucccgaccauuuuuuuguguugaggauuuauacguuuucugaucauuuuauccuagcucaggaguagcauauaaguauuaguugacacccagaaaaccauacaagugcucaacgguucuaaaaaacuuuuacaggccugauuuccucuuuaaccgauuuacugaagauauguacagagauuuucuuguauuguuuuacaaggcucagguuguucugaguaaauaaauaguagacacuaagcuuguuuaaagaaugaauaugcuuauacaguugcaugguucuuuuacauuugaaaugagaaaauauuucaaacuauugaggcucauuuagaccuuauuacacaccuagauaccaaguagccuuuccuagaaagugugucugaaaaaugaaaaaauauuaugaaaaguauacaaauauguuggcaggaaucauucaugguaauaauuuuuagcauaaauauugacuucucaaccucucuuugagauagucucuuuuuauagugaggccugccauagaacucaagauuuuccugccuauguugggguuucaggcauguaccuuuaugucuagcauuaauguuucuaaauuuuaaaaaugauaaaucaaaauacaugaaguccugaacaucagaggcccauauaagaauacauauugaacauuaaguaaauaauuucuucagauuguuaagagaaauuaguauucuccaugaucuccauauagaacuugacuggcacuuggauauguauuuccuuuaaacuuuuaagcuuuuuagaagucugggcugcuggcuacauuuugauaauucacaugacuagaccaugaccuuucauuuucagacuuuuauuuaggagugaauagcugaaagcgucuucacaugcugcaacaguuuauguacuuuacuuuucuuagcagucuaaugauuuucaguuuugguuuuguauuuaaauaguuugcaaagauaacucuuuaaaggguuacauuuauuacuggccccuuucauauaauacaaugguauuccaaaugaggaucuuuaauggauggagaaaaaaaaagaauagaaaaaauuuaaaguaucuuaaaaucugauauaacaguugcacuuauuauuuauccuguaauaguuuacacacacacacgccuauuauuuuuuaauuuuaaaaaauugcaagccuuuaaucccagcauucagaaagcgaaucucugaauucaaagccagccuggucuacagaguggguuccaggacagccagggcuucacagagaaaucugucuugaaaaaccaauaauaaaaauauuuuuuauaguggggagaucuuucauauauauaugauguguauauauauauacacacacauacacacacauuauaggagcuguaauaaacagaaaagcacauuaauacaugugauuguuacauuuugagcacuagaugauuaaggcuuacuaaguugcaagccaggaaauaacaugucagcuagucuuuauaauaauuuagugucaaaaucauuaacaacaaaccuaaguuaaacccucacuccgguaccaacaagucacauggcucuaacaggguucggguguucuguaaaucaaaauuagucucuauccacgugugaucaagcaaggcgguuucuucucaguugacaucuacuggaagacaacacaggaggggcugggcuuuuaccuacuagucugguaagccagugacauaucauguucuggcagaggcugauggccuuguuugcugaaagguugcccaaucucaacgccugaauccuuuacucggacaguucggaugaaaagucguaagggucagcucuagcaacaaaacgcuucuaugccuccucgugccgccaguaggcuacacccucuuggccuauucgucccucugacuccugggcuuugcuaggcuggguagaccuguccgcucucgcgaguacaccgaagcacacuggucuauagauugaguaaaaggagcagaggcuaaaaacaccaagccucucucagcccagucucaagauggcgacgaugcuggccagcuuccacccagcccaaggccaucuccccuucccaaaggccccugcgccgcaggcgaaggcgagcuagaggagggccccacagagcugcgaucggggcggggcagagcccgucgccaucccacgcacgcgcaaccccgccucgcaucccgccuccggacuccgagcccucgcccggcaggguuggcgcgcgcugccugucgggauacucgguccgcccaccuaguccucucguccagugcugcguucgcgagauccguauuucucccaagaugguggcgcuccucuuugggugacuccaggagacgacagggccuuucgucuuugccagcaccucgucgccccuccugcgcucgcucucucgcucgcgcaccgggccacgcagcuguucaccgccucguuacgcuucucuuccgucgaccugucgcugacgguggcgccuccuucugcuucucuucggaguugcucgccgcccucgccccccacuguggacagaucgcgacagcagcgcuucagcgccgacuucaagguugcccaggcgccuggccucucggccucgguuuccugaggagaagcgcgggucccgcaugagacccggcgguggcgccagcgaaagggaacgaggcgguggcgggcggcggcgguggacgagggcgacaaggaccagugaggcggccgcagcugcgagggccgcagcccacgcgcgggggcgaggacaggucagugcugcugcggcugcggccugcccggcgcgcucccucuggucuguaccgccgguccccucgucacccuccggcccgcgcugacaggguaggcgccgggcccucacccgccuccgugagcgagugcuuggggcgcguggucuggaggggccggugccaggacuaggcccugguggcugcggcugcugcagccuuaacugucagugcuggcuggacgcaggagggaggguuuugucacccacggguacccgagugggcccgggguggggcggacgugcagggcgucgagaucgggggccucaucuaagcagagaucggagagccagccguggcuucaggcugcgaaaggcaggccuuuuccuccaaaggggcgcucugguggggaagacauauuuagaugugugcuuaguggguugggguauuggggguggauuggaaggaagacggaugaagcggcaccucaagcccaaggauugcgcucugguuuuauucgugugcugcuucugguaggauucaguaguugaacgugaguuacugauuccucagaaacugcuguguuaauuuucaaugcaaaccuguaagcaguuggccuccuccucuucuccccucccccuuuucaguugagaaaaugaaaaggacguuuuccccauuuugaugcggaggcuuuuuguuggaagaaucagaguugaaugugcuauaauugcguuagccuuaaaaauagaaaguauaauuuuaauaagacuuuaucagcuuuagaagaauccucuaaagacaauuuuacgucaauuuuuuuuaugucuuuugagcaugcuaaaauagaacaguauaaaaucucuuugggauugcguuaaauagcuaguguacuguuggaaauguuaacuaaauaguauaugggauguguuauccaccauuaucuuacuucgugaaggauauucguauaacccaugguuuugggagaagcagcagauuauguuaaaauguuuuggauagggaagugcguuugaaauaaagauggccugaacuuuaagaaauacagcuguuaaaaagcuaaauaucaaagcccuauuggacaagagacacgacgaauguuuuugacacaccucagauuaguuaauacucuuaagauaucuuuuugguaaauuauguaaauuuagaauugaggagagauaaaaggaaaauuuugucuuguuauguaugacagaaauugcuuuaguauuaaauucuccucuuaaauagacugcuuacugcacuuuuaaggaaguggauacugcaucuguauugcugauaagccuaaguaaggaugacuguaaauccauaaauacuuagcuuuacaaaaaagccauguaucagaaucuguaauaaaaaugagaacuucaacaauucgcagucuaucguuuaagaaagauacagcacauaauaaagaugagaugacuuguaguuuuguuuucaaaaucagaauguagguugugaaauaauuugugucaauauuuaccuugcaugguguguugugaagugguauacacauacuucuuuggauguugcucuucauauaacugaggagcuuaacuuugaguuuagaaaauuccuuuuguaugcagguuuuguagguggcuuuuuuaucccugaaauagccaccaucacccuuuuuuuuuuuuuuuuuugagaaagggucuuaugguauaucgcuggaugacgucuaacucuccucuuggcuuugucuccaggguucugcgauuaaaaauguauaccaccaggaccggcuauuuacccuuuuuaugguuuuaaauuagaaaaaugugauuucuaccugagacaaaacucauucuauuugauucguuuuuuuuuuuuuuuuuuuaacauugcauucauuagguaucuauaaugucucugacauguaaauuuuauucaguuguauuucuuaaacauuugugucuucccucaaauaauugcaguaauaauuguuucucucaauuuuuaugaacauuuucuuuuuaauuggccauagcuauuuuuuuuucuguucaagagcuuaagaugaucuuuucaaauguccuuuaaaaaaaccaacaccuuaaaugaaugguuacugguauauuaucauuuauucuaauuagguuuguuuguuauuauugauaauauuacuguuaauggauuuauauuauauuuauaugcagcuauuaaaaacaucaguguucugauuuuugcaacuggagaugaguuuuaagagguggucuuuuaaguacuuucaaauacggaaaaacaauauaaaaauauaaaaauaguccucuaagucuuuugauguucucuucagaaaggcuuaggauaauagaguuuugguuuugacaguuacuuuuucuuacugauaaaaauaaagacaauguuauguuaggcaugaugucucacaucuguaaaccaacaauugagaggcuaaggaaggauuguggcaagccuagacuaagaggcgagaccuugucucaaaaaaguuaucaaucagagaugucauagaauguguaauugaaaacuuuuuucuuuaauuaauuaauuaauuaauauuuuugggaggcaggguuucuuuguguagccauggcuguccuggagcuagcuguauugaccaggcuggccucagacuauguuuccagaauccuuaagucuguuuggccuauuuauaaaauaccaaagacuggucaacaccccccuuccccccaacuccaaaaaauguaucucacagucaaggacacugagaaaucuuaagaucagaacuaauuuucauuguaaauuugaguaguguuaggaggacuaaggacugaaccuagggccucucaaguucuaggaacugcucuaccacuuccuaguccucuguacacacuccagcucagaccuugaaaugggaguccugccgccuuccauaggagcugugauugcaggccaguaucacuaugucucuguaucucugucucuguuuauuaggguuuuuguuuguuuguuuuuguuuguucuuuuuuugauuuuauuauaugagaguccacauugguguggugucuguaggggugagaagagaguguuggaacugcugugacugggauauagacaguuguuaauugccaugugggcucuagaaauugaacccagguccucuggaagagcaacaagugcuuuuaauuuaacuuuugaaucaucucuccagccuucccuauauuucccuccccuuccuuucuuuuuucuuuugucuuuuuccccuccccgcuucccuuucuugugucagugucucucacuagccucugaagcuagguaaauagucgaagcuggccucuaacucaaagauccaccugcuucagcuaagacuaaauggucuuuuaaaauuaggacauugcucucauucaucaauguagguccuccuaaaaauuacacuuguaauuucaucaccuccgauuuuaggcuuuuagugaaguuuuuuuuugggggggugcaaagauucagaucacauagaagaauaugucugaaauaguuaucaguaucagguaguguuucugaggcuccuuugaauugugugagcugacauggguuauaaggguuaaaaaaaaagaaaauaucuaucauuuggaaacugauagguugguuauuuauugcacauaacaccauuuuauuuuuuaaugugauaauucuguuaaguuauggaauuuaauugucugugccccuccaguuuuagggcaguucuguagacuuaauaucccuuaaccccuuagcuacaauuguaaaggauacuguuuguauccuuuuuuguauccuugguauauguguucaugucuuacuugcagcccaucaauauccuuuuacaguacacaugcacaugugguauauauaaaaugaaauagauuuagucuaguaugcuacucagccuguuaggacucauuuauuuggacaaugauuaccauucugauucaauaauaagagucagagauguuuguuuggaagaauagcuacacuuauuuugcaauuagcaauucacuuuuauggaguuauauauuuuuauacuauuaguaaaauauaauccuuauaagauagcacaggauuuaauucuuuuaaauaaaagaugugaaauaaauuguauuaaguagaaauauuauuauuuuucucaauuucuuuuuccaaccaugaaaggcuugaaauacaugacacuuauuccuucuuaauaaagugacuuauuaauguacacaucagauuuccuuuguuuucauuuaauuucaaaauauuaccuauacuuucuugauuucaguugucuauaacaacuaaacuaaugaauaguaauuuggaaagauuauaaguauugggccuaucuauacaugaaaaaaauuuuuuauacugauuuuugaaagagguuucaauauacauuacuuauuacuuuuagguuuuaccugaagccacagaauaaguaaauggcucagaauuucagugguuuaggaaacaaaacaacuuaggauuauugaaauggaauaaagaaugcaauauucauguugucagaaguugcugcuuuccugacaucugucuugagccagagugagcuaaauaggagcaggccauuuaucuuucuaaggccuuguuaaucauauuaaagugguacugccuucuuguuacagaggauuaugcugcucauaugugauacuucuugaacauugauagauacuguauaaagaaaguaacuugcccaggaaauuuguaggagaaaggaugauggaauacgguuauauuguuuucuguuaacauggcuaagccuccuggucuuucugguauguaccucuuuugagagcugggauugcagggguauaucuccuuuacagccgcaauuacaauauaugaauuaguuucagauuugauaacuauuucaauaagcuuagguuguuuuguuuccuaaaccacugaaguucugaagcacuuauuacuucuguggcuucagguaaaaccuagaaauaaguaauguacauuuaacaugaaauuguuagugauaaguuauuugcaaagcugaauuccuugucauuugcucuucuugaccugauuuuuaauuaaaugaauugcaagugaaucaguuauaagaaugaugggaaaggguagccuuuaggggccauaguaccauaguuaagcuuauucuugcaguucaguuguagcaaaucugaggagaagccucacgaagaaauugcauuaggcuuaugaaggagaauccuauguaaaucuugcugaagcuggcauccuuauuugagugaaaccagaguaguaguaguaguaguauauagguacugaacuuuuuauaugagcaggauaaaauuuuccuuacacauaaccuuguguguaaucuguuguuacucuuagcagcagcucaguacauuucagaauuuggucuuucuuaccugucaacaucauuuaagcaguauagcacaacucucauuaauuugacagaaaucagauauuaaaaaaaauccuucaauuuuaguuuuacauagcuggggauagaauacagggccuugcuaccuagcagugagcuacaucacuagguugaaaaaaauacuuugaaaaaaauauguuauggagccuuagaaaucuaguuugaauggugaugggguaugugugugggugugugcguggauggauggugguagcuguggcggcagugguggugguggcggcggagguggcggcggaguaguaguaguugauaaaaaucaugguauguaaccuaggauagacuguaucuggacauguagugcagacugcccuugaauucuuggucuucggcccaagugcugagacacuuuuuaguucuuguuuguuuuauauguuuuuuuaaaagacagaauaucuuguaguccacacuggucucaauuucuuaguaguugaagauaaccucaccuacuuauccuucugauuacacugcuccagugcuggggacuaugggugugaaccaauuuuuuuugugugugugugguguccaaugcauauaucuucaauucagaauguucuucuggacauuuaaagcaagcaguuuggcacacaaauuacauagcuaugacaugaaugaagauacugucaguguuguacuuuucugaacggugguuuuuuguuuuuuuuguuuuuguuuuuguuguuguuguuguuuuugagacaggguuucucuguauagcccuggcuguccuggaacucacucuguagaccagggagaccucaaacucagaaauccgccugccucugcuucccaagugcagggauuaaaggcgugggccaccacugcccgacagaacaguguuuuaaugugauaaaauuuuucuuuuuuuaaaacaaaaaccuauguuuuuuuuauuuguuuguuuuuuugcuuuuuugaauaaaagagauggcuauucacuuaaaacuucuaauggacuuucugauaugaaaaaguagucuuagagauaccauuguggaaccauggccauaauuaauuuaguuuuauaaucugugauauaaaauaaaugcugauaccucuaguuaaauauagaagauaugaacaauauagaagaaauuaaaagaaaccaaccauguaauguaccauuuaguuugaacaaacuuuauauuuuguuauuuccuugaauucuugucuuuucugaaacucauuccuuguuuucauuaguugauaccacucuucucauuauagguuucagcacuuuaccuaguaucagaugugaaucauacugcuauuuuuuuggaaaggaaaagaugaaaugcauagucccucuuucuuuuuuuuucuuuucuuuuucuuuuucuuuuucuuuuucuuuuuuaagaaaaauaaugccuagugcauccuaaggggaaguagaguagccucaauuuauuaguauuucucccuuaagauuucuauuuacuaugccccuuuguguagauauauuugcuaagcguacaauaugcuaaaaauaaagauaauauuugccuuugcuaaauguguuuuuguuugguaacuuaaaauguuguuuuuugaguaccuguuguauaguauguauaauaauagauaaaucuuauuucagauaaagacucauuagagaauauguuuuuguccucacuuuugaagugaccugacucuguaucauguguuacugauagaaaauacauuaagaaaauccaaauccuuaguuucaaagaaaugaaauuucuccgcuuggaaauucugucccauucuccauccucucuguuacuguuucucacugauucuauaacauuguacaggauucuagacuggagaugggaauaagaaguuauguacaaguuuaggaacuuaaaggaggaauauacuuuccucuacagauugggcuauauaauuuuaaaguaagagcucuuaaagcauaguaggagaacugagcuaauuuuagucuuuuaucuguacuuaacaucauguauaauuacuggcugguacauuauguuucaugucacuuuaaaaaugaaagauuguuuuggucugauuuaacuuuguauggaucaucuuucuacugauucugaaauuuucucuuacuccauuuuuuuuuuuuuuuugaguuaaaugaaacacagggaagaggugaacguaaaaacagauauaugcacauaacuuaaccaguugaaauuagaugucuauuccuauacugaagagucugggagaacaguaaauguuuguguacacauuuuguauucuguauccuuugucuucucccuuuuuccaucuuuccucuucucuuuuuucucucuuucuaaccucaugucucccaguucuuuccucucucacuguucucucccuuuuguccuuuuccuuucccuucugcagaugcagguauuuguaaauguuggauugaaugaacuacuuucuagauuguucaggucuggguuaggauaucugcuguaggcucuugaaauauguauguaugguaauacauaauucucuaggcuugagaauuuaaagguaaacagaauuaagcaguacuauaguggccuggacaauuaacaaagaccuucugaaggucuuuuaaaaauugauacuaauucgucuuuuuaguggucaagagauaauagcuuaauuauuuagacaccuauucugcgcuuaaaauuaucauguuauaauaauaguuuuuuuugggggggguucuuggcauuaaacccagggaacauuucuucuaguccuuuaguccuuuauauuuugucuuaaucuuuugaauuauuauuacuauuauuaucauuauguguuguauaauguguauuuggacauaagagugccaugcugugaugcggguggaggucagaggauaguuagguagauuaaggucucucaauuuuuaacuuuaaucccagaguguuuuuuuuuuuuuuuuaaagugucaggcuuauauggcuuuauccuacucauggagauaaucucaagagccauacauuuuuaucuuauuagcauacuuuuaauaaauugggaagauugugucauggaagucuccauagucuuaggguuuuguuuuuagcuuagaaauuguauauucagauuguuucuuauuaaaacauguuauaaaauauuuaaagcacuuaauaguauaucaauaaucuacuuaccuaccauccuggaauauaaaugccaguuuugauuuuuguuuuggaaacuuaaucucuuccuccaaguccuaauacccucucuucuuauccauguaagagauuucuugaaguucuugaauaucuucuguuuuguacuuaaauaugaccuuugccaauaagugagauaucaugcuuaagaauuuauagauguguuucauacauacuugccaucaguuuaugugucuuuauuuuauguguuuuauuuuauguguuuuaucuguuuuugagauguguauguugacacauaucuuuuaugguauuauaguauauggauaacuaaauaguauuguaucccacugcuuaugaauauuuugaauugcuuccuauauugcgcagaucauuuuuauacuuccuuuguaaaagguuuucuuuagggaaaauuaaagggaugaaguuguuagaaaauaggauauauccuuaacuugauuagauacggcaaauuuuauguaaauuugauuugccaacauauacuguaucaccagugaaugaacauuuuuguuucuagcaucucuaaccaguacuuggaauaguuagauuuuaaauaaugauaucaaauggcaucuuuuguguuugcuuuaauucugagugguugguaaaaugauaagaguuuuaugauuuuuuucuacaugcuucaauuuaaugauuuuaauuaauuuuuuuuaagugcuggaguuugaaauccagggccugcuguaugcuaagcaauuuucuguguguuuuauaauuuacagaaaaaaauuuaaaagaaaagaaacucuacaagguuuuuuuuuuuguuucuuuuuuuuuuuugguuuuuuguuuguuuguuuguuuguuuguuuuuuaaauagcugauuaucuguccagucaucaguauaugggcuucuguaugcuuucauuuuggguuguuaugguauuuuguguguguguguguauacacacacacauaaauaauuauauauuauauaauagauauauaauauauaauacauacauauauauggauuuaacuuuuguuguaaauauauagcauucucuugauuauauaucuaggugugaguugucugggaaauauggcaacuauuuaaaacuagaggcauuuuaaaacuuuucucaaaguggcuauauauuuauauuccuuugaaauacuuuuauuaguaauaugugaagguucugauuuuuuucauuguuaguguuauugucauucucaguccuuaacugucauuguucauuuggggugcucuaaaguuuuaagaagaauaguuuuguuuguuuuuuaaauaggcuuuuauagauaaagagaggauggaaauugcagagcacaggaaaacauuucuuguggaauauccugagaagcaaaauuauuaggaccagaaauagagauuucugauauaugauagaguacaauaaccaagggagauugauauuucaggaugucaucauauauggguaauguuuggauuacuggaugugaccauaugacaaggacaucaguuaauauguaaaaaaaaguuugaaauuuauguuaacagaauugagaaggcauagggauuuuuuuuuaauaugagagggauaugaccaaauucuaauuucuaggaggauaguucugucaaauauguaagagagaaaugagguaaaaugacaagacucuguaucacaacaaucuuaguaaccauguggggaaaagaagcaauggauucuuucuuuaaagaugaaauauuacaaaaaagaauuuuaaagcuaauuuuuccggcgugacuuugaguuagacugguuuauaaggaaauggacauggauagucuuuugaaacagauugaaguuucuuagccuugcauuuacauagcuacccaaguuucuuuuuuuuuuuuuuucugugcuguuuuauucuauaaaccuuuuaaaacauuuaguauaaaaauuaaggacauacucucaauguuuugucuagucuggaaggaaggguauacuagcaggguuuggaaacauaguuuuacauauugugauggagcaauuaagcuauaccgaaagcaaguaaaggccacuggagaauuauuagggauaguguuggauuguggggagaucccugagguggaauugguagcagugagugagcaauauauuauauuuggcaggaugauuugaacuuuucugauuugagucauuggaacgagaauccuacuguuaugccacaggauuuacuaguaugugauaaaguuuaucuuuggggagaccauaguguuauaucaguccaucuaucaauuuauuaaucugucuguccauccacccacccauccaucauuuaucagcccauccauuugccuuuccuucuuuccuucucacucaccuaccugccaaccuauuuaccuauaaauaauaugcagauuuauuuauuuuguaguugcuuaauccauaggauuagguuuucuccuuaugacaaaauaagauuaaaagauauuaaaggcugaaaaauauucaagacaaguuauaaaugaacuaugaacacaaauuuaaaaucauaggagagcuuguuuuaagcucuguaauaaguacauuguuauuguuuauuuguaaagaauugugauagacauggagugacuuaguugaguaacagagcccuguuaugugucaggaaagcaucuauauucuuuuuauacauuuucucuaauucaacaacuuagcacucuugagagacugacaggucagaggauuuagccaugguugcuacucuagguuuuauauagcagaaguuuuucauauagagauuaccuggaaguggacuuacuguagauaucugaagggguuugaggaaagggauuguggagcauuacuuuuuguacaugaagaugggaaacauggcuuuccuagucggaaaauauucagcucacagccuacagagcuacccugcuacuuuucuuggcaauaggagugggguaauuugucuuucaauauauuuuuggaucuuuauaaguauuauugaagagaaauuggcuuuuauuuuauaaugaauuugaguaauuuuuuuucugaaagacuauccaguuuauguuaaaagaauugagugagguguuuuauauuuuagguuaaaaaaucucucuaagagccugauuuuagaguucaccagcuccucagaaguuuggcgaaauaugguauguuucuguuuuauuuuuugaaauucauauugcaugaauuauuuuaauauuacggcuaguauaaugacaaaugcguucaauaaauuugggcgccugucaauuuuaaagacucuuacuaggugcugaguauacaaccagguagacugugagggauauaagugggguguuggaagaauuugugaguuuacuguauuaugagacaaaguaauaugaacaagaaggucaaggaaauagacuuggcuguuaggcuguggguaugaaaaaucucuuucauuuauuugcaaacauauuuuauauaaggcacucuuaugauaacccagacuaggguuuuaauucugcuuuaagauaauugagguuuagagagguuauguaacuuguccaagauuucccuauaguaagugaucauggagaguggaaucuuagaaugucuuuggaaacuguucaacugaacauugaaccuaauaaagaggagacuaguggagaguacuugauuuaguaauccuaagaguauauauaguucuuuaaugaauuaguugauuuuauuuaagcuguguuaucuuuguguuuguaaguuagaaguuagauucauuucaguauucacauaauuccacauaagcuguuugaugagaaacuaagggaacuaugccauggaccacauuuauuucaaggauguuauuucucucccuugcuaguucagugaugccucuguucuuaguagaagauaaauaguuaugauagggaaauuugggaaauuggguuauuucuuaacagggguuauaaauccuauuuauugggacccccugauuuuguuuauauauauauauauauauauauauauauauauauauauauauauauauauaauauaaacuugagccaacucuaacaauaauauggguucaaauauugaugcuuuaauaauuccuuugggauucucacuacuuccuguuuuaaguuggguucugauuccgugcuuucagccaucuggcuugucugugcugucaauuugaggguguuaauugugaaggggcuuccucuuccuaaucuuacacucccuuuucuucuuucuuucuuucuuucuuucuuucuuucuuucuuucuuucuuguuuuguuuuguuuuguuuuaagcucauucaaauuuguucuauguuuauagaucagugaaagaggauuuugggggaaaacuggauaaaaccauaacaguauuggcauuuugucaggaguauaguaugauaaggagggcugugaaacgaaucagauuuguuuaaaaucacauaugauaguucagauaugugaauaauaggauauucauucauauuuugcuuuauauuacuuccuagaauugagucuuagugggauugaaaacgaaugcuuucuuauagauccaaaggucuaaaaguuaaugauagauuauacuacuuaaauaauuucugucucucugucucugucucucucucucucucucucuuucaugugugggugcguguguguguguguguguguguguguguguguguguguaaaacuuuaaucaagauuuugccuguuugguagcugauuucucccaucaguuaaagacucuugauacuaaaucaguuucauucuaauuacugccacaauacauagucuaaauuuuugcuuuuuguauguauuuaaauuacaaaacacuguaaagcaaaacuaaaccauagcaaaauucuaauacuuaguggaaauuuagcugauauugguuuuuuggucuuaauuucaacauuauuuacaaaaucuucggcaagucaguuaaucacucugaggcugcuuauuguuauucuucuauuuugaucuuguagagcuaaagucaguggaauguaaggguacaguugauuguuguauuuugugagccauauaguacuacauugaaaaguagggauuauuaucuuuaucagaaaugccugggaccagacuauguuucaaauuuaagaauuuuucagauuuuggcauguuccuauagacuuuacuguuugaacauaccuagucugaaaauucaaaaucggaaauauuccuaaauccagcccuuuuuuauuugcugccaugaugauuuaaaacauucuggauuuuggaguaguuuuggauugagaauauaccucauuuucucaaaugaagagaccauuuaagaaaacaauauacugaagaauaguucauaaagguuuuccugugauaauuauucuucuaauuuuauauugacuacugauuuaaagcuuugaagauaaugacuugaacaaugaauuggguuuaugcuaguguucuaacuaaagguuuguuuaauuuauuagaauuauuaagccuacguucagaucaaguuagcagcuagacuggugugacaaccuguuuuuaaucagugacucaaagcuguuaucacccugaugucaccgaauggccacagcuuguaaaagguaauuuugaauguuauuuuacagucuuagaaaggcugucauuguaagaugaauuaugugcuauaaaaaugacaaaaaugcauagguagcaggaauauugcuaagaauaaaagaccuaagaacggagccauuucuucauuuaaccuccuuucucagauauuuauuauagugcauuucuuacuuacccuucaguucaugaagauaaguaaucaucaaagaccuguuuuucugcauagauuaauaagaaaauaugucuuaaguauuuugaagauuacaguguggacauuuuaagagauauguggaaaauaucuuaaguauuauuuuuaauauuuuauguggcaggaguuucagugcuucuccagaaauguugcaccuuuaguaaaaugaguguacuuuuucuccuagagaguuacaguggaguuaaaagugcaccuuuaccuccuuaaaaggauggauuuacuaggucauguuccaguguucagauuauuuguuuugugauuacauuuucugucuuuaaaguuaauaccuaaaauugauacuuuuaaaagacuuuuuccucaccauuguuacuagguauuuuucagguuucaaauuucauucauuccuuuauuaauauucugguaaacuuuaggauaacuugggucagucuuggguugguaguggauuuuuuauuaacuuuuaguugguucuauauuuugaauuugguaaaauuaggagcauguccugaauucuuauuucaaauguauugucaguaaaaagcagcaagcauuuuaagagcagagaacaguuuuauaacuauuaguagguguuacauauacuuugugguuuguaacaccuacuaauaguuauaaaaauagaguuacuuugaaaguuaacucuaguuuuaggauauauuuuggcaacuuaauuagaauauuauuaaaauugucugcauagacauucagauguacacaaugaucagaaacaugcuuuuguuguauuuauauauuuuucucuugacuaaaguaaaacuguuugaaugggagcagccucugcuauacuaugucuaagagaucaagaagaguauaauuuaagaagaauaauuuguuuggauuaauuuuacucugaucuuucugggguuucuuaaauuuuaguuuggcuaaauggugcuuaauaacuuacucuaauauuugugaauauuaaauagaagucuaguauauuuacaauacuugguuggcauuauguuacuggcauucacauacucuguagcaaucagaaauugcgaaaauagcuguaguuggccauuugacaauauguuuguucuauaguucauuuuagggucuugaaacugcagcaguucuauaauauucucuugagauauaguucuuuuuuucucuuaucuuauauuuucuuauauaauauuuuuucucucaucauucuuaaccuucucuaaauuuuucuuuuccuguacauuuagaacacuuugcuuccuaccuguuuagagacuucuaauuuggcuuccuaauugcuaacagguuuuuguuguuguuuugcaagucagcuuuaucucacagucuuaauaauauaugagauguuggaaagacacauuccaaaaugaguuagcuagugcauggguuaccaucauguuuuaacucuucuagccauuuuauaugagauauaaguuuggaaacaaucuugguaguuucuuaaggcuguagagaucauuauuucugagauauuugcuuguuuucugggggaagaggguggagaauuuuuuauuugauaucacuccuaaucuacauuuuucaauucuuauguaauuuugugauaaacagaaaaauauaaauaaacuacuaagaaaaucuaaacugucugagcuuuuggggucuguuuuuaaucguaucuuuuuuccuuuuucuuuguguguguguuacugacuuggaaucuaaaugaauuacaaugaguauuauuuugaaagucaagcaaagaagugaaauuucuuugacacuaaagaagugaauacauuaauuuuuaagauuuuuuguuguuguuuuuuguuuuuuuaagacagggauuucucucuguguaguccuggaacucacucuguagaccagacuggcuucaaacucagaaauccaaugccucugcccuccaacuucuaggauuaaaggcgugcgccaccauugccuggcuaagauuuuuaaauuuucugugugugaguuuuacuugcagguauguauguguguaccagaugcacaugugcaccugauacucacauaggccagaagagggcaucagugcuggaacuggaguuugugaugguugugagcagcugugugggugcuaagaggcaaaccuugauuucucugggagcaguaagugcucuuaacuagugagccucuucuuuauccccuaacuuaagaaucauugcuuuaaaaaaucuuccauaaccauaagccacaaccagccuuuuauaaacuuuuuguuuaaguugaauaucugaagucagugauaaauuuacaaaucaagucuuuaacuugaaagacuaaagucaguaguaaauucacagauugucuuuguauacaaauuugaaaauuuaaauuauucuuuucuuucuuaaccuauuuugggaauuuaaagcauuagaaauagguauuaaaauaaauuuaccuuagaacauugauugucucacaguaaagauauguaggguaacagauuuuuuucuuuuugggaggcagugucucacuauguagaacagccuguccucaugcuaaauccugguuuagcauucugaugacaggaaguauagcaaaguauugcugugugcaucacuggaauuuguucuuuaaccagauguucagaauagggaaauuggcuuauguuccacccaauaaaaaugggauacucuuuggugcuuuauauguauuucuauauuagcuaauauauuaaaaaauaaagaaaauaaccagcagauauuaaaacuaaaacuagccuacaauuaucuagcaaacauaaugcuccauauacacggugacggcagauagugcuuuuuagggaaaucuaauuuccuuauagaaccacaggaauuaugauuagaauggugcauagcauuuaaauaucuuaaagaucuaugaacacuguuauauuugaguuuaaauugucuacugcagaaauuggcagacauuuuucaagggauuuuuuuuuuuuauaauguuuuagguuuugaaggaaauaguuuuuucugcaaguacuuauccuugcuuuuucugaauacauagacaguguauaaaugaauacaaaucucucaguauaauaucacuucaaaauaaaggugauuauccuacaccuuaguguuugcucagguuacaguuugcaaacacuucauuuaauuucaagacuaugaauaccacaacccaacuuaauagaaaguaacagucuuguuuuuuaauauguguuugacauuguaaauaauuauggcuuauacuaauuugauaucuaaauauaaagauuuuaauuuucuuuuuaaacauugagguuucuaaaauuuguucuuaaauguguugugauaaucugaucuuucuacuuuuuuuuucuuaguuuuaaaucuuuuaaagcacccuuucauuggaauuuaagucuuguuuuccaguuuaucuuccuuacuuauauuucuauaccuuuuuuuuggaaaucacuaauauuugucuuuaauuacauuuuacagaucaccaggagaaucccagucugaggacauugaagcuagccgaauguaaguauaacuucguucagguuauuuugugucucaaguugcccuacacuauuuuauuugaaaauaccuuucaggcuuaaaauaaaaaaagguaaaauugaauuaaaaaaagaaaaagaaggaacaacuuuaaauuguaucuagagauuggaacaugucuacuuauaucuccuaaccaaauacuuccaaaccucugcaaaaaauuagaugucuaaugguaaguagauaauuacauacaugauucugaauuuucaauguuuuuugugcccuuggcaguuguugauaaauaggggaauuagaggaagauucaaacaucuaugugccugcuauuaauuuauaauuccugaaagcaagauuguuuaaauaugaccccuguucuaaauauuaaucaucaggugcuauguuuuggguauaaagaugcuugagacuuauaucucaaugcuucagaaagagcagaaucagauuuuuuaauuauugagauagaauuauacuugguauacagugggaauacagaggaguaccaaauuaugcaaaagaaaucuagugcauaguaggaacauugguauagcugaguaaaacuagguugaauccugaaauguuacuggggauuaagcaguuggauauuugaacaguguucuaggccaagucauugccaagguucugaagcaagacacuugaguguagggaaaaguaggaaauugagaaccuuuucaaaauuugacaaugaggaaugaaaaaugaaaauaggaauaacuagaaggaauuaagcaggggacuguggcaaagacuuggugaauauagcacuugcuauguaaguauuaagaagacuggaguaagaggcaagcuggcugcuagguuagcauaauugacaagcuuugaguauagugaaaacaagccucugacuucuaaacacaccucucuacauguauaaaucuaccuauaccaucuauguuaaugcacacacauaugcauuccugucuuaagaaaugaggaggaaguaaagauagauguguauagcuauguuuaaggugugguugaaaaaguccagguuuuccuuacuagaagcagauuacaucccuuuaaaugcuuaaguacauugugaagucuuaagaaacaacuaugaauuauccuuuaaauuuuugagaccauguaacuucucugauaacuuuaaaacacuuauaaaauguauaaaauuuacucuuuauuguucuaaaguauaugagccagugguauuguaaauauuaauauguuugagcauuugucaucagaacuguuugcauuuugcccuacugaaacuuuguaugcauuaaauagugaccuguuucuuccacuguggcuggcaauuaaauucuacuuuuugucuguggguuuggugcuucuaacuaucucaaguaaguguagucacacaguuuuuguuuuguuuugaugacuggcuuauuuuauauaacacaguguucuugaaguuuauguguagcauauacuagaacuuccuccuuuuuuuuuuuuuuuuuuggcugaauaacacuugcuugcuuguauaugcuauauucugcucauuuguuaauggguuaauucugugcuuuagcaauugugaauaauguugugauuagcaugggucuaaucuuuugucaaauucuuuugguccuauagaauaucaugguaauuguauuuuuaauauuuugagaauauaucaugcuguuuuaaacaauagcuauaccauuuuacuuacauuucuuagaauaaaaguuuuauacauuuuuuuuuuacaacuugacccguauauuaaaauuucuuuggggaacaauagucauccuaauggaugugagguuauauuuuauuguaguuuaguagccaaauaacuuuuguuguuguuguuguuguuuaaaagaaaacucguuuauuuuguauaccuagauagcugcagguauaguagaaacuaaagaacugccuuccccauguaccuuuuuucccccuccccaucgagauaggguuucucuguuuaacccuggcuguccugaaacuggcucuguagaccaauuuggccucaaacucagagacuggccugccccugccuccuaagcgcugagauuaaagugugugccaccacaucuuugcuccccauguacuuuuuuuuucuuuuucuuuuccuuuuucuuuuucuuuuucuuuuucuuuugaaaaagguuuaaugauguuuuguggaacacuauaguuauaauugaguugagauugaguguacugaaaacuuaccaagauaugaaggguuuuaaaaaaacagaccaaauguugaaaguuucaugcacugaauggccugcuuaguuuagaaaccucauagugcuugcaguuagacuguaccaguagucucuaauagauaauauuuuagauugaauauuagcagaauagauaggacaaaccauuaguaguguuucauguauaacacuuuuagcauuagagcauuuuaaguuugcaugcuauuauugauggccagaguugagaauguugugucaucagaagauggaaaaaucaggaauuaagucuuuugucacauaaagcccagaaccuaaugauaucacugaugaaauucacuaaaccuugaagaacuaauacuauaaguuaagucauuacucucauaugaaaacaaaagucuaguacuauaggcuaguaacaaaaguucuucagaaaggaauaaccaacugaauuaaacaauacauaauuauuauucauuauaauuaaguggaauuuauuuuagcccaguauggugguguugcaugccuuuaaucuuuaaucccuugggaggcagagacagucaggaggaaguucuaggacacccaaagcuacaucaagaaacacugucuugaaauccccaaaagaaacaacaucagcuaaaaucaaaacccaagucugccuaacuacaggggccauauugccuuacucucugacucaagcauucuugaggcugcaagguggcucagcuauuaggagcacugaccacucuugcagaauaaaaaaaccaguauguuaaauaggacaaaguuguguccuuaguuaauauccucuuuuaaguaucaccuaauauauuaaaacaggaaaagcuuuuuaauuaguguuuguaaauuuuguuuuaaaaacauaacuacaaaaaauagacuaaugggguuauacaaaacaauagcuuucuacacaagaaaagauauaguuaacagauaaccccccuauggaaugaaugaaagcauucacaugcugaauaguuacuuuaugaaauguguaauucagacagcucauggaagaaguggauaggggaccuaaauaggugcuucugaacaaguaguuccgguaggaagauagcucaguagguaaaaugcuugccuaagaagcauaaggaccugauuugauaacuuucauaacaacauaaaaaugcagugugugguaguguacacauaaaauuccggugcuggggaggaagauccaggaggauccauggggcuaaucugauugguaagcucuaugcuggugaaagaauguggaacuggacuacaguccagaggaugacaaguaaggugguauagaccagacaggggaaaaaaggaguacaaauggcaaagugguuaaaugaguuuuuaaaaauuauuuugauauuauaauauuuuuucuuuuccucuauucuuugcagaaucucaaauauuucaauucuugcucuuuuucuguguugaggaaaaaccuauuuauuuauuuuuguuuuuugagacaaguuuuucucuguguagccugaguguccuggaacuugcucuguagacaaggcugacuucaaacucagauauucuccuguuucugcuuucugagugugagauuaaagguguuguaccaccaugaccagcaucaaauucaugagaaaaaaaauucuuuaccuuucuaaucaucuaagaaaugaaacaacagugagauacuacuuccuaccugcuagaauauaugaauguucauguuggugagguuguaagcaaacagaaaucuuguacacaguuguuuggaauguaaauuagaucgauuauggaaaauaacagguuccuaaaaauugcaaugaccuagcaauuguauuauagaaauauauaguguguuauaagagauaccugcaguuuaauuuugauugcagcauuaauuaaacaaaaugcagaaauaaaccaguguuugucaguggcuaaacaaauaaaaauugacauauaugaugauguaauuuuucgccauuaaaauuuuuuucugaaaucuuaugucggugacaacauggauggaaaugauccuuuauauuuucaaugaaauaaaucagcacaaaaacagguagugcaucaucuuccuguacauagacuguaaaaacauucuaaaaauuguuuguuacuuagaguagaauaaaugauagacauaaaaaaugcaaaaugaauagaauguaguucaggaccaaaauuguagagcauggugacuucuuucuguauauuuucuugaauaucacuaaaagucaacuauuaaguauaugugcaaaagugcuauguuagaauuuauaaacucauuugauguaucacuuuugcauaugauaauauauguaguucuuauuugucaaugaaaauaaaaacuuuggaaaaacagccgugucuucauauauuaaaauuauuauugcaugagugaguguuuuuaacagacgaauaacauuuuaauaauccuacauaugguguuuauuaugcuuaagauaaaggaguuaugguuggaaauaaagagauuguaaaguucucuuauuaagaaauacaaauaauuuuggagacucuuaauacugggauauaacaugcacauugacauugauguccuuuagcccaugaguuuaauagaagaagaaagaaaaccagaagauaucuagguggauuauaugaaaauuucauauuaugaauuugugcauauagaaguauuaagaauuuugauauuuggcuggguauguuugcuugcuccacuucuguacucccgguacuugggagcuuauucagggacagcuucgccuauacaguaaggcaagucaaaguuacaugagaucauggcuuuaaacaaacaaacaaacaaacaaacaaacacaaaaagcagcuaaaagcagggccuaaagaguuggcucaguguccugcuuuccaacuauguggacuagaauuucagaaccuauguaaaaagugaggcaaggccuuucaucccagccuugguggaggggcagaaauggaauggugguugaaauguguucauucagucuagauaauucagcaagugucagguuuagggagagaccacgucuuaaaaaauugugugaggagcauuagaaaauuaugaccgccuuugcuuucuggucuccaaaugcacaugcaugggcaugcaugccuccauguuugugugcacaacacauguauacaccaccccccaaaaaagccagaaaucaauucauccaaaauagaacuguuauuuguaugcuaucaaucccuugaaaucugauagacauuugcaucuuauuuaguaggacuuuauuuuaaaccaaauucuagaaagcauccuuaguuucucuuugugucacauauuggaacuguuugcaaguuauguugcauuuaucuucagaauacauuucagcuucuuuaaaaagcauuuguaguaccauugccaucuuuugauaagggacaucauuguuucucaguacuuuuguuccuaccucuauuuacuaccaacaauucaaugggcuuuucugauuaaaaaaaaguuaagccaucuuuucuauacucaacuuuucaaagguuuccuauuucuuaaacuaugguuagaaauugauacagcccugaacuggcucuuucauuuaugugacauccuguacuagcauuauguucuuaaccugcaacuuuugagguuuuaguucuggaacuuacugacuguucccucuugaguuaaucuacguguuuuucuuuuuuacuuguuucagaauucuuagauaaugccugucauagguaucuuuucugaguaucucuaucaaaauaugauugugucccaucuucucaauucuuacuauuuuccuuucugagauuuaguaucacuucauuucuuuuaaggucucaguagaaugggaaccuaauguucuguuuauauuuaacagucuaacaaaaagaaacuuaggggaguaaaggguuuauuucagcuuacauguuauaggccaucguucaaaguagucagggcaggaacuuuauacuguugcugacucaauuuucagaccuaagcauugcuaacaccacuuacuuacaguccaaaaccaccugccuagggaaugcuauuauccacaguacacuggucccucuuacaucaaucaagaccuuccccuuucccccagucacacccaugggccaguuuaaucuagguagucccucaauugagagucccuuaggucacacuacacauuagacuaucaaauucacaacuaaagcuaccuugaauacguagcaaaauauauaaggaauaguuaguuaaugaguuaaugcuugcuuacuaaguguuagugaaaaaucauuaaauguaugaaaaauauuuagugucucagaaauauauugugguagcaguuuauuucuaaauaacuauuacauauucucagccugugauuaugagggauaauacauaacaucuuaagaauaugccauuugacaaaucacuuugccuuguugauccuugaauguuuuuucagaauuuuuuaugagagcugaacauuuuuaucagggugacuucugguuauaagaucggaugcuuuuaaguuucugugugaaacugaacucuaauuauaggugguucuauuuucaaaaauuuuucuggguuuuuugagcauacucuuggucagauugaaccuuugaagguucuuuaaccuaagauuagccuucuaauauggagaagaaaucugagaaguuuuucaucaaagucaaauaacuagaggaauaccaacuaaaaaaaguaagcaauaacaaaagagaaauuagagauuauugagucuguaauuugguauuuuggaagauacaaggauuaguuauugggucaugcuuucacuauauauaguuaguguggaauaguggagucagugauugcuauuggaccacagaaaugauauggaaacuuugggaaugaacugugauauaacuaaggaccauugguugguuauaaguugaauaucuccugauuacuuuucucgucagauaguuugcauagcauugucaaguuguacagauccuaguuaguagagaucaagcuucaaggugaguuuuugcuuaauuuuuccauuucuuuacugaaguguguuauaucuucaguaguagugucuuacugucaaguucuggagaguaaccaaaaacuauggaaauaaauagccagcauuggaagagagugaucacugggaugucacuggucaacaauucaagagguugaaguuuaauuuuuuuuuuuuuuuacaaaauucuuuuuuccuuuaaaaaaauuugaaaauuucaucuagucucuaaaugaauauaaucacuuccucaacuccuccucuuacagcccucucaacccuuccauuauuuuaagauuauacuuuuucaaacuuuuuuuccuuuauucuccauugagucuaguuuugcauugucaggcuagucuuggaauugggaccugcuguaguguguagucagauuaccagggguucauaagacacuugugguaggaugacaucucuacccccacccccccaugcugggguuuuggcuggcuguagcuuggguguauuaucguaaugacuugucauaaguucauauaugcaucuagucucuugcucuuggaaaagacuguuuccuugaaguuauuuaccaccugugagugaccaucuuuccagcucuuuggggugagauaaaugucugauuugggauugagcacuuaacacuuucuuuuucuugccaugcuuaccaguuuuggaauaggaucaucucuguuacuugccauauguuacggagcaaagcuucucuagugaaagcuaaaauaaugggcuuuucucgggauauagcaauaaucauuaggagucauuuuaauauuaugugcauuuagcagaguaaugguauggguucuacccuagggccuauuaccuuaucuauucacaaguucuuggcuccuuuaauaguauggccuccacuuuauagaguagaccuuuaaugcaaucauauaguggcuaguuacuccuaaaacaccuaugcaauuauuaguaauccuaucuugucaggccacuuuuagccuucaggguucauaacuggaugagauugaggccuuuauucucaagagaguuuauauagcacuugccagcacaguggauuauagccaguugugauaaaguuuuccagugaguaccagcauaaugucuccaugcucugugauucaaggaugugguuggugucuauagcaaucugaucuuaccaucaagaaguuuucacuucgauuucauuacuugaagugucuguuuuuaugucagcaccaugcuguuuuuauuacuaaagcuuuguaguauaacuuaaaaucauagaugaugauacugauagcacuucuuuuacuauucaggauuguuuuucugucauguguauuaugaaauaaauuuuaguguuucuuuuuaugaaaaaucaagcuaugauuuugauggggauuauauugagucuguaaauuguuuuagguagaaugacuauuuuuacaacauucugagcaugggugguuuuuuuucaccuucugguugcuuuuucaacauauuuucuuuaauuuuuuaaaauuuaauuauacaacucuuguacuuccuuaguuugauuuauucaaauaauuuuugagguuauugugacugggaugguuucccuaauuucuuugucuuuuuguuuauuauuuguacaaagaaagacuacugaguuuugugucuucauuuuguauuguuacuuugcugaguguuuaucaacuguaggaguuuucugguagauucuuacaguuugcuacuuacaggauuuuuuuuuaauagaaccauuuuauuguaaauaaagauaauuugacuucuuuccugacuggugauuucuuuaguuccuucacuuacaguauuucucucaucagcacuucaagcauuauauuaaccugaaauaacaagcacaggcccagaaugugcuuguuuuguuccuaauuuuaguaaggaugcucugaggguuuuuuuuuuuuuuucauuuguuauuuaacauguuugccaggaauuucuucuguuuuuccuuuauuauguugagauauccucuguguccuaagguucucaggauuguguuacuugauucaccuacauguuucugcaguucucauucagccauuuguuuauauugucuuugaguuccuuuaacagggauuugcuguuugaagauauuuucuugugcaucauuuaugaugcuuuucucagagaugaauaaacuguggguguuaguuucuagaggagauaauugucucuguguagcccugacucuccuugaacuagcucuguagaccaggaaggcuuugagcucacagagaucaccuguucaguaauguguuauuuaguucccaugguuucuguaauaucuuuugcuguuaauaucuaauuuuauuccauuguauucuauacaaagaaguaugguauuacaguauucauauauuaugacuuuuucagugucuugauagguaguugauuuuuguagaaaauuccauagacugagaagaauguauuaguauauggguggaauguuguacaaauaucuauuacauucauuugacuuaacuccagaguuucuguuuuaauuuuuguccagaugaucugucugcuggagagaguuggguagcgaagucacccacuaucagucacuguugagacugacacgugguuuuagaucuaauagcauuccuccuaugaaauugugcgccucuguguugcuuaugugucuaaaauuguaacauccaccugguagauuuuuccucuaauuuucuuuauuuuguaucuuuggagaagggauuaauuaagaccauuuacaaucagaguucuugaaagauguguguuuuuucuguuuaucauggaaaauuucuauuugucuuugaauuuuuguguaaaguuuuacaaguguaaugcuuuguguuaccaguugugaucuuucaggauccaggcuagcuguuuucagccugagagucauaacugccacagggguugcguaucagauaucccgcauaucagauauuuacauuaugauugauuauaguagcaauaguuacgaaguaccaaugaaauaaucuuuugguugggagucaucacaacaugaggaacuguauuaaagggucacagcacuaggaagguuaaggaucacugauccagacacuucaugcuuuaaagacuuuuguugaauagauauuaauuuugaugagccugcuuuaugagugaugucacuuuuuucuuguauccuuuaguauccuuuagucuguguuuuauuuauuuauuuuuuaacuauaauauguugggaagaauuuauuuacuggccuuuuguauuguguuuuucuaggcuuuuguccacacaucucuacuugcaaauguucauugcaaugaguuauuggucuauuuugaggccucuagguucugccguauuggauccucaaccaggacuccuggauauccuguuguuacccugugucauggagauccugcaguuuuggaugugcagaacuggcaacuucauaaguuccagcagaucauaauuggaguagauguugggguaggcccugggucugugcuugggagguaguugaguuauuuuucucagccgaggucaacucucaagcacuauccugcuuaacuuacccaaugaagcaggaucagcccuugugcucucaauguccuugcauccagcuuaccugcaacaucaccauagccagcuuuucugagcuguuauagucaauuugcaggaccugugcuccugagugauucaaucaguaagggaaagggccaguucuaccugcuguagguagugagagggggguagaagaaggcaucucucccuaccccaugccgucccaccucagauguggggcuaaagcagaucuccaguacauaugcccuuggguuggauuguucuauuuuuaucacagaagaguuuuacaauguugaggaagagggcuaauuuagugcaggauuggaauaucaguuuauuuggcacgugccuuuuuguucuuagacauucuagauacuaauucuguuagauguauaguuuucugcauuaaagauuuucuuccauuauuuugguugucucuucacuacugauuugccuuuuaacuguugcagucucauuugucaguuuuugcuauauucauuucucucucucucucucucucucucucucucucucucucucucucucucucucucucucucugugugugucugucucugucacucugucucucuggguuucuugggaucuuuguaggguuauauagaaaagcccugguuaugucuuucuuuuugcuacaaguguuuaucagaguccuuaaguaaagaaugcuuuuguguacuuacagagauaauuuguucuuuucuuucccauuuguuuuguucugguuuuucuuguuuucucuaugacuucagagugcuacauugaauaauauuauagaaacugaacacccuugucacaugucugauauuagagaaaaaugacuucaguauuuuuuuuuauuuaacauaacaauagucucagguuauuuuauagccuuuuaguauguuugagguguguucuuuucuaagugcucuuaccugguuuggaacucucaaaauaauauuuuuguagaauggcuuuaguaguuuucauucccuguuugguagaacacuuugagguuuuuugccguuuguucuucuauaaagaacugguaauuuuagcaaugaaucuauucuuugcuuuucuuuauugguaggauguacugcuucaguuuuguugcuuucuguaucuuuaguuuuuuuuaauuuccuuuuaauauaauuuuuauagaucauaccuguugaggaauuuauaacuuucuucuagauacuucauucuuuuuaaauguugcuuuucauauuaauuacuaaagaccucauguguuuucaguacuacauuuuauuuuguccucaucuuaaccuugaauuuuauuaauuuggucuugccuuucuuugguuauuugggcuaaggaauuguuauucucuucaaagaaagaacucuguguuuuagaguucaguacauuaauuucuauacuggucuuuauucuuuuuuuuuuccagguauuaguuuguaguuuggguuguucuuauuuuucugagauugugaugugcauuguuaaguuuuuauuugaauucugaccgaauuuucuaaaggaaggagugaaacuucacuguuagagaugccuuucuguaucauaauauauuuuccuuucuugauuuuuuuuuuaacaugacaaaauaaaauacaauaagaugaagcaaaaacuaucaugguagucugccuugguaaacaagaggaaaagagucacaagagcaggcauaagagucagaagccuaauucguucucacaccagggaguaccauacaauacuaaaccuauagcuauuuuacauguguguuugugugcacaugcgugugugccuauguguguguguauuauauguauauacauauuuguaguauaaauauacuacauauauauguaauacacguaauauauguaauacauguaguacauguauguauguauaugcauacauauacaugcauacauacauacauauauaauacacacagacacuuacaaauacauacagacauacauacagacauacauaccugguacagacccacugcuucaguuuaugacauuuccuaugagacuuucguaguugauuuagagggucuuguucugguaucguccauccccucuggcucuuaaaguuuuuccaccuucucuuccaagggcuucccugcucucugcuguaaaguauuugauugagagcucccauuuaaauauucuguccauguaaugucugacuguggucucuccaucucugcaccuguuuccaucugcugccagagaaaaccucuuuugacaguaacuagauuaggcacugauacaauguguauaccauaaucauuuuauugacuuuaaaauuuuuuaagauuuaaaaaaaaaauuuaaaacguaaguaguguuuuuguuuuacccuagguuucugguucuuaguuauccaagcagucuggauauaggcuucuucucauggagugggccuuaagucaaaucagacauugguuggcuacucccacuaguucuuugccccuacugccuuagcauauuuuacaggaaggacagauuguaggucaaagguuuuguggcuggguuggugugcguauaucucuuuugguagcuuguagaguaccuuccuacaccaaagaaguagaguguaggggugaagaguccaugcaggcagcagcuuggcuucuccguguucauuggguaguguggauauuguccuuagcaguagggcucuacuguuaguuuucagguagcaaccuguuguuuugacaacagcuuaggcuguuuggggauuauucuuucuuucuuucuuucuuucuuucuuucuuucuuucuuucuuucuuucuuucuuucuuucuuucuugucgucuucuucuucuucuucuucuucuucuucuucuucuucuucuucuucuucuucuucuucuucuucuucuucuccuccuccuccuccuccuccuccuccuccuccuccuccuccuccuccuccuccuccucuucucuuuucucccucuuccuccuccuccuccuccuucuucuaagauuuauuuauuucauauaaguggguacacuguugcugucuucagacacaccagaagagggcauuggauccuauuacagaugguugugagccaccauaugguugcuggggauugagcuuaggaccucuggaagagcagucaguggucuuaacugcugagccaucuuuccagcccuguuugggaauuucuaugggacccucuucacuuaacugaagugcaacucacuuugguugucuggagacaagagauggccacuuaagauucuauaucuuccauuacuagaccauuuuauuagggucacuuucauacauucaaggacauuuccaaugcacuagguuucuacaccaacauggaaauucuuuccuccccaauuccagcuguuucuaccacacuuucccucaaccccaucucucccuccaccugcucaccuccccacaccugcuuacucucccuaucuacucccaguuggcuguauaaucuauuucacucuucuagggagauccuuguaucccuacuggauccccccucuuuaccuaaccucucuggcucuauagauuguaccuugguuauuauuuacuuaacugcuaauauccuuuuuuuuuauaagugaauacauaccauauuuaucugucugagucugaguuacuucacugaggaugauuuugcuguuuccuaguguguuuucuuuucauuugacuuauuccuuuaaaacacuucuguucugauuccuucaguuacucuuaugauacuuaagauuguauuauauugucuucagguauuuguagcauaccuaguuuuuuuuuugcauuuuaauuuuauucucuuauuauuuguuaaguacaagaaaguaauuuuuacuauuguugacuugccuaauguucaaaaaugugguuuaucucuuagagaguuccaugggcugccaagguuuauucugcagaaggugagauguuuuuuagaugucuugaaauaaguccauuugauguuugguacaguuuagauaaaaucaaucuuccuuccuuccuuccuuccuuccuuccuuccuuccuucuuuccaucagauaaguuauuaauuuggaaaguuaagauuauuacuguauuuuacuguauuuugacuuguuacuuucuauauggauauuguacuuucuggugagagguuggauuuuuuuuuaagauuuauuuauuuauuauauguaaguacacugcagcugucuucagacagaccagaagagggcgucagaucuuguuacagaugguugugagccaccaugugguugcugggauuugaacucgggaccuucggaagagcagucgggugcucuuacccacugagccaucucaccagcccgagagguuggauuuuacaguagucugguagugcuuguuuuuaugaacuuggguacaccaucauuuaaugcauauauacuuauaauuaauuguacaucccucauugguuguuuucuuuuuuuaaauauuuuuuaaaauauuuuuuuagguauuuuccucaauuacauuuuuaauauauuuuuaaagagauuuauuuauuauuauauguaaguacacuguagcugucaucagacacaccagaagagagugucagaucucauuacagaugguugugagccacccugugguugcuggaauuugaacucgggaccuuuggaagagcaguaggugcuuuuaaccgcugagcuaucucuccagcccaguuguuuucuuuuauaguauacagucauauacuuaugucaguaguccaguucuuuuuugauuuccacucacuuuucagucuccuuuuuuuuuuccuuuagcuucuguucaagugaaauacauuucuuauagacaacaaauaauuugauccugcuuuuaauucauuuggcuaaucugucucauaaauggaacgcuaaaaacauuuauauuuuguuguuucuuucauuguucuguuuuucuuucauuaacuuauguagacacaguugcuucuuucuuaauuuuucauauauagaauuacaaaauucauuuuccuugagcuccucuguuuguaucauucugcuauguguaaguuuccuuuaaguguauacuguaguuuaguggucacaaguggccuuauguuaugccuaccuuggaaaguuuuuauauuacauuuaaaagauaacuuuggauauaguaaucauugaaaagauuuuugucuuuaaaaauuucuagugagagguuggauguuacagugaauuuaccuuuguuaguauguugauacuuuuauuuucuuuguaguguuaggauuugagcuacacugugcucaggagcaauucuuucuguccaugauuuauuuggguuuuacacaucuuucuguauagauguucauuucuuucucgauauuuuagaaaauuucugcuguuauuucauugacuuagucucagugcuuuuaaguuccuucugcuccauguauucuuuaguuucauuuugaucauguucuaaaagguuugguuguguuuacuuauuguguuguugugugucugaauacagauuuuucuucaauuccugcuguucugucuuguacuugauuuggucuauuauuuaugguuuccacugagauuuuuaauuauuuuauuuauuuccaucauccucccucccagcaccagucucaauuucuuugcuaaacuucucauugacauguacuucagaauucuuugaacagcauuucaaacaguuggccaucuuuuuauugguuauuaaaugcugaucuucugaaauaacuuuguuccauuuauaauguuuuguuuguuuuuguguucuaauuuguacacuugucaguauggauauguuuuccaguuuuauuuguaauuagccuucuguugaguuuucaauccuuaacacuacucaaaggaggaaagaaaccuccaacacauacaauaaaaccaaacaauuuucagauauagacuuugaauugauugaugccagcauuuauagcaccauugauaauuaaaaauauguuuagaauaauguaaguagucaaaacuuguuuagggucaaauuagaaauagcagcuuaaggaaaaaaaaaaggggaaaggggcaggaaaagaaaagggaagcaaguuuaaaugaaaagaaguagaauacuaagaauaaugggaauggaacaaauggucaauaaguaaagaaagcaaacaaaauagaaagcaaacaaauaaauagaauaguaaguaaauaauagucuuacaaaaaauaaagucuaaaacaauaacaaguaaaaggaaguguauuggaguaauuuauucugcauccccuaauauuccaguccuguuauugaggcuggugcugauuuggaaccagucaaagcucagaugucauagaaaacuaucuucgguuugagauugucaguguuuuugaauaccagugucuuugcuagcugaacuuugcuguacaggaccuagggauuuuuacauuuauuuuuuaaauuuucaccuauuuauuuauguauucauucauucacucauucauuauuuccuucagggacuuuccagcuuuucugucuuaguuggcuacuuucaagccacagggugucucccaaguaugcuuuaaaugagggaagucaaaaaagcacuguuuguucuagagaacuggucucuauacuuuuagauccugccugucgucaccacauugcaagggguaucagacagcuggaaucaauuucuccacuggaccuuaccuucagaguugucaaguacuguaggcagcaacccucaugacagacagagccaauuuuguaggcuugacacuuuauccuccacauuguaggguuugauccuugccacagaagggcugguuaauugacacagugcccuucaagccuugucuacuuugcuugaguuucucagucaaucaagucucuacuccauaucuaccugacucagcuuucuucccacccauagacuauggcaagacuucaccccuuuuccuuauuuguaauuguuucauguuuuucaacccccaagauuguuuguuuucaaacaaauguagaucccuuuucaugacaccugacuaguucuccagaauacaguuauaaacuggauuuuucccuuuccagugcugacuuagaauaagucagugucaugacgaaaccuccaauuaauucuuugugaguacucuugcuuguucugugaucaagacuauugcauuguuuuagucagucccaucuguuuuaccuuauggaugagauaucccuuaucaccaccacuuggcuggagccacuugcugcuuuuccuuuuugcuacauaguauuuuucucuguuucucaguuguaguaucucuuuugugauuuccaauauucuucaucucucuuagaauuugaauuuauccuuugauacucuggaaguuuucauucacuuuaucacauuagcaccuuguagucuugcaucuuauuccaaauguuccuguaucuuuuaucuuuuucuuaucugauagcuaugccuagauauuguacuucauccauuagaggugguaagaguaaauauuucuccuccuccauuucuucuuccucuuccuccuccuuuuuauguuuaucugugguuugcugggauauaucucugugcaccacauguagcauggucggugcccauggagaccagaugaguguguaacuccuccaggugucacagcugacugcaccaguuuguugguguggagaaucaaaucuggauuccuuggaagaggaggaaucagugcucuuaacuacugagauaucucuaucacugggagugguuauucauguucucaaaugagucugucugaaagccuuuuggcuucacaagauuucuuuuaaguaaugggauuuuagcaaggacauguguucuuuuucaaauguguuuugugcauugguuuugacuguauuuagauuuaauauguguauauguauauguguguguauauauauauauauauauauauauuuauauauauauauauaugcauauaugcauaugcaugcuauaugugugugggugccuguggcauuuaaugcucuuaagcuggaggaacaggcaguuuugugagccaccugacaucaugcuaggaacugaacucuguuccucugaaaaagcagcuagugcuuuugacuagugagccaucacucuagucuccuaucagguaucugcuguuuguauggcagugguacuaacucuuuccaaacuaauacaggacagauuuccauuuucaaaauucuuacuuaggaaauauacaaguucuaaaacuagcauucacuacaaucagccaauauucaccuucuguuuacagaaagaagagucaaccuaugguuuuaggaaaagaucuuuguuuaaaaaauaauauucuuugaaaguuuuauauauuuauacaauauauauugguggugugccucuacuacacuauguuuccagcuccacuagucaauuucuaaauuuguaaauguuuacuuacuuucuucuaaccaugaaacugggcaggugaaaaacaaacaaacaaacaaaaaaaaaaccccaaaaacagugguuuauucauuuuaaaagauaaauaauucuaugugaaaauuuaauuccacaguucuauuuuuacaacuaguacuuuguuguaaagaugaauaaaagcauuuuuaguauccauccauccacccaucuaucugucuuuaagaaauuuuccuuauuuuauauauaauugacuuucaaaugguuccugauacuaauugggucauauuuguacuuucagucuuguaauacaugauuugaugacacuucaauagacccuaccuuauacugguuuuaacuguauuaugaauaucucugguguuugugagaucacauuuuuuacucuugacaaguuucuacauuaaaaauaacuuggggcaaguugugaaauuugguuuacugauuccuccacauaaaguucauaauaaacucaagaucuuccugccuuagucuaguauaugcuacuauuauaagcauaagccaccauuucuuggaggaguagugauuuuuauaaagguacauccuuuauaaaaccccuuacaaaauaaugagacauuuaccuaugaaagacacuaagcagugcuuacuagauuaugcauggguuaauugagucuugggcuguauauguuucuuaccucuuuuguccaaucuuuguuuuuauucugcuuauuuuuuuaaaaaagauacuuugaauaagucauauuguuaguuaucucuuucauguuucuguuucuuguuuucauggcagcuauuucacuguuuuugauucucaugcugaacuaugugggaauucuuuauucuucuaguguauaaucuccuugaugcuaucuauauauaguuaugaauaucuuauaacuuuaucauuuuuauuaugauuuacuuacuauuccuaaguauucaacuaucccgaaauuaacuuaggacccagcaaauaauguuauuagugcuacugagaacacugaaaauuauuucucuuuauugucauuuguggaaaacaucaauuaguuauuaauuaauucuuucauauaguuuauccugucugcauuuucuucucccugcacuccucucaguucuuuccuccucccuucccucaugcuucagauccacuacccucuucuuucccgucauuaaagagcaggcuucccaugaauaucaaccaaaccuggcauaacaacaaguuucaauaagauuaggcacacacauaaccuucccauugaggguggacaaggcaagccauugggaggauaaaguucucaaaagcaggcaggagagucggagacaucccuuacuuucacugcuaauugucacacaaggacaucaagcuauacaaaacuauaacauaugcagaagacccaggucagacuccccaauuguugcuucagucucuguuaaccccuuaugagcccugcugaguugauucugugggcuauguuuuugugguguccuuuggcucccuuccccucuucagcaggacucuucaaggguuuggcugugggucccugcaucugcuucuaucaguuuccguagaauccguuuuaauggcuucuuagaaaguaauaaagaaguggaaacuauuauuuaaagaggaacacuuuuacugguaggauucacuugauucuuauaaacuaaauaaaaaaggcauauuuuuauuuaaggacucacuauauuguacuuugauuuccacgaagucaguggaauaugaauaggcaaaaguaacugcuaccuccuuuuuguagaguuuugguuaugaauaucaggaaacggauucacuucauuuccugaacuuuacuuugguuuuucuuuuauguuccuuccuacuuccccacucccuuuuuguuaaaguacuaaguaggaagaaagaaccuuacucuauucaucuucugaggacaaagagagaaaguaaggaggccagaugauugguugaaaguuucacuggcaugcacagggaauucauuuuaaggugacaaagcauuuuacuuuuggcuagauacauuaugauagagaacauacaggaaauauacaaguacuugaaauuuaccauguuacauuagaaauuauggacauagacauuuaaguuuuaugcaauuuucacacaugaaacaaaauauaauuuuuuaaugauuuaagacuauaaaauauucuaaacuucaacuguaaaaaaaguagauuugacacaugagguaugauuuagugaccaguccuauguauggauuagcauuggaagguuaucaaaagcuauuauuaguauguauguuuccaacuuuagaggccuuuuacauguccuuaaugaauuuauaugcccugcauuuggcauucaaugguaucauuuauaaugagaaaagaauagcuuauuauuguuaauuaaucauauucaaucauauuaaccaauuuaauuaacuuaauauuaauaaacgcacauuaaucaaauuagucaacuuaauaugguugauuaugaccucuguuuauuuaauuuaauauaauuauuaguauuagugggcuacuacuuguaacuuggugcaaaaaagcuggucaguuucaaacauuuucucugcugucuccccuuuaguaaugcuaaaauuucaaauuuuggaauuaagccuagauuuuaauuuuucagauuuagugcaauggaguucucuugaccaagucauauacucaugcaaaugauagaaauuauagcaauugcaauagcaucugauacuuaccauuagggccuagcauguagcagguaauacauacuauuccauuaauugaggauuucauauaugauacaaugcauuuugcucaucuucaccuccuauuuuuuuccuaccucuuccaaaauuuacugaaauagucuaaacacuuguaauucuuaaaucauuugaauucugaaauauacuggcauccuaaggaugaggaagcugagacacagaaagagacuaaauaaguaguuaacucagauacagaaacuguucaugaacccaaacaaucuggccucaaaauugugaauuucuaccuguuacagacugagucuucuuauaaagugcuuagcauauccauuuucaauaaauuaccgauaucuuaaguauagugauauaauuuauucaggaguuucuauacuguacccagauaguacacaugguuguuaaguuuagauuggaauuuuuuggaagauuuuguuuucuaauuauauauuacuuaggucuuuuuuucccccuuaaaacuuuuuaggacugcugguauuaagaauuaauucuucugaaauuauaaucuguaaaacagugauuggaaauaaauugaauucugaagcugaaaauuguccugacuucuuuaauggacauagcauaagaucaauuauaagauuugaucuuuucaggucuuucucuuuuacuagcuguagacagaagauaaucuucaaguucaaguuucauaugauaaucagaguaccugacaauguacugaguuuauuauuuggcauguagagagugcuagcuagacaaauuauaaggacauaaggugguaaaaugaggccuagaaaauuaguucauucaacuaauuacauugagcugacuuuuggauggucucauuucucccuucaguauugagaguucuuuaucacauaaagaaguaguguguguauguguguguguguguguauggguugggggggcggccuaguacucuuagaaaacuaguguuuugaacuuugaaauuaacgcuuaaaaauccuggauauaaacauaaacauuggcucuauuuaaaucacguagaugaaguuuuaaaacuuccguacugauacuuagaaauuuuuaguguuuagguacauacuuacagaaaaaacguagcuaggaagaauuaacucagucaauuauuuagaaaaauaguuaauauuucgaaacauucauccuacauuuauaacuugaucacuagcuuuuguuaaggaaguaacaaaauuaaaguaguugguaauuauuuuauuuggugcaugcugucaguauauugaagcgguuugcuguuguuaagcaugcugaguuuccauaaauaauagggaaauaagucuuccuuuugaugaauuuuucucauaagugguaucucuaacuucgugauacauuuuaaacuucaucacauuuauuuauuuucuguagauacaugugacugggcauauguuuugguguguuuagaguucagaggacaacuugugguaauuaguucucuccuuucaccaaguuggauacagggaucaaacuugagucaucaggcuuggccuuuguacacuaugcaugguaaauauacagggaauauuucuaaauauaaguaucugaaugaguuaggaucguaugacauaccauucuuugucauacaaagaaugacauaguccuaaagucacuuaucagugccauauuuguuuaucucuagugccauuagucacuuaguucuaucuaaaauaaugacaugaaguuuuagaaugaaauuagauagauucuuucuacuugcaguucccaugcuuguauagaaccaaacggauuccuuagaaugacauuauuaugggccagauauacauuucaacuuaaauuuugugguaaucuccaagaauagaauuuuagagucaaauuauagaauuuagguuauguagaacaacuucuuguuugguaaaauaauucauuccuuuaauuguauugguuacuuugcaugaaaaauauguuaaucaaauguuaauuuuaauguuuaaaguugaugaaguaagaugaauaugaguuuccccugauggaaguuuaaaccuuuaucuuuccuaugacaaggauuuaaugaagauagugacaaguaugggcucaagguuguaugccuuggugcuucucucucgguauaauaugaaauuagauaguuuauuuauaaagcacuuuuaaauaucucaugauuacuuacugaguaaaaaauuuuaaucucuagaaguuugauauuaacuggaaaucaaguauuugaaacuguuaaaaugaauuagugauuuuauauuagugaaaagggaaacugccauggagauguagcagugaaguuuguuuuuguuguuuucugcuaaauaguuaaggguccuauaccaucaacuuaagcuuaucuuuuuuuaaaccaaagaaaagccugccauauuaaaauuaucuuauaagcugacauaguuuaucacaguuuuuuuagaaaauguuuauuauuuuacuaacacuuugggagguaguagugaauuuccaguuucuacaucuaaauauuuaguuuauugcuuuauugcuuagcuaacuuuugccuuaucuguugggcuuuguuucugagcuauacuaauaaaugugcuuauuguuugaaugucugguacaggaagcgagcagcugcaaagcaucuaauagaacgcuacuaccaucaguuaacugagggcuguggaaaugaggccugcacgaaugaguuuugugcuuccuguccaacuuuucuucguauggauaacaaugcagcagcuauuaaagcccuugagcuuuauaaaauuaaugcaaaacucugugauccucaucccuccaagaaaggagcaagcucagcuuaccuugagaacucaaaaggugcaucuaacaacucagagauaaaaaugaacaagaaggaaggaaaagauuuuaaagguaagagauuauauuucaauucaaaaugguuaauugaaagcuauaucagauuuaaauguggaggggguuguuuauuuguuuugauuuuguuuuuuuguuuguuguuguuauuuuguuuuuauuuuuguuuuugcuuuuuuuaucaccuuaaguuaucgcacuauaauauaguaaaagucaccuuuucugguaaacugugguaaaggacugguauuuaguuuguuuacauuuuauucuuauauuuuacugauucauuaguugucagucagaagcaaguuauacucuaaaaauuaauaugaugaugaguugaacucaguuuguaaugauuuauauuguagcuaauaccuuauuaggucacaaaaaucuacuauguacauugcauuugccgugaauaccuaguaucggcucuagaacuccagggacugugguaaaaggagaaauacaaauauaaaguguaaaguagucuuuuuuuuuuuuucuuuucuuuuuuuaagaaagcaggguaaaauuuugcaauaguuaucugaaaauuacauuuuuuccuucuuacauucugcccucucuacgucaggaauuagauauuuucauacugcuuagggacguaacuuaccaguaauagucuuuacucagcucuugugggguuucguuucauuuuguuuugugcaaguuaaguggcacuauucuuguacuuuuaauacucacacuucuauuuccccaguaaugaaauuaaaguuuuauacucugauaccugguacugaggauagccucaugagugaaaaauaagcacucacgauuaagcuauguccccaaugcaucuaguauuuuaaaaauaguucuauauuuugaaaauucuucaaauuuccuacuuugccucaugauugauuuuguucaaucuauuuuuuucucuuaauggaaguaauugaauguuucagauugccagggauuaguuccacuaucacuugaaacauguuuaaaugaauuagugaaauaaaauuauaguacaacuucaugauauuacuuucacaauaggacuaaagaaaaaucagaaaaaaaaacuuucagcuuugcuacucaaaaauauauagccaguccuauuucaugaauuuguuuacauuguagauaaguaggugaaugcuaaucaauauuuugaaugugaaaauugcauuggcucaauuauacauguuucuacaacagaguggacaugacagaguaacaguaaaugaaaaauaguaucccaucauaguugaaugcaacuaacugugggaaaaaucuaguauauaauggauauaguugccuuguuuuagcccauggguguuccuuuuuuacagguucuuuguuuuuguggaucacuccaaauuuuauugccuuuacuucuuuaauauuuuugaauuauauaugcuuaaucauguuucccucaguuugauaauuauauuuguucacuuuaguuagagguguaguuaucagcuaguguaucacaacucuguuuuugcgugaaacuguuuggaguauaaaauguuauguuuuaaagauuuugagcugauuuccaguucuguuucuacuaugugaaaccaugucucaaacaguuuucaagcacacauauauuagaauguacaggugaaucuuaaaaaaaaaaaguuucuuuacuuaacuguuuguugauacccagauuagaacuuuuuauuucugauugcagugauuuauaugcacacaugagaggggugggggagauggagauaaacauuuuaaacauuuuaaguagaguacuacguggaacaaauaucaaugaauaguaguuuguauuacuagaaugucagagugauuuaaugacugugcucugaaaggaagacauugcaaaucaaagguguguggaucuagagcuuuauucucuuucaggcaggauguauauuguucuguauguagaauuugcacuuucuaacuaauuuuauaauucaaugauagggagauaaaacauuauauucuaacagucugccuauuuauucauuacugauauuuucuguguuuugguuacaguuuagagaaauuugguagacuugaaugguuaaagaagauuccauguauuuuuuucaguuagaauaacgagaaaugagcuccauguuaguguuuucuuuuuuacuuauucuuaguagacuaagaauugaacuuggcuugccaugcugccucagauagggacauguaacuacugaaacucacacuguagaaggagaaaauuaauucuuuuagguuaucaacucagcucaauacccucaucaccucuaauaaguaaauagaacauuuuuuuaaaagaaagaauugaagaucauaaaauuaaaaaguaucaauacucuagaaugggccauagacagguuuguaguauauauaguuuagugcuuugugguuuauguuuuggaagccauuccaucaaugaggacuugaauuuuauauuguuucuuauuuuugaauuagguaccuuuaauaauauguagcaaucauaauaaagauuuuacauguuagauauauuggcaauguaugagguguauuaucaauguaaccauaaaauuauccuaacuuaaauguuuaauaauuauaauauguuacucuuuggugaaagagauuagugguuucaacauuauuauuugauaaauauauuacuuucuaaaacuuuaauauguaaaauguuaccuuuuuccaaaaagauaaguaucuuuuguuuuguuaaccugaaaugguaaagccuuuguugaaauuuacauuuggccuaguggugagaagcuagagacuuuuaugaucccaauucuauuucugggagaaaauaaauauagguuuuagugcuugugguuuuugcuuucuuagcuucuuucuucuguuuguuuuuaaaugacugaugacuguaauaauuuccaguugcucuguuaagaauuguuagaaccugaguaauggucauagguaguaguaguuguaguagcaguuuuaacuucaguagaguuuacaugaguaguaauaucuuuuccucagccucugaauggaaauucuggaagaaauuaggaauacauaagaugagucaguuugguuuuaguauauacaaaaguauagaaagaguugauugcaaaugaaggggcuaaggaaaccuuguuauaaaaccuuaccuccuuaguuuuuugagaacaaugcaaaggaaaaugauuucaggauuuuauauaguagcuuuuuguuaagguuguaauaaaguacaaugaggaaaugacaaguauauauauuuguucauaccuacaauuaauguuacauaccaguacaugucuugguuacaaggcaugucuuaauuaucaaugcauaauuaauaauuauauuuuguucaaugaaugccaagaaagggugagauuguugggauuacuuguuaauaaguaaauuacaucauuuaaaaauucuaaaucaaguccagaauguuuagauauuuuacuuuuucacuagcaauuauuuuaacaaaauaaacauguauauuacaacauaaauguucuuuuucuuuccauuuucuagaugugauuuaccuaacugaagagaaaguauaugaaauuuaugaauuuuguagagagagugaggauuauuccccuuuaauucguguaauuggaagaauauuuucuagugcugaggcacugguucugagcuuucggaaagucaaacagcacacaaaggaggaauugaaaucucuucaagaaaaggaugaagacaaggaugaagaugaaaaggaaaaagcugcauguucugcugcugcuauggaagaagacucagaagcaucuucuucaaggaugggugauaguucacagggagacaacaauguacaaaaauuagguccugaugaugugacuguggauauugaugcuauuagaagggucuacagcaguuugcucgcuaaugaaaaauuagaaacugccuuccugaaugcacuuguauaucugucaccuaacguggaaugugauuugacauaucauaauguguauacucgagauccuaauuaucucaauuuguucauuauuguaauggagaauaguaaucuccacaguccugaauaucuggaaauggcguugccauuauuuugcaaagcuauguguaagcuaccccuugaagcucaaggaaaacugauuaggcuguggucuaaauacagugcugaccagauucggagaaugauggaaacauuucagcaacuuauuaccuacaaagucauaagcaaugaauuuaauagccgaaaucuagugaaugaugaugaugccauuguugcugcuucaaaguguuugaaaaugguuuacuaugcaaauguagugggaggggauguggacacaaaucauaaugaggaagaugaugaagaacccauaccugaguccagcgaauuaacacuucaggagcuucugggagaugaaagaagaaauaagaaagguccucgaguggauccacuagaaaccgaacuuggcguuaaaacucuagacugucgaaaaccacuuaucuccuuugaagaauucauuaaugaaccacugaaugauguucuagaaauggacaaagauuauaccuuuuucaaaguugaaacagagaacaaauucucuuuuaugacaugucccuuuauauugaaugcugucacaaagaaucugggauuauauuaugacaauagaauucgcauguacagugaaagaagaaucacuguucuuuacagccuaguucaaggacagcaguugaauccguauuugagacucaaagucagacgugaccauauuauagaugaugcacugguccggguaaguuugacuauuauuuaaaauuggaauuaaacuaaaaccuagacagugauguauuucaauuuauucauuuuaucuauaauuuuggaaaaaaauaggauuauguuaacauuucugaucuguauugcuacaccuuuguugcuucuuaccaaaaauacugguauccugguugucuaaugauaauucucuuuugaagaagaauagauuuuucuaguacuaggggaaugacucagugguuaaaacguuuguugugcaaacaugaggacuuauccuuggauuuucugaauacauguaaaacaggauaugguaguuccauuuguaauaguacugccuaaagcaagauagaaaguauagacagaaaaauccucagaagcuaaucugauauauaaacugacaaauaacuagacccugucucaguugguagaaagcaaagucugauacuugauguucuuugaccuccacacauacguuuuccccuuuuggcauuuacaugcacacaugcaugcaugcaugcaugcauacauaugcacacagaugcgcagacagacaggcacaaagcaaguaaaaggaauggauuuucugaaucuugaaagccagccucauauauuuccauuaagaagaaaagauugguuuucaaagauuggaacacaugacaaaugguauuguuauacacauuuuuaagaauggaagauggaauuggaagaaauaaugcaauaaauguacauuguaaaagaauaagagcugcucuucaaauuccauuauguguaacacaacucagcuuucuauugugaacuugaugauaugaccaggaaagguuagucuguauuaucaauaagacuuuggaguucuaagccacucugucuugugugacauuguaggauuuuguuuuuuuaaauaauaauaacaugaaucuugaaaauucuguaaaguggcuauuuugggagcuuggaauuaauguuaguaauaccagguaaaucuagaugauuuaacugggaagucaggaacuucuuacugcgugauuuuuguuuuuguuuucaaauaacauugccucuugucuuccuuuuuucuacagacgacaaaaauuacagagucccugucaguuaaaccagaaauuugguuugaaaauugucagucacauauuaacaaaauuauauauaaguaauucaggguaucccuugguauuaauuguuccuguuagugcuaguucuuguauaaacuugauguaagauuuaguacuaguuacagauugaagcaucauccuuauagucuaacaaauaauauuaacucauuaacagauaacuaacaaauaauauuuauuugaacauuuauuuuuuuugggggggaauggauugucgaaaucugaaaagccuuaagacugagcuaaauacacauuuaauaaaaaauuuaugcaccuguccuaccugauuuuuuuuuuauuaucuucuuauacuauuuuuuucuauaauaaaguuauugaguuaagaaccaguuaaaacuuggauaguauuuguaaaauuucauuuaggacgaaauuagccccuucuguaguuggaguaaaauuaacaguugagucuuguaauuaugcuaacaaacuguugcuaguaaaucuuauuuaugugaacuagucauaugguuugacaugauucauuugauaauauccauauucgacuaguaguauuuuauagaagcccuggccuucaucaauucuguguguuugucucauugauaagcaguagaauuacaaagauagguacuuuuugagaaaauuccuaagaguuucacccagcucuucuuuguccuauauugcuuucuuuuccacuucuccucuuuuuuucucuuucuggaucauuuucaacugaaccccucuaaaauuucuugguuuuucagcauacuagugggaaaggguuagaaauagaagcaaagacucagacuuuagagaucaaauugaugacccugagcaaaggauaauuauuauauucauauuagauuaauagcaaaaagguggagguuuacagcaagcuguauucaaaagaauacccacauaugaacugauggaauucuacucucuuuccacgucuuuauucuccacaaaucccuauuguuuugaaaccuuguucuuucuuucauaaaaaaacuuggcagaauauucauguuaaucacaaucuuuuaugacccggucauuuugaacugcauaguaagguuguauagagaaggaaugagaaguuuugcagugaacucaacauuaauaaauauaaagaaagaaagaaagaaagaaagaaagaaagagagagagagagagagagagagagagagagagagaaagaaagaaagguuauagaacccuaaccuugagcuaugaaggaaauaauaccguuuucuccuuaguuuauaagugaggccuagaaaagauuacauaugugacuuuuguaaguuuucuauugaaucucacauuucaguguuaauuagauuagcuggcuuaaugguagacaguaggcgaguaaauuagaauuaauuuuguuuguuuguuuguuuuuguuuuuuguuuuucgagacaggguuucucuguguagcccuggcuguccuggaaaucacuuuuuauuuuuauuuaauaaagaauguuuagccuauccuuggacuucugaucuuguuuaucuuuuccacuugagugcuaaaauuauguguguauaacacuccuagccaauucuuuuuuguaagcaaaaguuuauucauuauuuucaaucaguauaacaacucuuucccccaacuguuauuuuuagaagaucugucucacaagagaauagucaguauaaaaguauaagguacuauuuuuuaaaauuuguauguacuaagcaauaaauaaauaauaaagaaauaaaucuacaaauucuacuaaaaaggaaaaaacuccaauauuucuuuugcuuuauuuugaaugguuuuggccuuuuuuuuuuaacgagaaaauuauacagauauaaauacuaaugagaucccagcuuccauuugaacaacaauccuaguguagaaguuuuaacagucuuaaaaaaaaaaaaaaacaaauaaaacaaaaaaaaaaaaacaaaaaacagauauucuuuguaggcuguuguguugguuuauuggguaaagucacuugccaccaggcuugaugacugaguuuaauccacaagacguaauuaacuccuuggcacauguuuucuucuaccaccagcaaauaaauggcacauuuuucuccucuuuuuaaaaaauaaagugauuucaaggauauagcauauauaaaaucuuaaaaccuuuuuuuaaaaaguggaauaagaucagauguauccagagacaguauugccaugugcgagaugcuuuagacugcguucacaaucuaaaagcagaauugcccagaaaauaaaaacacagcaacagaauuuaaggucuggacuuuuaggaguucagacuaagaauucugauaggaaaaaaaaaaaaaaagaauucugauaugaaaauguaguggucuguucuuuacauguuuugguacaucuaugcuacaaaucaauauuugggaaacaacaguuaguacaguuuauaaguauaaauuauugaauaauauccauguguagaauauugccaguguuuaaaacgaauaaugaagucagugugacuaaaauaggaguugacagugguaugggacaugaauaaauuuaguuaaguucuagaauuuuccauaguuaaccaaaaauaauugcuaaguuguagaauuggaaagaaaaguccaaaaacccaggagcuggcacacaucgaugaagaaaaaguuguuugaauuacuuccucaauuucucugaaagucuagaugcauugucuagcugagcuuccaucauuucucuuaguauaaauaccuauugcaacaagaacuugauuuaaaaaaaucauuugacauacauugcuuuaauaauggaguuuuucugugcugcucuagguguaauucauucauuaauagaauuguacuuaaugugauuucucuuauuuaaaauuauucuaauagaaauuaauggaagccgggcgugguggcgcaagccuuuaaucccagcacucgggaggcagaggcaggcagauuucugaguucgaggccagcuacagagugaguuucaggauagccugggcuacacagagaaacccugucucguguaaaaaaaaaaaaaaaaaaaaaaaaaaaaaaaaaaaagaagaagaagaaagaaagaaagaaaaaaaaaagaaauuaauggaauccucuucccuuuaucuucaaaauaauuucuuacaaccagaaugggagaugaaguagucaguacgauaagagcuuagcaucauauaauaauuuaaaagaaagaaauuuagagagauuuuuacuuauagaaaugaaagucauauuuagauuuuuaucaaaguguauaaauuacucuucuuggagagucuaaacauuuuuaaauagagcuaauuugaguguuguucaacuuaaauaguaucauuaguaguuuuuuguuuucaguuauguuaacauaggauuuuagaugguaacucuggaugucuaaagguuuuauuuagccugccugccugccugccugccugccugccugcccgccuucuuuccuuguuuccuuccuuucauguuuauuuauuuucagacacaucagaagggagcaucagauccuauuacagauagcuuugagccaccaaguguuugcuuggaauugaacuuaggacuugaaagagcagucagugcucuuaacugcugauacaucaucccuccagcccugucuaaagguuuuaaaugauggcgcuaaauuuuuuuuugauccuugaagauaugguuauagaauguuuuuuuuuuuuuuuaaaucaguauaucauucugcuuagauuucuuggaaugcucuccuauaaggucagcuuguaaaaaaugaucucucuaggauuuuguauugccaaauaaauuaagaauaauauuuuaacaguugaugagagugagauuuccuaguaugaagagaaguacaguuaggaagugauaguuacuauuguacauuaauacagcauaguaauaccaguguauuuuuucuccagcgcuaucuaugaagccaauacuaccuauuuugucuuauauuuuuuucagaauuuuaaguauaucccaauaguuuucauguauccaauuacauguaagacagcuugauuuuacaaauucauuuuuaaaauauaacuuuaauuuuuuuuuuuauacuauucuuuaguugaugaaacaaugguuuaagggugugugugugucucuucuaagaguuacauuuuugggcggguuguauuuugagaggguuuauguagcccuggcuguccuggaacuugcucgcucuguugacuagucuggucuagaucucagagauccaccugccucugccucuugagugcugaguuuaaaggcuugugcuaccaccucucagcaagaguuacuauauuuaaggaaaaaaaaauaaugugacuuucuuugcuaauggcuuuuguguaugguuaguauuaaauuuuauguuuuguuuuguuaccauaguuuuuaaaaagacaggcuacugaugcaucaucucaaacaaaauaagaauuuacaaagucacuuuggcaacauugagaauggucuucuuaaauugcuaguuggacauuuucacuuacagaauuaagcugccaacuauuuuuaaauuauauacaaauauauccugauucugaaaauaauaugugaauauaguugaaaauauugauauccaaagaagucacacaaaaucuaaaagcaaauauuaucucuauuuucuuuggaaaaguagguaaacugugggcuauaagcuugcucccuggauuaaaacuucucuucugaauuacuauuucuuaaguuauuuauccuuuuauuacuucaagggacuuucuguaaaaugguuuuagcagccuacuugcuaaggaguuguagauaucagaacaauuuuaauuguaaagugagcuguaaguuucauaauuuguugcugcugcugcucuuauuccgggaauacuucuguuuuuaaaaucaugugguuaaauauucuagcaaaacuggaaauacuuauuuacuuguuaucauauuuuagauagagaaucacuauaaagcucucacuggacucagauuuucuguguagacauaacugcacuaaacuuaccgaguuugagugcugggaugaaaugcuuguucuaucauauauagaaaacauggaauauuuaaaaauuacuagaaugacaauacuugcaacuucaaacuuagaguuaaugguagagcauuaauuuacacacuucacuuauuuauuugauacuaucucauuaugcuuauuuuacauuucaaacgaaagcaaaaauauagaaaauuauuuuuagugaucauaauagaacauacuagaaccagaauugggggaaaaggguagagacuggacagauguaugcugucuugaaaccaacaagccuuugaaucaauaauuaacauguuuucuuagcaaguugagaacugggagaaaccacaguaauaauaguauauuguguugggaccaaauuugagcuaagaugaucauggaaauuuaaguguacaaaguuauucugucuuagaacagguuucuagcuaaugcuguuguugguauaauuuuguucuccauuucuaagguuaaauucaaaucuauauauuuggcuguaaagugucagaccuaccuauuaauuucuuggggacauaaauuuaugaauuuuaaaagucuauaguuuugaaggguaauauguuaacaguuuugcuccuuagaaaugauauauuaagcauauaccauuagaguaggaagaauauuaccucuguuucuguaauacauuagaaaauaggauugauuuauugaagcuuaguaauuaaauguuaauauuuaguggugauauguggaacuugugaaagaacaguuucuuauauguucaccaacaaaguacugcugaaaauaaauuucaaugaauacugaccugaaaauuggguaugcgagcugagaagguagaucaacuugcaagaagaacugaguuuaaucuucagaacucuauuaaagaaaagaaacuugaagugggcauuguaguccugaugcuagguaggcagguacuggcagagaugccaggggccauugacaguccaaccuauuguguuaugcagucuuccaggucaaggagagauccuuuccugacaaacaagguggacagauccugaggaaauacaucuuagguggaaggagacaugugaauauacauacaugaagacauacaaauuaguuaaaguagaccaauauagagauucuuuacagaauaaauucauaggcccuuagaccccuaaagaugaagauauacaggacauaauugcaacuauuccccccaccccacccccaacagcauuuuggcuauauccuuuacuaagaaaugcauagcuucuuaaacacaguacauacucuuguguguugaaauaaaucuugccaaaaacuguaagucaguuugcuuuuuuucuuuucagaaacaaaauucauuguuuucuuuccauauuguuuuguuauugcugcuucuuauuuucuucuacuuauaucuuacauuuuuccucuucucaacuguccucuuuuuuauauuuucaaucaacagcuagagaugauugcuauggaaaauccugcagacuugaagaagcaguuguauguggaauuugaaggagaacaaggaguagaugagggaggcguuuccaaagaguuuuuucaguugguuguggaggaaauuuuuaauccagauauugguaaguauuagugauaugauuaugaugguguguuagucuuuuaaaguauaaacuugguuuauaaauauuuucaguuaugguaagcaguaaaaaaauugaguaugccauaucccugcuucaggagcuguucuaucacucacuuaauuuagguucuuccauauauuacuuagucaaauauucuaguagaacacaguugccuucuagggaaauuuaauuugaaaaaccuuagagugguagauuugaaaaccugaagucaugagaaucauagguuauauaauuuauccucugguuaauuuauagcuuaauuguccuugagaccaagagcauccauuggugacauucuaucagauuuauuauuugugaacuggaacuuuugauauuaccuggauguauaaccuggcaugcaaaugauacagacauacauaacucacauuuuucaagcuggaaugcaaguaugaauugaauacuugugaaaccaguauuccacaaauauuaaauugcaagaaaaagcuuagacuuaauuuauauuacuacaguucaaggagaaaaguguacuuuucuuuuuaauuaaaacugaaagugaaaauaaggaaacauuuuaaauauuaaaauuaaccugaaaguacauuuuaaugcuuuauuauuuguuuuuuaauacucuuguuccauuagaaaaacauuucccaaaacuuuuugauuugcucauuuugauuuuggcuuuuuuagacaaucuuuuuauauuguauuaguacucuaaccuuaagcucauaauuuuccuuacucauuuuaccaagugcuaagguauacagcccacucucucccccagcuuguuagacuuuguauaaaaaguauuuccugagaagcaacugaaaauaaacuuagaaaaauugaaaggcauauacaauuaguuuuguuuuauuuuauuguuugauguuccguaaaaaaagaaaaaaaagacuaucucuuaauguucaccuagauaaaauaaugaugauaggaaaaaaaaucucuggacuuuggcuuugaauaaugaagaucaugugaagcugaaagaucacaaaauauuuuuuaaaauuauauuagcuuagauuugauaugaauuuuaaguaacuuaaaguuaaucaacuuucuccaauuguuuuuuuuuuuuuuacuuaaucaugcauuuguuucauauguaauuuucagucauuaaguggauaaaaugacuuuuaauuauuucuuuauagguauguucacauaugaugaagcuacgaaauuauuuugguuuaauccaucuucuuuugaaacugagggucaguuuacucugauuggcauaguccugggucuggcuauuuacaauaauuguauacuggauguccauuuucccaugguuguauacaggaagcuaauggggaaaaaaggaaccuuucgugacuugggagacucucacccaguaaguuguccuucguuaauagucuuuaagauuguaucuaaauacagaaguuuaucucaguuuauauaggaacauuauuuauuuguaaacuuuuguugauacugcuguuuaguaaaguaaaauacuuuuaaucugguuaaguauaauaaacaucauuuuuuauauauccuaucaaguauguuuugauugaccccauaaaaaauguugaaaacaucauguuuucaaugucccauaugagucuauguaguaaaguuguugauagguacaguugauauguguguggcuuuuuuguuguuuguuuuccuguuuguuuguuuguuuguuuguuuguuuuuccucauuuccuguacccugccacaaucauggagagaaaguguauauucuagaccaugguaugaaaucuguugcugaacugaucauuugaagaauuuuuaagauugacccauugccugugacaaccuuucuaucuuauuaaacuacuugagagauguggaauauuuauggcuucauuuuuguugacaaguuguuucuacaaagaaugaacaaucuauuauuuuuauuucuuuuaguauuuauuuggcaaccucacuucucuuucugguuguuagguuuuauaucagaguuuaaaggauuuauuggaauaugaagggaguguggaagaugauaugaugaucacuuuccagauaucacagacagaucuuuuugguaacccaaugauguaugaucuaaaagaaaauggugauaaaauuccaauuacaaaugaaaacaggaagguaauuaaauuuuugucauuguuuuauaaauauauaauuucaaagcaguaaaguuuucaaagaauuaccuaguaugguuugaagcaguuauaaaaacuuuacauaaacaaauuuaucuaaauaguaaagcuacacuuuccucuuagauaagagcuuaugugauuguacagaauuguuaauuccccuuuagagaaagacuaaacagacuacaaaagauugaauggguaaauauuacuauaauguaacgcuagaaacagggccuuaccauauuaaaccuaagagguauacagagcccagugauugacaucugguuuaguguguauauacauuuuccauuugagaucuaauuaugcauaucagauuauucacauuagauuugguuuuuacuaacuuuaaaagcuauuuacuuggcaauaggaaauaacuuagcuuaaaaagaaaauauuacauaguauaauuuuaagaaauauauuaauuuauacuuauuuuuggugaaauauuguacugucaugagaucuaauuaugcauaucagauuauucacauuagauuugguuuuuacuaacuuuaaaagcuauuuacuuggcaauaggaaauaacuuagcuucaaaagaaaauauuacauaguauaauuuuaagauauauuaauuuauacuauuauuuuuggugaaauauuguacugucaugauacaaacuacauuuguacuauaacaaauuuuauaauuuguaaaguuuucaaagaauuaccuaguaugguuugaaguaguuauaaaaacuauaaaauuuuauaauuuguuauaauagcuuaguuuaccaacaaauaacauuuuugcugagcuggauacaguagcuaacuuaccaguaccauaauuuccagaggaaaccugagacauucugguuuucucaaguucaguauucauaacaaauuuauauugcauacuagagguucuguuguuauauauauauacagucuuuuuaaaucuuuuauuuuaaucuuacuguuuacauuauuucauuauuauuacuauuaauuacauuuuauauaauuucucuuugauuuacucauagaaucauaauguauaacuaugcauaugaauacaacuuuuauaucugucagaagugagaaauugugaaaauaauuuucuuuguacauauaacaugugauuaauuuuuuaagacuuauguuuauucuucaagaguugcuaaugcuuuuuuaagcacugaaccaacucucugaaaucuaauuuuuaaacauaguaacaaaaaaaauacugcugaagguuuucuugggguggaggguggguauuaaaacuaguccaaaagcuaauuguguuucauuuguauagaauaugcuuucuuguuaauauuccuacaggaauuugucaaucucuauucagacuacauucucaauaaaucuguagaaaaacaauucaaggcauuucgcagagguuuucauauggugacuaaugaaucgcccuuaaaauacuuauucagaccagaagaaauugaauugcuuauauguggaagccggguaagaaagacauauacaaaaaaggucuuuuuuuuguuuguuuguuuuuguuuguuuuuuuuuuuguuuuggguguuuuguuuuguuuuuuguuuugguguacuauggauguuaaggugcuuuuuuuucccccuauaauuuucagaaucuagauuuccaggcacuagaagaaacuacagaguaugacgguggcuauacgagggaaucuguugugauuagguaagguguuuaauucuuaaaaaggaagauuuuauucaucaaacauguagaugugugcuuuuguguccuguaucuguagguacugguuaccaaacaaguaagcucaaaaauagaccuguauuaauauuuccaauuuucaugcagucuaaugcuuuauuucaugaauuaaaugauuuaagucucauauuuucucaacccuuugccuuauuuuuggucauguguaagauggcacauuauuuagucuuuaagauacuugggaagaaccauguauacuagugauucugaacaauucuuaggacaguauuaccacuaacaucguucucuagucaaaugcccuuauuucuacuucuguaauaugcuacuauccaauucugaaagaucuuuccccccaucuucuaaugugacugaucaaaaugcagaguagucuuuuuggcauccacuaugaugucauagguauuuaaacaguuaucuuuuuguagaucacuugagcuauaagacucaaauauguuaacaauagaaugaauauuaacugugucuaguaaugauacauuaucauuguuauauuuauauuacaguauuacuuuauucauuuaaguuuguagaagauuacucuugcuuugcccuuuuuuuuuuaauagaaaagcaaauauguuauuuauucagcuuuuagguaauuaaauaacaaaauucagaguaaagcaaaacaaaaaccauaacaugucauaugauauaucauuucuaagcacaauggcaauuauuaaugaauauaaaaauuuaucauucauauuugcuucuaacaccagucacaaaaguggcaaccauuauauugcugcucaguuuuaaagguaauucauaacagggauaaacaugguaauacagaagccuuaaugggaauauccuaguauuaucucuacaauauggcaaaauaauguuuuagauugauuaugauuaauguaugcauuuugauuauuauccuuuuguuauuggcaauagaauuaucaugacaguggggcuguuacaaauaaaguuuucauucuuaguguugaaguguuuucauuucuccugaagaagcacuuuggaggauugugguugugaaguaaauaacauuuuuaaccuuaagaagcacugcaagaaugcuuuuguaaaaugauacugccauuuuaccuaagaugacaagcagugcuagaacguauucuguaucucuuuuaaucuuuggucauguugucuuggagugugaaauaaaauuuuaccuuaguauaaauuugcuuaucacugaugacucaggaucaugagcugucuuuuagguauuuaucuuuuuuuaaaauauuuuuauuacauauuuucuucaauuacauuuccaaugcuaucccaaaagucccccauacccucccccccucaacuucccuacccacccauucucauuuuuuuggcccuggcguuccccuguacuggggcauauacaguuugcguguccaaugggccucucuuugcagugauggccgacuaggccaucuuuugauacauaugcagcuagagacaagaacuccgggguacugguuaguucauaauguuguuccaccuauaggguugcagaucccuuuagcuccuuggguacuuucucuagcuccuccauugggagcccugugauccauccaauagcugacugugagcauccacuucuguguuugcuaagccccagcauagucucacaagagacagcuacaucuggguccuuucagcaaaaucuugcuaguguaugcaguggugucagcguuuggaagcugauuaugggguggauccccagauauggcaaucacuagaugguccauccuuuuaaccauuacuuugugaauuaucuuccccacucuucuuuccacugauuaugaacuauuucuuuuggaauguauucuuuuuaaaggaucauaugcaaacauguuauacauguguuauucuagucugcagcuuucuuucccccacugaauuuuauuuuuguugaaauugaguuuugugugaguuacuucuagacuugguucuucucugcuuauucauuuguucuuugaucaaaaucacaucuugaugacuccuuuaccuugauagaacaaagagcaagucuuuauaucagauggugagaaucccuuuacuuuuucauuguucuuaauguuuucacuaauuuuacuuccauguaaauauuaaaaucuguuugcugaauuuuacaugaauaacauuuauuuuugauguuuugauuuggguugaauugauuggauaaaucaauuugagaauugucauuuucaucacuuuggauuuucuaaaucucaagcauggcauagcacuuuccauuuaguuauaccauaguuucauccagcauugauuuguaauuuuuguguugaaauaauguaugcuuuagugaauaaguuuaaauaauauguuucuuaugcauuauuucauuguucauuucugagaauaagcuuauaauuacuuucauugcuuuaaaagccuugucaguaaaauucaaacaauuuuuuaauuucuguuggcaugaguuguuuuaauuucuuuguucuuggcaugauaguuuccguuuuauuuuuugagggcuuucuuaaaaauggauuguuuuuccauauaauauauuuauuguuuucccuguccuccuaccccuuccagauugccuacaccuccccucccaucugcucccugccuuuucugacucuuauaaggaagcaaacaagcaucaaggaauaauaaagauaaacaaacaacaaacaaauuaggauaacgcaacagccaagcaagaaaaagaaccaaagagaaaaauuucuagaugauucuauagauguagagacacacauauuuguguacuagagaaucucauaaaaaaugcaaaacucacaaaacuagaagcucuaauacauaaucagaggaccuuuaagauaugggggggagaaacaccaugaauuaacauuaugagaccaagaaccucugcagaugccauuguguuggucaacuaacuguuggauaugggccccacacauaagaauggcauguuucuccagugagacucacucucucucucucucucucucucucucucucucucucucucucucucucucccccucccucccucccucccucccucccucccuccuuccugucuuugaguagaggaaaacuauuccucagcuauuugcauguuggcgaauauauacuucauguagcuucuugccagcuucuuuuugcugguacuucuaacaguaccucagccuaugugguuaucuuugucuuaccuagggucucuaagacucaaaggauaggagagcacuucagggcaacaacuauuccuagcagaacuuugcccauagcccauuaauacuguauauuugaaccauggugcaacuuaauugcuuuuugaaucuucauaguuuuaaucuuucuauuuuagguuuguaaaagauuguaaaauugucuauauuccuaguuguguauaguuuugaauuuaucucuaguuucuuuguauuuguuauaauuuuuaaaauuuauuucuaauugaaccuuauuucugucacauuuuuucaagguuccucucuguuaagguuuucuaaacuucauuucugaucuaguuauuguuuucauagccuuuauuuuagaauuuuaguuuuuacuauguauuucuaauuuucuugucuuuauaguuuucaucuuuuguugauauugacaaaguuuucaugauuauacuauuuaauaaaauuguguguuuuauuuugauuccuauuuuuguuucuuauuuuuuaaaauaacauuacuauauguuuauacuguaaaauaaaauucuuucaguuaauuaaaauacgaaacaacucaacaauagaaaauagguaauuaaauacuuuuaaaaauaacaauucuuugguuuuugauuugauuuuauuuuuuuuuuguaugaguggccugcauacuugagucuaugcaauguguguaugcaguguucacugaggcuagaggauggaguuggauucccugacacuggaauugagccaucauauagggguugugaauccagccuggauccucugcaauaguagcuggugcuuuuagccaccgaauaaguuccagcccuacuucuaaaauuuuaaaugaaaaguugugucaguuuugccuaugucuaauucucuuagaucuugaggccuuauuauguugaaaaucuuggcuucuacaugcaguacagauacaguuuuuuuuauaauguauccaucagggucauaucauauauuuguaaguauuauauauuauacguguuuuuaaaaauaaaaucuuuccuuggcuuuuuuuguuuuguuguuguucuuauccaugcuucuuucccaugaaaagaaugauagaccacuucaucacuauaucuucuucagaaagacuuugaaacuauaacaaucaaaauuacauaguacuacuauuaaaaaucggccauucaaagggaacaguuccaaauacauuguauuuuauguuagaauaauuuuugauguaaaagcucaaguaauuauucauucaaaauauauauauuucaauugcuauaaacguggaaaauccacagucuauuuuagguuuugacaagagaaauaaauuuugcauccuugacaaacaaaacuucuacgcaacauagugauuaucauuuucauuuguagaagaauguucuuuaguuccucuucuauaaagaggaaauaagccaacauaagaaaacagaacaaaacaaagcaaaaaaagaaguguuaccucuggucccccccccccuuuuuuuuugccacuuuacagaauagaugucuauacuaagaaacuuuaaguaacagggagaaaggaaagaagaccugcugcugugugcuacaaaagagaaaaaugauuuguuccaugccugggagaaaacauguuaauagauuaaaagaucagggaucaauuaguucuuacuuucuauaguaaaaauugagcuauuaaccaacuagguaacauuuguuuuuguuugguuuacacacacacaccuuccuccauuuucugguaaauuccaauaagcuucuuucaaucuccuccaaauucuccuccccgcauuauuucucccaccaaucaccuuguaauuucgggcuucaaaucuccuguuacuuuaaaucuaaguggggcacuugaauaguugguggauauuuuuauaauggcuuguugaacuacuuagcuccugguuugguuugcucuucaucuuucauaggguaguaauucauaaugcuacugcccuucuuucuccucaucuuuuguagugcuacuucaguucuuuuuuaguucaaguuaaguuuauuggaaauaacucuuguucuucaguucuuugugccauauccccuuuuuaacuauucauucaaauagguuuucauguucacuuuuaucaguaaauggagccuaauuuuucuuuuccuggcaugcucuggaaccauugcuauaugaaaguuuuccgcuuuuuuuuuuguuuuuguuuuguuuguuuuuuguuuuuguuucaaggucuauuagcuguccuuuuugcuguucuuuuuugcauuucuuuuucaacgaacuguuguuuuuuuuuucuuucaaaaaauuuuuuuaauuaucagugugaauaaaaucaccauuauuuaaugugauuaauucuucauauucucuguucaauucaaagguuuucauuuucuuucuuuuuuacuauuuuuugucuuaguuuuuguccuagcuucuuuauuuuuuuuuuuuuuccauuuuuuauuagguauuuagcucauuuacauuuccaaugcuuuaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguuugcuaggccccggcauagucucacaagagacagcuacaucuggguccuuucaguaaaaucuugcuaguguaugcaauggugucagcauuuggaagcugauuaugggguggaucccuggauauggcagucucuacaugguccauccuuucaucucagcuccauacuuuguuucuguaacuccuuccauggguguuuuguucccacuucuaaggaggggcauaguguccacacuucagucuucauuuuucuugaguuucauguguuuaggaaauuguaucuuauaucguggguauccuagguuuugggcuaguauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccucgccagcaucugcugucaccugaauuuuugaucuuagccauucucacuggugugagguggaaucucaggguuguuuugauuugcauuucccugaugauuaaggauguugaacauuuuuucaggugcuucucugccauuugguauuccucaggugagaauucuuuguucaguucugagccccauuuuuuaaggggguuauuugauuuucugagguccaccuucuugaguucuuuauauauguuggauauuaguccccuaucugauuuaggauagguaaagauccuuucccagucuguugguggucuuuuugucuuauagacagugucuuuugccuugcagaaacuuuggaguuucauuaggucccauuugucaauucucgaucuuacaguacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuggcucccuugucgaagaucaagugaccauagguguguggguucauuucugggucuucaauucuauuccauugguccacuugucugucucuauaccaguaccaugcaguuuuuaucacaauugcucuguaguaaagcuuuaggucaggcauggugauuccaccagagguucuuuuauccuugagaagaguuuuugcuauccucgguuuuuuguuauuccagaugaauuugcaaauugcuccuucuaauucguugaagaauugaguuggaauuuuaauggggauugcauugaaucuguagauugcuuuuggcuagauagccauuuuuacaauguugguccugccaauccaugagcaugggagaucuuuccaucuucugagaucuucuuuaauuucuuucuucagggacuugaaguuuuuaucauacagaucuuucacuuccuucguuagagucacgccgagauauuuuauauuauuuguggcuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucugguggaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagacagugggcagccuugucuagucccugauuuuagugggauugcuuccagcuucucuccauuuacuuugauguuggcuacugguuugcuguagauugcuuuuaucauguuuagguauuggccuugaauuccugaucuuuccagaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauuaagaauuuuugcaucgauguucauaagagaaauuggucugaaguucucuaucuuuguuggaucuuucugugguuuagguaucagaguaauaguggcuucauaaaaugaguuggguagaauaccuucuacuucuaucuugugaaaaaguuugugcagaacuggaguuagaucuucuuugaaggucugauagaacucugcacuaaacccgucugguccugggcuuuuuuuggcugggagacuauuaauaacugcuucuauuucuuuaggggauaugggacuguuuagaaggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcucucucccguuuuuucuugaaggcacucauagcuaugaguuucccucuuagaaaugcuuucauugugucccaaagguuuggguacguuguggcuucauugucauuaaacucuaaaaagucuuuaauuucuuucuuuauuccuuccuugaccaagguaucauugagaagaguguuguucaguuuccaugugaauguuggcuuucuguuauuuauuuuguuauugaagaucagccuuagugcauggugaucugauaggauacaugggacaauuucaauauuuuugaaucuguugaggccugauuugugaccuauuauguggucaauuuuggagaagguaccaugaggugcugagaagaagguauauccuuuuguuuuaggauaaaauguucuguagauaucugucagauccauuuguuucaucacuucuguuaguuucagugugucccuguuuaguuucuguuuccaugaucuguccauuggugaaagugguguguugaagucucccacuauuauugugugaggugcaaugugugcuuugagcuuuacuaaaguuucuuuagugaauguggcugcucuuguauuuggagcauagauauucagaauugagaguuccucuuggaggauuuuaccuuugaugagaaugaagugucccuccuugucuuuuuugaugacuuuggguuggaagucaaucuuaucagauauuaggauggcuacuccugcuuguuucuucauaccauuugcuuggaaaauuguuuuccagccuuucauucugagguagugucuaucuuuuucucugagaugaguuuccuguaagcagcaaaauguugggucuuguuuguguagccaguuuguuagucuaugucuuuuuauuggcgaguugagaccauugauguuaagagauauuaaggaaaaguaauuguugcuuccuguuauuuuaguuguuaaagguggcauucuguucuuguggcugucuucuuuuagguuuguugagggauuaccuucuuguuuuuucuagggcguuguucccguucuuguauugguuuuuuucuguuauuauccuuugaagggcuggauucguggagagauaacgcgugaauuugguuuugucguggaauacuuugguuucucccucuaugauaauugagaguuuggcuggguauaguagccugggcugcaguuuguguucucuuagugucuguauaacaucuguccaggcucuucuggcuuucauagucucuggugaaaaaucugguguaauucugauaggcuugccuuuauauguuacuugaccuuuuucccuuacugcuuuuaguauucuaucuuuauuuagugcauuugauguucugauuauuaugugucgggaggaauuucuuuucugguccagucuauuuggaguucuguaggcuucuuguauguucauaugcaucucauucuuuagauuugggaaguuuucuucaauaauuuuguugaagauguuugcuggaccuuugaguugaaaaucuucauucucauccacuccuauuauccguacguuuggucuucuuauuguguccuggauuuccuggauauuuugaguuaggaucuuuuugcauuuuccauuuucuuugauuguugugccaauguucucuauggaaucuucugcaccugagauucucucuuccaucucuuguauucuguugcugaugcucaaaucuaugguuccagauuucuuuccuaggguuucuaucucuaguguugccucgcuuugaguuuucuuuauugugucuacuucccuuuuuaggucuaguaugguuuuguucauuuccaucaccuguuuguauguuuuuuccucuuuuucuguaaggacuucuaccuguuugauuguguuuuccuguuuuucuuuaaggacuuguaacucuuuagcaguguucuccuguauuucuuuaagugauuuauuaaaguccuucuugauguccucuaccaucaucaugagauaugcuuuuaaaucuaggucuagguucucagguguguugggguucccuggacugggcgaagugggugugcuggguucuggugauggugaguggucuugguuccuguuaguaagauuccuccguuuaccuuucgccaucugguaaucucuggaguuaguaguuauaguugacucuguuuagagauuguucuucccuagcuucuuuaaaaguacacauugcuuuaaaugucauguuucuucuuaaccuugagucaauauuccuguccuuguugcaaugguucuucaguccguguauuauauucuuuuguuuguuuguuuguuuguugcuuuucaagacaggguuucucuguguaucccuggcugugcuggguagaccaggcuggccucgaacucagaaaucugccugcaucugccucccaagugcugggauuaaaggcgugcaccaccacgccuggcucguguauuauauucuuaauuugcucagguccaauuuucuuuucuuucuuucuuuuuuuuuuuuuuuuuuuuuuguaaaagcacauucugcucauuucuacauggucauuccuccucgguucuuuugaguuuuuuucugauuuucuuucuccauuuuagucaccuucaagacugaaucuuuuuguucuuagaagagucucuugcuuauuaugaggagaaacauuucuuuugugaaauauucauacuuucucuaugucauuugaggcuuuguacauuuuuauguucucuucagacacaucagaagagggcaucacauuccuuuacaugguggcucaugguugugugauuugugggauuugaacucaggaccuuuggaaguguagucagugcucuuaaucgcugagccaucucuccagcccggcuuuguacauuuuuauacccauccaguucauaauccauccaucauuaaggaaacuuggagcaggauccauugcagcacugcuugcugauuuauguuccucuaacucccuccucauuuuuuuaaaaagagaaauaauucugucuccuuuucagaagacuaaaauaaacaaaacauaauuguugaccucucauuuuccuaucuaaauuugcucuguuuacagagauuguggagcaguaacaaaauugcugugaucaauaguccuuugccuuguauaucuuuuuugucuuuccuuaauugaugauuucaccugugauuauaaaaauggugauuuaaggaaauaauuuuaucuagucaucugacauaugucauucuccuauuuuccuaucuuuuucauaucaacuauuauauuguuaccuuaagauaucaaucuauugaaaagacaaagucaaauauauuuaagauugauacugaagagauaauaugguaauuuuuuuguuuucagauauuaugaacucaugaauuuacuuuuaauguaguaaauguguuuuaccauuaggacuuuagccuugcuuaggacuuugcuugguguugguguaucuuuaacaugacacaugacuuuguuaaaauuugaaauuuugccuuaucuugaacauuauccccuacccuguaagaaaacauuguuaaaagaaauuauuagaaaacugcauccaggaauaagacuuacuauuuaauguuaugacugguaaggccuugucaaggaacaaaccuagaaagaaucuuuuaaguauauuaucaaaauaaucccuuauuaacauagagguuacuuugcaacuuuuuugcucucuuccagcugucacauaauauugaaguauaguuuucuauuuucaaggucauuauauuaccuaaucauauuuuuaauauugucucuuacucauuuuauuguucaguuauugaucccccucacacccuucuuuugaacaauagcuugcuuguagcauagccuagccuagaacuugccuaccuuuugccucaaccuucaaaaugcugaaucauaggaauacuuuuuagauuuccuuucccuuugccuuuucuuguacaugagagacauuugucucuggaguaauuuacaguauuuucucuacauuaaugucauuuaucuuuacuuguuaggguuuuuuaccaagugaaagguuuuagucaauuaacaauuuguuuccauuuuacuuugauaugcauuucuucaguuuugaauauuuuguuuuaacuccuuuccccuucugacuuccuaacccuuugcuugcuuuuuguuucuagacuguugucaaguagaaauguuggauguuugucaaauacaaauuacuacacuucccucauuuacuuaccucauuuuugaaucaucuuuuauuucuagaguugaugugcauuugccucagaauuuucuuuuuucuuuuuaagaauuauuuauuuauuuuauguauauggguacacuguagcugaacagaugguugugagccuucgcaugguuguugggaauugaaguuuuaggaccucugcucgcuccggucacucugcuuacucuggcccaaaagauuuauuuauuauaauacauaaguacacuguagcugucuucagacucgccagaagagggaucaucucauuacggaugguugugagccaccaugagguugcugggacuuugaacucaggaccuucagaagagcagucugugcuccuaccugcugagccaucucaccaaccugccucaguauuuucaaguguuauuauuucuguuugaauucauuaaucucuuuauuuuugauucaugaugccaucguuaaacuuuucauguuagaguuuauauuauucacgacucagucuuuuuuaaaaauaguuucauauuccaaaaagccuuauuucucauuugaagaacucuucauaauauuccuauuggacuuaaauuuauuuuuuaucauuuacuuuuuuauauauuuccucccauggaccugcucuuaguaaaugucaugggguagcaaagcauaguacagucacuuuaagugguuucucaaugaaggaaaaccuuuuacugcuguuucuuuaauauuugguucugcuuuaugugauucaaugccuucuacuuuucacuuacaauuuuuuaaaaauuaaaaucccuucaccagguauuucuaucaucuuuggaaaguuucgucacuucuuucuuccgcucuuccagugucuacaauuuuuuuguccuauucugauccuuaacugugcuuaucuuguguauuauuucucucuacuuuuacuuuggggauuuauuacuugauuuuccaauuuuauucucagcauagauuacagauauauuuauugcacauuucucuugcuuuggagaagaucuugauagauuuuuagauugagguuuuagaaaugugaauaggauauugaacauguauuuuuuacaaaaguaaauuuuaaaacaucacgcuuagcauuaggaauacaaaaguacuuuuuaaguagaauuacugagcaaaagaguuauuaauauuuaucccauauauaguuccuacaagauauaaaaucuggcugacuaaaacuuacauacuaaguguaaaugguacuuuuaauauucacugugacauuggccuuaauguuguaguacuaugaucuuguuuauaguggaugucaaauuaaaaccaguauucucuuuucacauuagggaguucugggaaauuguucauucguuuacagaugaacagaaaagacucuuucugcaguuuacaacaggcacagacagagcaccuguuggaggacuaggaaaauugaagaugauuauagccaaaaauggcccagacacagaaagguaauaucaaacuccaacuuuguacccacuguaaaccuuuucaccauauuccauacacgcaagcagagccaacauguagccucuauauacucuucugauguuauauugaaauaucuaagucagcaaacacuaguggaauggauauuuucccuucaugauuugaggaauuuuuuuaaaaauuaguguaguuaaaaaguaauuauggagcuuacagaaguacagacguuaucaaguuguuauguuuuauucccccuuuguuucauaguuuauuaagaaagccuuauuauagaacagucuacuuugaauggcuacacuaaaauuuagaggauugucuguucuuuuacauuauacuagauucuuauucuaggguuaaaucauucugacuuuugauuguauucuuucuccaauaaauacuucacaauuuuaugguggggcugaacaauauguccuagguagacuucgauauacaucgacagauauauuuuuauuacuguuaauuagacauuuuauacaucuuggcucuaauuuuaauuaauuuauaaucaaucauuaucauuuucauuuugccagcaguauuucaaaucuauauacagagcauagacuucaaaaucuuuaaaagccagguuugaauaauuuuuaaucuuugguguaaguuguuuagugacuucagcuuuuaauggguuuaguaagauguuuguuguguaaagauuuaaaugaacuucaguguuaaaguaucuaaagcaauagguaacagaguggaaacucaauagauaauaaauguuacuaucaucagcaucacuuuaauuuuugcauuauuucauaggauaaagacccaacugaucuuuuuaacuaaacaguacaauguuuaugauauauuuaaucuguaguuucucauuaaaaaccguccuaacaagauauguaucuaauaggagcauuuaacacugagcauauuuccaaugacucaugauuguccuguuuuucccuuucucuuuauuuagguuaccuacaucucauacuugcuuuaauguccuuuuacuuccggaauauucaagcaaagaaaaacuuaaagagagauuguugaaggccaucacauaugccaaaggauuuggcaugcuguaaacaaaaagaaaaagaaaaagaaaaagaaaaaguuaaaaaauaaauauaagagggauaauuugaugguaauaguaucccaguacaaaaaggcuguaagauagugaaccacaguagucaucuaugucugugccucccuucuucauuggggacauugugggcuggaacagcagauuucagcugcauauaugaacaaauccuuuauuauuauuauaauuauuuuuuugcgugaaaguguuacauauucuuucacuuguauguacagagagguuuucugaauauuuauuuuaaggguuaaaucacuuuugcuuguguuuauuacugcuugagguugagccuuuuugaguauuuaagauauauauaccaacgaaacuauucucgcaaggaaaacauugccaccauuuguagaacauguaaucuucaaguaugugcuauuuuuugucccuguaucuaagucaaaucaggaacuuuuuucuaacaauuugcuuuugaaacuugaagucaaggaaacaguguggugcaaguacugcuguucuagcccccaaagaguuuucuguacaaaauuuugagaaccaauaaagauggaagggagaacuuggaauguuugaaccacagcccucagaacuuuaguaacagcacaacaaauuaaaacaacucaugccacaguauguugucuucaugugucuugcaaugaacuguuucaguagccaauccucuuaguauaugaaaggacagggauuuuuuuuuuguuuuuguuguuguuguuguuguuguuguuuuuguuguuguuguuguuuuuguuguuuaaguuuacuggggaaagugcaucuggccaaaugauaggauagucaagccuauugcaacaaaauuaggaaguuuguuguauaaauaagcauguaaaagugcacuuaaaaugaaucuuuauuauugcugagauuuuaauagacaauccaaagucuccccuucuguugccgucaucuuguuuaaucaaccauuuuucaaggcacucgaucaguguugcagcauaacagaaaguacagcuacugugccuuguguuacuuauuuacacaguuagcaggccuggaaaugaauggaacuaguacuccugagaaauaaauuguauaucccccaaauuaaaauuuacuucaaagguguuaaagauuucauguccuauauuaaaguacaaauaggcuuaaauuacuggauauuuaauguaguuucccaucccuagucuucuaugucugugauguuaauuucuuuuguugcauaacaaaauaaaagaauuauguauuuuuaacuaaggagagacauacugguauaucauuuuacuacaagcuacagauaaccuguugagcuugugccuugauuguuuuaacaacuagugcaaaucaaccugaugauuuuaauuggcaggggauaaugguagcuuucaaaucauuggaaggggaaaaggaugucuuaggauuauuuucuuucuuguaguaguugagacagagcucuuauuuacuguaaugcuaaaugaaacaguggcuuaaauauuuuaaugggaaaagagaacacagugcguuccauauugugauaagguaacgugagguuuuuuuguuuuguuuuguuuucuuuuuuuuuuuucugagcuagccuuuagaacacuguugugguauguaugcuaccuugauuauaggacccccuaaaugugacuauagucaucuuaaugggcaucuuguccacugugcuucuuauguauuaugaaagugauaagaagacaaauuaaguggguauauuuuauaaaauaaauucaugaagagauuuguguucuucaguuuauugucacuacaguauugaaguaguugugauacuauaucugugugaaaguuuucaaaugauaauauagauuaucaaacagaaguaacaucaauauauuuaaaagaaagugaaaaaaaaauccuaaaaaguuuucagagguaaaaaaaaaaacucucacuugcuuccuaaucaguuuuucucggcauguuaccacauuaauauggcugccuuuucaugauugcuuuacuagauugucauggaacaauacuuacgaguuaaaaaauaccuuuuaguaguguagaacauuucaaacuuauggcauaaaagcacagccugcagcaaaacuucucuggaaacuuggcagcugcagcaaacaaauugaguguacauaucguggucuauaguuaauugugugaucaaauucauuugcaauaaccuuaccuuuauuuggaaauacauccuguguaggaauguauauaucaaaagaaaccuauaaaugagccuucagagaacuuguucacauuaacauguggcaaaugcaucaacuaggcagcauuacuccguguuuccauaagguggcuauugcugaaaucaaccucuuuuaaagaauuuuuuucucaagaauccacauacccuagagaaagaaguguuuuacugaggcuacucuuuaagauguucauucuuuaacugcuuaucccagggucuauuuuaauccuuucuacccuucccagaauaaaauaauaauaauaauaauaauaauaguaacuuccauuugcugcuucuuucaucuuuagaguguaaaacaguuccugguguuugguaggaaaaauguuuacacaauauagacagaggcccuuuuuuuuuccccucuucuacuuucaaauaagaaaauugacuuugguaacaguuguaagaauauuugagugcauguauguacugcauuucacuauguaaaggcugcuaauccaggaauauuucacugaaaauguacuugcaauaauacuaguagucuccauuugccacaguaaagaagucuuguuuuuaacccuugagagccuugcagaguugggcuacagcuuccugaaaggcucacuuuuccaucccaacucauagacaccuuguauggauacucuccugauuguacuuagaaguacuccucugaacuuccuguucaacccaaaguuuuuucucuugccucauauuuugugggucucauaucucauaucauaucagacccguguuuccaggacaucauccugguaccucuaagucauuauauaguacaaaacaguaccgauaaaaacaaaauucuuacucuuguaucuccuaguuauuucuuguuacuuccuuuagaacugucaauuuuuuggccuggggagauggcuuaguggguaaaggugcucacuauauaaaacuugaccugaagacucugccuagacuccacauaaacauggaaggaaagagcaacuccacaaaguuguuuccuggccuuuccauguuuaccauagcuuuugcuguuuccuacccucucacaguuuaugugcauauauaugcauguugucaguuauugucucucagaccuauuuaauuguacuuuauuucaggccccaauccuuugauuuacucagguuaucuuccugacucugaacuacuucuaauucuuuucauucucaaaaagcauuuuuuuuucugauuuguaugaguacuuccccuuugaauaguuuguacagguggauuucugcauaauuuacuagugcauccuguucagcaucccuuucaucacuacucaaaauuccuuuuuagauuaacuuuauacaacucacauauucuuucaguuggaauuuugaaaguaucauacucauaaagacuucuauuaguuacagugugccuucauaguguaauagcagccuacauaucccuggucacagccugguggaucauauuuauuugaacaguugaggaggccuucagaagugcguucccuuccuucuuuccuguguuuuagcuuugauauugucccacuauuauuauuauuuuuuuuaaagcaucuucucuuuuguauggaaucugaguaaauucacaguggaaacuaccuuguacugaucuuucugucucuuaggcaguaggcagauaagcauuaaucaagaaauauacacauacauuuauugaauagaguuucuggaaucacuguauuauaucugccccaggguaaaaaagacaguaaguuggaaaagacuagaugguugaaagcaagacaguuuuguaacucuacauccugucuucugguguacucuugaccaccgucuuuaugccacucauacucuuccagcagucauggcaacugauaccuuaauucguucuguuauuacugacuagucucucaaauuuucauagaggaauccuccagaugcuguucucuguaaauauaugugagucauauuuaacauuuucuuauacuuugcugcucaaauuccuguaaauucugacaagaauuuucaaugacugcuaaagaucugugcacaugguccuucauuuucacaaagccaauaaauaucuguaacuugagagguuauacaccuuacuaaaagucauacaggcaggaaaagggaugacaaaugguaagguugcguccacaugaccaccuaaaauuugucaucuuccuuuuugcaaaaacaaacaugacuaaauuaaacaacaaauuaagauuauuaugcugacaugcauggaaccuuggaucauuauuaugauuuuucauuacccagaaacacauagaaaaugauaaggaauguaucuggaauauaguacacacugguugggguuguagccuucagucaaaugacucugaauuuuaguuuggcacugccauucccuugacuuggauuauacccacuccuaccuuaucucugguugugugguuucagugaaauuaccaugcagcugguagauaacaucuuggaagacauccugagaacaguucucccaacguugcuuguuaacuuaaaaaaagagagagagagauuagaaaugucuguaaugaagacuuauuuucuaaaaccugaccuuauaucguccaccuuuaaauggaagagauguguuuucucacaucuuuuagauauaauucacauaguauaaaaauucgccauuuuaaaaaguguaaaauuugugguuauaguauauucacagaguugugaaauugucuuuauaaaauuccagagcauuucaucgcuguaaaaaguuuucuguacccauuaagagugacugccuguucuuaacuccaaccccuggcaacuacucgucuucguaugccuaugaauuugccuauuuuggucauuucauguuaauggagucauacaauuauguggccuuuuugucuguuucgccaccuuccacaaagcaaugaguucaaacugcaucaauguuguagcauguacugguacuguuucuuuuguggcugaauauugucauuguauugauaugcuguauuuuuuugcuuguccacuugguugugcauacauguguucuuucugcuuuuugcauauuaugaauacaacuaugaacacuuuguguacauguuuucauuucuccuacugucuuuuaaguaucuuaugguuuugguucuuaaauuuaggucuuugauucauuuuugcaugugguacauuuuagggauccaguuucauucucuaauauguggauaucuaguagaacaauaccuaauuguuacaaagacuauuaguaauuuccuuaugaguaggcuugcuaucuuugucaaaaacacguacaaaugaccauaaauauggcuaauuuuggauucuugaacuuugucccauuguccuaugugugucucuuccuaugccaguaccauacugucuuaauuacuguagcccuagaguaaguuuugaauuuaggauguguuaguucucuagcuuuguucuacaucaagauaauuuuaccuguucugggucccuugcauuccacauggauuuuagaaucuauuuguuaauuucuacauaaaaagcaccugugauuuugauuguucuuguguugaaucgauacaucagauugacguauguugguauuuuaacaguauuaaauuuuauaauccauaaauauggagugucuuuccauuuauuuagguguguaauuucuuucaaugcuauuuuauagauuucaguguauacaucuuggcuuuuuugaguuaaauguuuuucacuugauccuuuuacaaacaacuuuuuuuuuaauauuuguuuggauuacucauugcuacaucuagaaagaauucauuuuuauguauuaaccuuauauacuguagcuauucugagcugauucuguuuuuaauuuuuuauacaagauugugcaucucugaauauaaauacuuuuguuuccucuccaaucuggauucuuuuuauuugauuucccugccuaagugcccuggcuagcacguccaauaugauauuaaauugaaguggcaagaguguacaucuuuuucuuguuucugauuguaguggaaaagcauuaggucuuucaccauuaaauaugauguuagcugugggauuuucauagauguugcaaguugagaaauauuccaucuauuccuaccuuacugagucuuuuuuuaaaucaagaaaaggguuuugaauuuugucaaaugcuucuucuguaucuaauaagguugucauguaguuuuguccuuuauucuauugauauguuguauuacauugauggaauuuuguauugaaagaaccuugcauuccuggaauuaccccacuugucuaugcuacauaaaccauuuucuaugcugcuggauuugguuugcuaguauuuuguuuagcauauuugcaccuguauucauaaaagauacuggccuguaguuuucuuguuaucuuugucugguuguuaucaggguauuacugauacuggucuccaaauaugccuggagcuuuccaacuguucuuaaauccagugagguguguuugaaauaauauacuuugaaaguuauucuguggucuuuagauucuggaugacaugggagagguaauugacucuugaaaggauuccaagguaagacaugucuaaagugccauuugacaguagaauaaaaugcaguuaacaccagucuugaguucagguaggugcuucucaugagccauacauauaucauuauuauaaaguauuagccaucagcuguuuugaaaauugcccuauagaaguuuccuuccuuaguaagccauacaauuggaagcugagugucauccaauaaagacgcuuacagcguaggaggcauuggaaacuaacagccaagcaaguugggauugccaagaagguaaauucugaaauaaaguuauuaauacaccaauccucacuaccacuugcauuaauccuaagaacuugauaaguaagacaauaucuuuguaauaaguuccuauagugcagaaguucccucaguaccuguuaaaaugaguagggagggucuuuugaguugcgguaggaggaccugagcaggaggaagacuuucgucuucaauuaagaguuggucauuuuaauguuucacugcugucagcucuaugcuguuuaguauuuguaaaauuaaaaaaaaguuuaugaacagaaaaaucucaaagcuugaggucucacugcuagaaaaauccagagaucguguuuaaaaugaacgacuuguucuacaccccaccuguacuacacaugcauaaaaucugcaucaugcaacaaagcagacugagaauucagauccaaaaacuaugacacgugguaaaggauuagaugguuaccaggcagaaaagaagagcauuuuauuuuaacaggggccguauuggguugagauaaguagcuggaugugauugggcagccagacagaucaugaugggucuuguagacuucagauuuuacuuugcauaucuuaagaggcaaagacauaaauuuauacauuuauuaccauaugaacugggaaagccuaagugucucuauucuuugcauuaaugagauuguugcuauaguugcagaaagauucagcaugauaaaagagaagggauaguguaugggauagaggagagucaagugaacgauuucacauauuugauauggaugauggagggauaaugaugccauuggguuuucccugggacagaugaggcaggggaguugcaguguacuaagucacauucuuuguguagugagauuauucaaggguaagucuagagaggaucuucaccaagaugaaaaugaguggcucuagcaugacagucaucguuaguauuuuccuagaauacuuucagggaacugugaugaaaugaaaagagacgacaaaggacagaaucuauggaauuacuauccuuugagagguauacaaagaauucauguuaaagagaaaugacaaaaaggaauugguuuguuugacccuguguucuacucaguauaccaagcuuugcaagguuagggaauuuguaacugugacuuacggauccacaucaaaauaugaagauacuuuuuggaaccauacaaugagcagacugucuuagagucucauuuccauucuucuccuuacaaucucccauaugacuagcuaaaugccuuccauuccagucucaauuaucaucaauuaucauagcuuuuaaauaaccagauauacauguaccuuaugaaaucuaguuagccaaaucaaaauauuucaaauaauugaaauauuaacucuuaaaauaauuuaccauuacucugccucaauagaguuguuugauccuucucaguggaucugaaagagcuuaguaguaaguugguuuauuuuggguaggagacuugugagagaagagcacagguccucauauaaacuagacaagugcuuuuuugagcuacaucccuauccccuccaauuuauuuguugauucaaaugaaaaagguuucuugacacagacauagcuagcuauggauggaaguagaucaagauaaaauugugcagaggguucuaguuucuaacuagaugauguacauuuugaguaguagaaguuagccuauuaugcaacuguauuuuagaagauguuuccaaaacucuugcaucuuuuaccuacucccaccaagaacaccaaauacaguguuugggaccaauauaucuuuaugcuguguuucucugaauagauauaguucauauaggucaucuguauuuauauauauauuuguguaugugcuuuaguuauugccucaauuucucauugauaauguccuagaguaggagugguuucaacuuuucuuucacuuuuuucuuuuuaauccucaauucccaggcuguaauacaucugucgaaagaauguauagaugaaaugauugcaaagauaaagauccuggguagccaaccagaccauacaugcaaauuucuacaaaaguacccaauaaaaagcuaagaaaaaaaaucauuacaaagauuguucguguguaugaagacucauccuggaugcagcuuuacuaccgauucagauacuccuuacacuuuccuacuguggagggaaaacgaaauccucuacugguuuuaggggcacaccuguaugggaaagcaacagaaggaaaaccagcuuguuucucauuccuuagaugauaguggguaaauccaucauguuuuuauauguaacuuuaaaccaucuguucaguacuaugcaacuuuuaacuuauucuuccaaguucuuuaguuugcauguguaaaccauuauuuauguaagguuuuaggguuuuuguuuguuuguuuguuuguuuuuugcuuuucaucucuaccauuuuugcuuuuucuguuucuacauaaccaacucauaagaggaaauaauaaaaugggaacaaucugaaauugucauguaugucacauauaacagcacuuguaggggacauaaaccuguaguuugcugacucuuuaguuaucuaguaacacuuuaaacuuccaguucuuuagugaugagcuuagugguaugaacucaguuuucuuuuccuuuccuuuccuuuccuuuccuuuccuuuccuuuccuuuccuuuccuuuccuuuccucuuucuuuccucuuuccucuuuccucuuuccucuuuccucuucccucuucccucuucccucuuuccucuccuuuccucuccuuuccucuccuuuccucuccuuuccuuuuuacuuuccuuuuuccuuuccucuccuuuccuuuuuccuuuccucuccuuuccuuuuuccuuuccucuccuuuccuuuuuacuuuccucuccuuuccucuccuuuccuuuuuccuuuccucuccuuuccucucuuuuccucuccuuuccuuuuuccuuuccuuuccuuuuuccucuccuuuccucuccuuuucuuuuuccuuuccuuuccuuuuuccuuuuuccuuuuuccuuuccuuuccuuuuuccuuuccuuuccuuuccuuuccuuuccuuuccuuuccuuuccuuuccuuuccuuuccuuuuuccuuugcuuuuccuuugcuuuuccuuugcuuuuccuuugcuuuuuccuuuccucuuuccccuucccucuuuccccuuuccccuuucccuuuuccucuuuccccuuuccucuuuccccuuuccccuuuccuuuccccuuuccuuucccucuuuuuuuuucuuucugucauaaaagguaauauuucaguuacaugucuguuauggcaaaaaaaaaaaaaaaauugggaagauauccuuguauacaauacuagucauuucuaguggaggacuagcauuuuauacuuuguucauuaaaauuguuacuaugugugugcacgcacgugcgagugcgcauuugugggauccacugauagucgccauguguaauuuacccagaacccuacucuuucccccauuccucuucuguaucucagacugucccaagcucucuacaaaacuagcagugugcuccugucacuuuuuauuaguguauccccgaaaauuucugccacuuguaguauaucaaauaucauucuuaauggaauuucauauguagacuauuuugcaagaguugguucucuauugugugacuaaugggguuaaauacacauugugagguauagcagcaaguccacuuccaugcuaaaccaugucacuggccuugucuuuuaacuauuaauaaauguauuguccuagaaaaucagaaggggaaaugaaaaagccaauggagaaggcaauucauuugucuuauugcaaucugagcuuuguccuuucuguguuuuaugguauagagaggaauggaggugagccuggaaagggauaccuaacgaaggugagcagaaugcuggcaggauuucuagugagucaauagcuucuuguaacucuuugaaauuguguuauaauuagcuuugauagaacuuaugaaaauauauaaccacucaaauuugagagucucauaucuaaaacucaacaaaugccuaaaaacauuuugucaacccgguaagacacugguacuauaauuuuuuaaacucagcucagcugucagaguaugaagauauaauuuggacguugaucagguauuucucuuagguacuuaugacaauuaaccucagguuccuauuuuacagggaauguuggcaaaggcuaacuucuagcuaccauaaugguaacaagcgaagcaacaacuuggcccuuucuucuguagcauguguaaaucaaagcuccuuaacaggaagaaagucagagacaaauaauuuugaagauuaccagaaguuuuaaguuugguaaacuauacauauagauuuuagauugccauaucugacaguugugaagagguacuuaauuggaaguaucuauccaguuguauuuaauugagacuuguggcuuuagaauaagcuguaauuuaguauugccugauguccuuacuauauaaggagagcaaacacaaauaggaagaaaaugaguaauauggagcaagagauugggcauuguuucuacaagaugaagaauaccaaagauuacuuuuaaaaagugaaaaaaaucagaaccuggaagagacagugauuc

SEQ ID NO: 16 - RNA, 97978 nt, Mus musculus
gaaucacugucucuuccagguucugauuuuuuucacuuuuuaaaaguaaucuuugguauucuucaucuuguagaaacaaugcccaaucucuugcuccauauuacucauuuucuuccuauuuguguuugcucuccuuauauaguaaggacaucaggcaauacuaaauuacagcuuauucuaaagccacaagucucaauuaaauacaacuggauagauacuuccaauuaaguaccucuucacaacugucagauauggcaaucuaaaaucuauauguauaguuuaccaaacuuaaaacuucugguaaucuucaaaauuauuugucucugacuuucuuccuguuaaggagcuuugauuuacacaugcuacagaagaaagggccaaguuguugcuucgcuuguuaccauuaugguagcuagaaguuagccuuugccaacauucccuguaaaauaggaaccugagguuaauugucauaaguaccuaagagaaauaccugaucaacguccaaauuauaucuucauacucugacagcugagcugaguuuaaaaaauuauaguaccagugucuuaccggguugacaaaauguuuuuaggcauuuguugaguuuuagauaugagacucucaaauuugagugguuauauauuuucauaaguucuaucaaagcuaauuauaacacaauuucaaagaguuacaagaagcuauugacucacuagaaauccugccagcauucugcucaccuucguuagguaucccuuuccaggcucaccuccauuccucucuauaccauaaaacacagaaaggacaaagcucagauugcaauaagacaaaugaauugccuucuccauuggcuuuuucauuuccccuucugauuuucuaggacaauacauuuauuaauaguuaaaagacaaggccagugacaugguuuagcauggaaguggacuugcugcuauaccucacaauguguauuuaaccccauuagucacacaauagagaaccaacucuugcaaaauagucuacauaugaaauuccauuaagaaugauauuugauauacuacaaguggcagaaauuuucggggauacacuaauaaaaagugacaggagcacacugcuaguuuuguagagagcuugggacagucugagauacagaagaggaaugggggaaagaguaggguucuggguaaauuacacauggcgacuaucaguggaucccacaaaugcgcacucgcacgugcgugcacacacauaguaacaauuuuaaugaacaaaguauaaaaugcuaguccuccacuagaaaugacuaguauuguauacaaggauaucuucccaauuuuuuuuuuuuuuuugccauaacagacauguaacugaaauauuaccuuuuaugacagaaagaaaaaaaaagagggaaaggaaaggggaaaggaaaggggaaaggggaaagaggaaaggggaaagaggaaaagggaaaggggaaaggggaaagagggaaggggaaagaggaaaggaaaaagcaaaggaaaagcaaaggaaaagcaaaggaaaagcaaaggaaaaaggaaaggaaaggaaaggaaaggaaaggaaaggaaaggaaaggaaaggaaaggaaaggaaaaaggaaaggaaaggaaaaaggaaaaaggaaaaaggaaaggaaaggaaaaagaaaaggagaggaaaggagaggaaaaaggaaaggaaaggaaaaaggaaaggagaggaaaagagaggaaaggagaggaaaggaaaaaggaaaggagaggaaaggagaggaaaguaaaaaggaaaggagaggaaaggaaaaaggaaaggagaggaaaggaaaaaggaaaggagaggaaaggaaaaaggaaaguaaaaaggaaaggagaggaaaggagaggaaaggagaggaaaggagaggaaagagggaagagggaagagggaagaggaaagaggaaagaggaaagaggaaagaggaaagaaagaggaaaggaaaggaaaggaaaggaaaggaaaggaaaggaaaggaaaggaaaggaaaggaaaagaaaacugaguucauaccacuaagcucaucacuaaagaacuggaaguuuaaaguguuacuagauaacuaaagagucagcaaacuacagguuuauguccccuacaagugcuguuauaugugacauacaugacaauuucagauuguucccauuuuauuauuuccucuuaugaguugguuauguagaaacagaaaaagcaaaaaugguagagaugaaaagcaaaaaacaaacaaacaaacaaacaaaaacccuaaaaccuuacauaaauaaugguuuacacaugcaaacuaaagaacuuggaagaauaaguuaaaaguugcauaguacugaacagaugguuuaaaguuacauauaaaaacaugauggauuuacccacuaucaucuaaggaaugagaaacaagcugguuuuccuucuguugcuuucccauacaggugugccccuaaaaccaguagaggauuucguuuucccuccacaguaggaaaguguaaggaguaucugaaucgguaguaaagcugcauccaggaugagucuucauacacacgaacaaucuuuguaaugauuuuuuuucuuagcuuuuuauuggguacuuuuguagaaauuugcauguauggucugguuggcuacccaggaucuuuaucuuugcaaucauuucaucuauacauucuuucgacagauguauuacagccugggaauugaggauuaaaaagaaaaaagugaaagaaaaguugaaaccacuccuacucuaggacauuaucaaugagaaauugaggcaauaacuaaagcacauacacaaauauauauauaaauacagaugaccuauaugaacuauaucuauucagagaaacacagcauaaagauauauuggucccaaacacuguauuugguguucuuggugggaguagguaaaagaugcaagaguuuuggaaacaucuucuaaaauacaguugcauaauaggcuaacuucuacuacucaaaauguacaucaucuaguuagaaacuagaacccucugcacaauuuuaucuugaucuacuuccauccauagcuagcuaugucugugucaagaaaccuuuuucauuugaaucaacaaauaaauuggaggggauagggauguagcucaaaaaagcacuugucuaguuuauaugaggaccugugcucuucucucacaagucuccuacccaaaauaaaccaacuuacuacuaagcucuuucagauccacugagaaggaucaaacaacucuauugaggcagaguaaugguaaauuauuuuaagaguuaauauuucaauuauuugaaauauuuugauuuggcuaacuagauuucauaagguacauguauaucugguuauuuaaaagcuaugauaauugaugauaauugagacuggaauggaaggcauuuagcuagucauaugggagauuguaaggagaagaauggaaaugagacucuaagacagucugcucauuguaugguuccaaaaaguaucuucauauuuugauguggauccguaagucacaguuacaaauucccuaaccuugcaaagcuugguauacugaguagaacacagggucaaacaaaccaauuccuuuuugucauuucucuuuaacaugaauucuuuguauaccucucaaaggauaguaauuccauagauucuguccuuugucgucucuuuucauuucaucacaguucccugaaaguauucuaggaaaauacuaacgaugacugucaugcuagagccacucauuuucaucuuggugaagauccucucuagacuuacccuugaauaaucucacuacacaaagaaugugacuuaguacacugcaacuccccugccucaucugucccagggaaaacccaauggcaucauuaucccuccaucauccauaucaaauaugugaaaucguucacuugacucuccucuaucccauacacuaucccuucucuuuuaucaugcugaaucuuucugcaacuauagcaacaaucucauuaaugcaaagaauagagacacuuaggcuuucccaguucauaugguaauaaauguauaaauuuaugucuuugccucuuaagauaugcaaaguaaaaucugaagucuacaagacccaucaugaucugucuggcugcccaaucacauccagcuacuuaucucaacccaauacggccccuguuaaaauaaaaugcucuucuuuucugccugguaaccaucuaauccuuuaccacgugucauaguuuuuggaucugaauucucagucugcuuuguugcaugaugcagauuuuaugcauguguaguacaggugggguguagaacaagucguucauuuuaaacacgaucucuggauuuuucuagcagugagaccucaagcuuugagauuuuucuguucauaaacuuuuuuuuaauuuuacaaauacuaaacagcauagagcugacagcagugaaacauuaaaaugaccaacucuuaauugaagacgaaagucuuccuccugcucagguccuccuaccgcaacucaaaagacccucccuacucauuuuaacagguacugagggaacuucugcacuauaggaacuuauuacaaagauauugucuuacuuaucaaguucuuaggauuaaugcaagugguagugaggauugguguauuaauaacuuuauuucagaauuuaccuucuuggcaaucccaacuugcuuggcuguuaguuuccaaugccuccuacgcuguaagcgucuuuauuggaugacacucagcuuccaauuguauggcuuacuaaggaaggaaacuucuauagggcaauuuucaaaacagcugauggcuaauacuuuauaauaaugauauauguauggcucaugagaagcaccuaccugaacucaagacugguguuaacugcauuuuauucuacugucaaauggcacuuuagacaugucuuaccuuggaauccuuucaagagucaauuaccucucccaugucauccagaaucuaaagaccacagaauaacuuucaaaguauauuauuucaaacacaccucacuggauuuaagaacaguuggaaagcuccaggcauauuuggagaccaguaucaguaauacccugauaacaaccagacaaagauaacaagaaaacuacaggccaguaucuuuuaugaauacaggugcaaauaugcuaaacaaaauacuagcaaaccaaauccagcagcauagaaaaugguuuauguagcauagacaagugggguaauuccaggaaugcaagguucuuucaauacaaaauuccaucaauguaauacaacauaucaauagaauaaaggacaaaacuacaugacaaccuuauuagauacagaagaagcauuugacaaaauucaaaacccuuuucuugauuuaaaaaaagacucaguaagguaggaauagauggaauauuucucaacuugcaacaucuaugaaaaucccacagcuaacaucauauuuaauggugaaagaccuaaugcuuuuccacuacaaucagaaacaagaaaaagauguacacucuugccacuucaauuuaauaucauauuggacgugcuagccagggcacuuaggcagggaaaucaaauaaaaagaauccagauuggagaggaaacaaaaguauuuauauucagagaugcacaaucuuguauaaaaaauuaaaaacagaaucagcucagaauagcuacaguauauaagguuaauacauaaaaaugaauucuuucuagauguagcaaugaguaauccaaacaaauauuaaaaaaaaaguuguuuguaaaaggaucaagugaaaaacauuuaacucaaaaaagccaagauguauacacugaaaucuauaaaauagcauugaaagaaauuacacaccuaaauaaauggaaagacacuccauauuuauggauuauaaaauuuaauacuguuaaaauaccaacauacgucaaucugauguaucgauucaacacaagaacaaucaaaaucacaggugcuuuuuauguagaaauuaacaaauagauucuaaaauccauguggaaugcaagggacccagaacagguaaaauuaucuugauguagaacaaagcuagagaacuaacacauccuaaauucaaaacuuacucuagggcuacaguaauuaagacaguaugguacuggcauaggaagagacacacauaggacaaugggacaaaguucaagaauccaaaauuagccauauuuauggucauuuguacguguuuuugacaaagauagcaagccuacucauaaggaaauuacuaauagucuuuguaacaauuagguauuguucuacuagauauccacauauuagagaaugaaacuggaucccuaaaauguaccacaugcaaaaaugaaucaaagaccuaaauuuaagaaccaaaaccauaagauacuuaaaagacaguaggagaaaugaaaacauguacacaaaguguucauaguuguauucauaauaugcaaaaagcagaaagaacacauguaugcacaaccaaguggacaagcaaaaaaauacagcauaucaauacaaugacaauauucagccacaaaagaaacaguaccaguacaugcuacaacauugaugcaguuugaacucauugcuuuguggaagguggcgaaacagacaaaaaggccacauaauuguaugacuccauuaacaugaaaugaccaaaauaggcaaauucauaggcauacgaagacgaguaguugccagggguuggaguuaagaacaggcagucacucuuaauggguacagaaaacuuuuuacagcgaugaaaugcucuggaauuuuauaaagacaauuucacaacucugugaauauacuauaaccacaaauuuuacacuuuuuaaaauggcgaauuuuuauacuaugugaauuauaucuaaaagaugugagaaaacacaucucuuccauuuaaagguggacgauauaaggucagguuuuagaaaauaagucuucauuacagacauuucuaaucucucucucucuuuuuuuaaguuaacaagcaacguugggagaacuguucucaggaugucuuccaagauguuaucuaccagcugcaugguaauuucacugaaaccacacaaccagagauaagguaggaguggguauaauccaagucaagggaauggcagugccaaacuaaaauucagagucauuugacugaaggcuacaaccccaaccaguguguacuauauuccagauacauuccuuaucauuuucuauguguuucuggguaaugaaaaaucauaauaaugauccaagguuccaugcaugucagcauaauaaucuuaauuuguuguuuaauuuagucauguuuguuuuugcaaaaaggaagaugacaaauuuuagguggucauguggacgcaaccuuaccauuugucaucccuuuuccugccuguaugacuuuuaguaagguguauaaccucucaaguuacagauauuuauuggcuuugugaaaaugaaggaccaugugcacagaucuuuagcagucauugaaaauucuugucagaauuuacaggaauuugagcagcaaaguauaagaaaauguuaaauaugacucacauauauuuacagagaacagcaucuggaggauuccucuaugaaaauuugagagacuagucaguaauaacagaacgaauuaagguaucaguugccaugacugcuggaagaguaugaguggcauaaagacgguggucaagaguacaccagaagacaggauguagaguuacaaaacugucuugcuuucaaccaucuagucuuuuccaacuuacugucuuuuuuacccuggggcagauauaauacagugauuccagaaacucuauucaauaaauguauguguauauuucuugauuaaugcuuaucugccuacugccuaagagacagaaagaucaguacaagguaguuuccacugugaauuuacucagauuccauacaaaagagaagaugcuuuaaaaaaaauaauaauaauagugggacaauaucaaagcuaaaacacaggaaagaaggaagggaacgcacuucugaaggccuccucaacuguucaaauaaauaugauccaccaggcugugaccagggauauguaggcugcuauuacacuaugaaggcacacuguaacuaauagaagucuuuaugaguaugauacuuucaaaauuccaacugaaagaauaugugaguuguauaaaguuaaucuaaaaaggaauuuugaguagugaugaaagggaugcugaacaggaugcacuaguaaauuaugcagaaauccaccuguacaaacuauucaaaggggaaguacucauacaaaucagaaaaaaaaaugcuuuuugagaaugaaaagaauuagaaguaguucagagucaggaagauaaccugaguaaaucaaaggauuggggccugaaauaaaguacaauuaaauaggucugagagacaauaacugacaacaugcauauauaugcacauaaacugugagaggguaggaaacagcaaaagcuaugguaaacauggaaaggccaggaaacaacuuuguggaguugcucuuuccuuccauguuuauguggagucuaggcagagucuucaggucaaguuuuauauagugagcaccuuuacccacuaagccaucuccccaggccaaaaaauugacaguucuaaaggaaguaacaagaaauaacuaggagauacaagaguaagaauuuuguuuuuaucgguacuguuuuguacuauauaaugacuuagagguaccaggaugauguccuggaaacacgggucugauaugauaugagauaugagacccacaaaauaugaggcaagagaaaaaacuuuggguugaacaggaaguucagaggaguacuucuaaguacaaucaggagaguauccauacaaggugucuaugaguugggauggaaaagugagccuuucaggaagcuguagcccaacucugcaaggcucucaaggguuaaaaacaagacuucuuuacuguggcaaauggagacuacuaguauuauugcaaguacauuuucagugaaauauuccuggauuagcagccuuuacauagugaaaugcaguacauacaugcacucaaauauucuuacaacuguuaccaaagucaauuuucuuauuugaaaguagaagaggggaaaaaaaaagggccucugucuauauuguguaaacauuuuuccuaccaaacaccaggaacuguuuuacacucuaaagaugaaagaagcagcaaauggaaguuacuauuauuauuauuauuauuauuauuuuauucugggaaggguagaaaggauuaaaauagacccugggauaagcaguuaaagaaugaacaucuuaaagaguagccucaguaaaacacuucuuucucuaggguauguggauucuugagaaaaaaauucuuuaaaagagguugauuucagcaauagccaccuuauggaaacacggaguaaugcugccuaguugaugcauuugccacauguuaaugugaacaaguucucugaaggcucauuuauagguuucuuuugauauauacauuccuacacaggauguauuuccaaauaaagguaagguuauugcaaaugaauuugaucacacaauuaacuauagaccacgauauguacacucaauuuguuugcugcagcugccaaguuuccagagaaguuuugcugcaggcugugcuuuuaugccauaaguuugaaauguucuacacuacuaaaagguauuuuuuaacucguaaguauuguuccaugacaaucuaguaaagcaaucaugaaaaggcagccauauuaaugugguaacaugccgagaaaaacugauuaggaagcaagugagaguuuuuuuuuuuaccucugaaaacuuuuuaggauuuuuuuuucacuuucuuuuaaauauauugauguuacuucuguuugauaaucuauauuaucauuugaaaacuuucacacagauauaguaucacaacuacuucaauacuguagugacaauaaacugaagaacacaaaucucuucaugaauuuauuuuauaaaauauacccacuuaauuugucuucuuaucacuuucauaauacauaagaagcacaguggacaagaugcccauuaagaugacuauagucacauuuaggggguccuauaaucaagguagcauacauaccacaacaguguucuaaaggcuagcucagaaaaaaaaaaaagaaaacaaaacaaaacaaaaaaaccucacguuaccuuaucacaauauggaacgcacuguguucucuuuucccauuaaaauauuuaagccacuguuucauuuagcauuacaguaaauaagagcucugucucaacuacuacaagaaagaaaauaauccuaagacauccuuuuccccuuccaaugauuugaaagcuaccauuauccccugccaauuaaaaucaucagguugauuugcacuaguuguuaaaacaaucaaggcacaagcucaacagguuaucuguagcuuguaguaaaaugauauaccaguaugucucuccuuaguuaaaaauacauaauucuuuuauuuuguuaugcaacaaaagaaauuaacaucacagacauagaagacuagggaugggaaacuacauuaaauauccaguaauuuaagccuauuuguacuuuaauauaggacaugaaaucuuuaacaccuuugaaguaaauuuuaauuugggggauauacaauuuauuucucaggaguacuaguuccauucauuuccaggccugcuaacuguguaaauaaguaacacaaggcacaguagcuguacuuucuguuaugcugcaacacugaucgagugccuugaaaaaugguugauuaaacaagaugacggcaacagaaggggagacuuuggauugucuauuaaaaucucagcaauaauaaagauucauuuuaagugcacuuuuacaugcuuauuuauacaacaaacuuccuaauuuuguugcaauaggcuugacuauccuaucauuuggccagaugcacuuuccccaguaaacuuaaacaacaaaaacaacaacaacaacaaaaacaacaacaacaacaacaacaacaaaaacaaaaaaaaaaucccuguccuuucauauacuaagaggauuggcuacugaaacaguucauugcaagacacaugaagacaacauacuguggcaugaguuguuuuaauuuguugugcuguuacuaaaguucugagggcugugguucaaacauuccaaguucucccuuccaucuuuauugguucucaaaauuuuguacagaaaacucuuugggggcuagaacagcaguacuugcaccacacuguuuccuugacuucaaguuucaaaagcaaauuguuagaaaaaaguuccugauuugacuuagauacagggacaaaaaauagcacauacuugaagauuacauguucuacaaaugguggcaauguuuuccuugcgagaauaguuucguugguauauauaucuuaaauacucaaaaaggcucaaccucaagcaguaauaaacacaagcaaaagugauuuaacccuuaaaauaaauauucagaaaaccucucuguacauacaagugaaagaauauguaacacuuucacgcaaaaaaauaauuauaauaauaauaaaggauuuguucauauaugcagcugaaaucugcuguuccagcccacaauguccccaaugaagaagggaggcacagacauagaugacuacugugguucacuaucuuacagccuuuuuguacugggauacuauuaccaucaaauuaucccucuuauauuuauuuuuuaacuuuuucuuuuucuuuuucuuuuucuuuuuguuuacagcaugccaaauccuuuggcauaugugauggccuucaacaaucucucuuuaaguuuuucuuugcuugaauauuccggaaguaaaaggacauuaaagcaaguaugagauguagguaaccuaaauaaagagaaagggaaaaacaggacaaucaugagucauuggaaauaugcucaguguuaaaugcuccuauuagauacauaucuuguuaggacgguuuuuaaugagaaacuacagauuaaauauaucauaaacauuguacuguuuaguuaaaaagaucaguugggucuuuauccuaugaaauaaugcaaaaauuaaagugaugcugaugauaguaacauuuauuaucuauugaguuuccacucuguuaccuauugcuuuagauacuuuaacacugaaguucauuuaaaucuuuacacaacaaacaucuuacuaaacccauuaaaagcugaagucacuaaacaacuuacaccaaagauuaaaaauuauucaaaccuggcuuuuaaagauuuugaagucuaugcucuguauauagauuugaaauacugcuggcaaaaugaaaaugauaaugauugauuauaaauuaauuaaaauuagagccaagauguauaaaaugucuaauuaacaguaauaaaaauauaucugucgauguauaucgaagucuaccuaggacauauuguucagccccaccauaaaauugugaaguauuuauuggagaaagaauacaaucaaaagucagaaugauuuaacccuagaauaagaaucuaguauaauguaaaagaacagacaauccucuaaauuuuaguguagccauucaaaguagacuguucuauaauaaggcuuucuuaauaaacuaugaaacaaagggggaauaaaacauaacaacuugauaacgucuguacuucuguaagcuccauaauuacuuuuuaacuacacuaauuuuuaaaaaaauuccucaaaucaugaagggaaaauauccauuccacuaguguuugcugacuuagauauuucaauauaacaucagaagaguauauagaggcuacauguuggcucugcuugcguguauggaauauggugaaaagguuuacaguggguacaaaguuggaguuugauauuaccuuucugugucugggccauuuuuggcuauaaucaucuucaauuuuccuaguccuccaacaggugcucugucugugccuguuguaaacugcagaaagagucuuuucuguucaucuguaaacgaaugaacaauuucccagaacucccuaaugugaaaagagaauacugguuuuaauuugacauccacuauaaacaagaucauaguacuacaacauuaaggccaaugucacagugaauauuaaaaguaccauuuacacuuaguauguaaguuuuagucagccagauuuuauaucuuguaggaacuauauaugggauaaauauuaauaacucuuuugcucaguaauucuacuuaaaaaguacuuuuguauuccuaaugcuaagcgugauguuuuaaaauuuacuuuuguaaaaaauacauguucaauauccuauucacauuucuaaaaccucaaucuaaaaaucuaucaagaucuucuccaaagcaagagaaaugugcaauaaauauaucuguaaucuaugcugagaauaaaauuggaaaaucaaguaauaaauccccaaaguaaaaguagagagaaauaauacacaagauaagcacaguuaaggaucagaauaggacaaaaaaauuguagacacuggaagagcggaagaaagaagugacgaaacuuuccaaagaugauagaaauaccuggugaagggauuuuaauuuuuaaaaaauuguaagugaaaaguagaaggcauugaaucacauaaagcagaaccaaauauuaaagaaacagcaguaaaagguuuuccuucauugagaaaccacuuaaagugacuguacuaugcuuugcuaccccaugacauuuacuaagagcagguccaugggaggaaauauauaaaaaaguaaaugauaaaaaauaaauuuaaguccaauaggaauauuaugaagaguucuucaaaugagaaauaaggcuuuuuggaauaugaaacuauuuuuaaaaaagacugagucgugaauaauauaaacucuaacaugaaaaguuuaacgauggcaucaugaaucaaaaauaaagagauuaaugaauucaaacagaaauaauaacacuugaaaauacugaggcagguuggugagauggcucagcagguaggagcacagacugcucuucugaagguccugaguucaaagucccagcaaccucaugguggcucacaaccauccguaaugagaugaucccucuucuggcgagucugaagacagcuacaguguacuuauguauuauaauaaauaaaucuuuugggccagaguaagcagagugaccggagcgagcagagguccuaaaacuucaauucccaacaaccaugcgaaggcucacaaccaucuguucagcuacaguguacccauauacauaaaauaaauaaauaauucuuaaaaagaaaaaagaaaauucugaggcaaaugcacaucaacucuagaaauaaaagaugauucaaaaaugagguaaguaaaugagggaaguguaguaauuuguauuugacaaacauccaacauuucuacuugacaacagucuagaaacaaaaagcaagcaaaggguuaggaagucagaaggggaaaggaguuaaaacaaaauauucaaaacugaagaaaugcauaucaaaguaaaauggaaacaaauuguuaauugacuaaaaccuuucacuugguaaaaaacccuaacaaguaaagauaaaugacauuaauguagagaaaauacuguaaauuacuccagagacaaaugucucucauguacaagaaaaggcaaagggaaaggaaaucuaaaaaguauuccuaugauucagcauuuugaagguugaggcaaaagguaggcaaguucuaggcuaggcuaugcuacaagcaagcuauuguucaaaagaagggugugagggggaucaauaacugaacaauaaaaugaguaagagacaauauuaaaaauaugauuagguaauauaaugaccuugaaaauagaaaacuauacuucaauauuaugugacagcuggaagagagcaaaaaaguugcaaaguaaccucuauguuaauaagggauuauuuugauaauauacuuaaaagauucuuucuagguuuguuccuugacaaggccuuaccagucauaacauuaaauaguaagucuuauuccuggaugcaguuuucuaauaauuucuuuuaacaauguuuucuuacaggguaggggauaauguucaagauaaggcaaaauuucaaauuuuaacaaagucaugugucauguuaaagauacaccaacaccaagcaaaguccuaagcaaggcuaaaguccuaaugguaaaacacauuuacuacauuaaaaguaaauucaugaguucauaauaucugaaaacaaaaaaauuaccauauuaucucuucaguaucaaucuuaaauauauuugacuuugucuuuucaauagauugauaucuuaagguaacaauauaauaguugauaugaaaaagauaggaaaauaggagaaugacauaugucagaugacuagauaaaauuauuuccuuaaaucaccauuuuuauaaucacaggugaaaucaucaauuaaggaaagacaaaaaagauauacaaggcaaaggacuauugaucacagcaauuuuguuacugcuccacaaucucuguaaacagagcaaauuuagauaggaaaaugagaggucaacaauuauguuuuguuuauuuuagucuucugaaaaggagacagaauuauuucucuuuuuaaaaaaaugaggagggaguuagaggaacauaaaucagcaagcagugcugcaauggauccugcuccaaguuuccuuaaugauggauggauuaugaacuggauggguauaaaaauguacaaagccgggcuggagagauggcucagcgauuaagagcacugacuacacuuccaaagguccugaguucaaaucccacaaaucacacaaccaugagccaccauguaaaggaaugugaugcccucuucugaugugucugaagagaacauaaaaauguacaaagccucaaaugacauagagaaaguaugaauauuucacaaaagaaauguuucuccucauaauaagcaagagacucuucuaagaacaaaaagauucagucuugaaggugacuaaaauggagaaagaaaaucagaaaaaaacucaaaagaaccgaggaggaaugaccauguagaaaugagcagaaugugcuuuuacaaaaaaaaaaaaaaaaaaaaaagaaagaaagaaaagaaaauuggaccugagcaaauuaagaauauaauacacgagccaggcgugguggugcacgccuuuaaucccagcacuugggaggcagaugcaggcagauuucugaguucgaggccagccuggucuacccagcacagccagggauacacagagaaacccugucuugaaaagcaacaaacaaacaaacaaacaaaagaauauaauacacggacugaagaaccauugcaacaaggacaggaauauugacucaagguuaagaagaaacaugacauuuaaagcaauguguacuuuuaaagaagcuagggaagaacaaucucuaaacagagucaacuauaacuacuaacuccagagauuaccagauggcgaaagguaaacggaggaaucuuacuaacaggaaccaagaccacucaccaucaccagaacccagcacacccacuucgcccaguccagggaaccccaacacaccugagaaccuagaccuagauuuaaaagcauaucucaugaugaugguagaggacaucaagaaggacuuuaauaaaucacuuaaagaaauacaggagaacacugcuaaagaguuacaaguccuuaaagaaaaacaggaaaacacaaucaaacagguagaaguccuuacagaaaaagaggaaaaaacauacaaacaggugauggaaaugaacaaaaccauacuagaccuaaaaagggaaguagacacaauaaagaaaacucaaagcgaggcaacacuagagauagaaacccuaggaaagaaaucuggaaccauagauuugagcaucagcaacagaauacaagagauggaagagagaaucucaggugcagaagauuccauagagaacauuggcacaacaaucaaagaaaauggaaaaugcaaaaagauccuaacucaaaauauccaggaaauccaggacacaauaagaagaccaaacguacggauaauaggaguggaugagaaugaagauuuucaacucaaagguccagcaaacaucuucaacaaaauuauugaagaaaacuucccaaaucuaaagaaugagaugcauaugaacauacaagaagccuacagaacuccaaauagacuggaccagaaaagaaauuccucccgacacauaauaaucagaacaucaaaugcacuaaauaaagauagaauacuaaaagcaguaagggaaaaaggucaaguaacauauaaaggcaagccuaucagaauuacaccagauuuuucaccagagacuaugaaagccagaagagccuggacagauguuauacagacacuaagagaacacaaacugcagcccaggcuacuauacccagccaaacucucaauuaucauagagggagaaaccaaaguauuccacgacaaaaccaaauucacgcguuaucucuccacgaauccagcccuucaaaggauaauaacagaaaaaaaccaauacaagaacgggaacaacgcccuagaaaaaacaagaagguaaucccucaacaaaccuaaaagaagacagccacaagaacagaaugccaccuuuaacaacuaaaauaacaggaagcaacaauuacuuuuccuuaauaucucuuaacaucaauggucucaacucgccaauaaaaagacauagacuaacaaacuggcuacacaaacaagacccaacauuuugcugcuuacaggaaacucaucucagagaaaaagauagacacuaccucagaaugaaaggcuggaaaacaauuuuccaagcaaaugguaugaagaaacaagcaggaguagccauccuaauaucugauaagauugacuuccaacccaaagucaucaaaaaagacaaggagggacacuucauucucaucaaagguaaaauccuccaagaggaacucucaauucugaauaucuaugcuccaaauacaagagcagccacauucacuaaagaaacuuuaguaaagcucaaagcacacauugcaccucacacaauaauagugggagacuucaacacaccacuuucaccaauggacagaucauggaaacagaaacuaaacagggacacacugaaacuaacagaagugaugaaacaaauggaucugacagauaucuacagaacauuuuauccuaaaacaaaaggauauaccuucuucucagcaccucaugguaccuucuccaaaauugaccacauaauaggucacaaaucaggccucaacagauucaaaaauauugaaauugucccauguauccuaucagaucaccaugcacuaaggcugaucuucaauaacaaaauaaauaacagaaagccaacauucacauggaaacugaacaacacucuucucaaugauaccuuggucaaggaaggaauaaagaaagaaauuaaagacuuuuuagaguuuaaugacaaugaagccacaacguacccaaaccuuugggacacaaugaaagcauuucuaagagggaaacucauagcuaugagugccuucaagaaaaaacgggagagagcacauacuagcagcuugacaacacaucuaaaagcucuagaaaaaaaggaagcaaauucacccaagaggaguagacggcaggaaauaaucaaacucaggggugaaaucaaccaaguggaaacaagaagaacuauucaaagaauuaaccaaacgaggaguugguucuuugagaaaaucaacaagauagauaaacccuuagcuagacucacuaaagggcacagggacaaaauccuaauuaacaaaaucagaaaugaaaagggagacauaacaacagauccugaagaaauccaaaacaccaucagauccuucuacaaaaggcuauacucaacaaaacuggaaaaccuggacgaaauggacaaauuucuggacagauaccagguaccaaaguugaaucaggaucaaguugaccuucuaaacagucccauauccccuaaagaaauagaagcaguuauuaauagucucccagccaaaaaaagcccaggaccagacggguuuagugcagaguucuaucagaccuucaaagaagaucuaacuccaguucugcacaaacuuuuucacaagauagaaguagaagguauucuacccaacucauuuuaugaagccacuauuacucugauaccuaaaccacagaaagauccaacaaagauagagaacuucagaccaauuucucuuaugaacaucgaugcaaaaauucuuaauaaaauucucgcuaaccgaauccaagaacacauuaaagcaaucauccauccugaccaaguagguuuuauuccagggaugcagggaugguuuaauauacgaaaauccaucaauguaauccauuauauaaacaaacucaaagacaaaaaccacaugaucaucucguuagaugcagaaaaagcauuugacaagauccaacacccauucaugauaaaaguucuggaaagaucaggaauucaaggccaauaccuaaacaugauaaaagcaaucuacagcaaaccaguagccaacaucaaaguaaauggagagaagcuggaagcaaucccacuaaaaucagggacuagacaaggcugcccacugucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauuccaccagagaacuccuaaaccugauaaacagcuucggugaaguagcuggauauaaaauuaacucaaacaagucaauggccuuucucuacacaaagaauaaacaggcugagaaagaaauuagggaaacaacacccuucucaauagccacaaauaauauaaaauaucucggcgugacucuaacgaaggaagugaaagaucuguaugauaaaaacuucaagucccugaagaaagaaauuaaagaagaucucagaagauggaaagaucucccaugcucauggauuggcaggaccaacauuguaaaaauggcuaucuagccaaaagcaaucuacagauucaaugcaauccccauuaaaauuccaacucaauucuucaacgaauuagaaggagcaauuugcaaauucaucuggaauaacaaaaaaccgaggauagcaaaaacucuucucaaggauaaaagaaccucugguggaaucaccaugccugaccuaaagcuuuacuacagagcaauugugauaaaaacugcaugguacugguauagagacagacaaguggaccaauggaauagaauugaagacccagaaaugaacccacacaccuauggucacuugaucuucgacaagggagccaaaaccauccaguggaagaaagacagcauuuucaacaauuggugcuggcacaacugguuguuaucauguagaagaaugcgaaucgauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuuguacuguaagaucgagaauugacaaaugggaccuaaugaaacuccaaaguuucugcaaggcaaaagacacugucuauaagacaaaaagaccaccaacagacugggaaaggaucuuuaccuauccuaaaucagauaggggacuaauauccaacauauauaaagaacucaagaagguggaccucagaaaaucaaauaacccccuuaaaaaauggggcucagaacugaacaaagaauucucaccugaggaauaccaaauggcagagaagcaccugaaaaaauguucaacauccuuaaucaucagggaaaugcaaaucaaaacaacccugagauuccaccucacaccagugagaauggcuaagaucaaaaauucaggugacagcagaugcuggcgaggauguggagaaagaggaacacuccuccauuguuggugggauugcaggcuuguacaaccacucuggaaaucagucuggcgguuccucagaaaauuggacauaguacuaccggaggauccagcaauaccucuccugggcauauauccagaagaagccccaacugguaagaaggacacaugcuccacuauguucauagcagccuuauuuauaauagccagaaacuggaaagaacccagaugccccucaacagaggaauggauacagaaaaugugguacaucuacacaauggaguacuacucagcuauuaaaaagaaugaauuuaugaaauuccuagccaaauggauggaccuggagagcaucauccugagugagguaacacaaucacaaaggaacucacacaauauguacucacugauaaguggauacuagcccaaaaccuaggauacccacgauauaagauacaauuuccuaaacacaugaaacucaagaaaaaugaagacugaaguguggacacuaugccccuccuuagaagugggaacaaaacacccauggaaggaguuacagaaacaaaguauggagcugagaugaaaggauggaccauguagagacugccauauccagggauccaccccauaaucagcuuccaaaugcugacaccauugcauacacuagcaagauuuuacugaaaggacccagauguagcugucucuugugagacuaugccggggccuagcaaacacagaaguggaugcucacagucagcuaauggauggaucacagggcucccaauggaggagcuagagaaaguacccaaggagcuaaagggaucuucaacccuauagguggaacaacauuaugaacuaaccaguaccccugagcucuugacucuagcugcauauguaucaaaagauggccuagucggccaucacuggaaagagaggcccauuggacacgcagacuuugugugccccgguacaggggaacgccagggccaaagggggggaguggguggguaggggaguggggguggguggguaagggggacuuuugguaaagcauuggaaauguaaaugagcuaaauaccuaauaaaaaauggaaaaaaaaaaaaaauaaagaagcuaggacaaaaacuaagacaaaaaauaguaaaaaagaaagaaaaugaaaaccuuugaauugaacagagaauaugaagaauuaaucacauuaaauaauggugauuuuauucacacugauaauuaaaaaaauuuuuugaaagaaaaaaaaaacaacaguucguugaaaaagaaaugcaaaaaagaacagcaaaaaggacagcuaauagaccuugaaacaaaaacaaaaaacaaacaaaacaaaaacaaaaaaaaaagcggaaaacuuucauauagcaaugguuccagagcaugccaggaaaagaaaaauuaggcuccauuuacugauaaaagugaacaugaaaaccuauuugaaugaauaguuaaaaaggggauauggcacaaagaacugaagaacaagaguuauuuccaauaaacuuaacuugaacuaaaaaagaacugaaguagcacuacaaaagaugaggagaaagaagggcaguagcauuaugaauuacuacccuaugaaagaugaagagcaaaccaaaccaggagcuaaguaguucaacaagccauuauaaaaauauccaccaacuauucaagugccccacuuagauuuaaaguaacaggagauuugaagcccgaaauuacaaggugauuggugggagaaauaaugcggggaggagaauuuggaggagauugaaagaagcuuauuggaauuuaccagaaaauggaggaagguguguguguguaaaccaaacaaaaacaaauguuaccuaguugguuaauagcucaauuuuuacuauagaaaguaagaacuaauugaucccugaucuuuuaaucuauuaacauguuuucucccaggcauggaacaaaucauuuuucucuuuuguagcacacagcagcaggucuucuuuccuuucucccuguuacuuaaaguuucuuaguauagacaucuauucuguaaaguggcaaaaaaaaagggggggggggaccagagguaacacuucuuuuuuugcuuuguuuuguucuguuuucuuauguuggcuuauuuccucuuuauagaagaggaacuaaagaacauucuucuacaaaugaaaaugauaaucacuauguugcguagaaguuuuguuugucaaggaugcaaaauuuauuucucuugucaaaaccuaaaauagacuguggauuuuccacguuuauagcaauugaaauauauauauuuugaaugaauaauuacuugagcuuuuacaucaaaaauuauucuaacauaaaauacaauguauuuggaacuguucccuuugaauggccgauuuuuaauaguaguacuauguaauuuugauuguuauaguuucaaagucuuucugaagaagauauagugaugaaguggucuaucauucuuuucaugggaaagaagcauggauaagaacaacaacaaaacaaaaaaagccaaggaaagauuuuauuuuuaaaaacacguauaauauauaauacuuacaaauauaugauaugacccugauggauacauuauaaaaaaaacuguaucuguacugcauguagaagccaagauuuucaacauaauaaggccucaagaucuaagagaauuagacauaggcaaaacugacacaacuuuucauuuaaaauuuuagaaguagggcuggaacuuauucgguggcuaaaagcaccagcuacuauugcagaggauccaggcuggauucacaaccccuauaugauggcucaauuccagugucagggaauccaacuccauccucuagccucagugaacacugcauacacacauugcauagacucaaguaugcaggccacucauacaaaaaaaaaauaaaaucaaaucaaaaaccaaagaauuguuauuuuuaaaaguauuuaauuaccuauuuucuauuguugaguuguuucguauuuuaauuaacugaaagaauuuuauuuuacaguauaaacauauaguaauguuauuuuaaaaaauaagaaacaaaaauaggaaucaaaauaaaacacacaauuuuauuaaauaguauaaucaugaaaacuuugucaauaucaacaaaagaugaaaacuauaaagacaagaaaauuagaaauacauaguaaaaacuaaaauucuaaaauaaaggcuaugaaaacaauaacuagaucagaaaugaaguuuagaaaaccuuaacagagaggaaccuugaaaaaaugugacagaaauaagguucaauuagaaauaaauuuuaaaaauuauaacaaauacaaagaaacuagagauaaauucaaaacuauacacaacuaggaauauagacaauuuuacaaucuuuuacaaaccuaaaauagaaagauuaaaacuaugaagauucaaaaagcaauuaaguugcaccaugguucaaauauacaguauuaaugggcuaugggcaaaguucugcuaggaauaguuguugcccugaagugcucuccuauccuuugagucuuagagacccuagguaagacaaagauaaccacauaggcugagguacuguuagaaguaccagcaaaaagaagcuggcaagaagcuacaugaaguauauauucgccaacaugcaaauagcugaggaauaguuuuccucuacucaaagacaggaaggagggagggagggagggagggagggagggagggggagagagagagagagagagagagagagagagagagagagagagagagagagugagucucacuggagaaacaugccauucuuauguguggggcccauauccaacaguuaguugaccaacacaauggcaucugcagagguucuuggucucauaauguuaauucaugguguuucucccccccauaucuuaaagguccucugauuauguauuagagcuucuaguuuugugaguuuugcauuuuuuaugagauucucuaguacacaaauaugugugucucuacaucuauagaaucaucuagaaauuuuucucuuugguucuuuuucuugcuuggcuguugcguuauccuaauuuguuuguuguuuguuuaucuuuauuauuccuugaugcuuguuugcuuccuuauaagagucagaaaaggcagggagcagaugggaggggagguguaggcaaucuggaagggguaggaggacagggaaaacaauaaauauauuauauggaaaaacaauccauuuuuaagaaagcccucaaaaaauaaaacggaaacuaucaugccaagaacaaagaaauuaaaacaacucaugccaacagaaauuaaaaaauuguuugaauuuuacugacaaggcuuuuaaagcaaugaaaguaauuauaagcuuauucucagaaaugaacaaugaaauaaugcauaagaaacauauuauuuaaacuuauucacuaaagcauacauuauuucaacacaaaaauuacaaaucaaugcuggaugaaacuaugguauaacuaaauggaaagugcuaugccaugcuugagauuuagaaaauccaaagugaugaaaaugacaauucucaaauugauuuauccaaucaauucaacccaaaucaaaacaucaaaaauaaauguuauucauguaaaauucagcaaacagauuuuaauauuuacauggaaguaaaauuagugaaaacauuaagaacaaugaaaaaguaaagggauucucaccaucugauauaaagacuugcucuuuguucuaucaagguaaaggagucaucaagaugugauuuugaucaaagaacaaaugaauaagcagagaagaaccaagucuagaaguaacucacacaaaacucaauuucaacaaaaauaaaauucagugggggaaagaaagcugcagacuagaauaacacauguauaacauguuugcauaugauccuuuaaaaagaauacauuccaaaagaaauaguucauaaucaguggaaagaagaguggggaagauaauucacaaaguaaugguuaaaaggauggaccaucuagugauugccauaucuggggauccaccccauaaucagcuuccaaacgcugacaccacugcauacacuagcaagauuuugcugaaaggacccagauguagcugucucuugugagacuaugcuggggcuuagcaaacacagaaguggaugcucacagucagcuauuggauggaucacagggcucccaauggaggagcuagagaaaguacccaaggagcuaaagggaucugcaacccuauagguggaacaacauuaugaacuaaccaguaccccggaguucuugucucuagcugcauauguaucaaaagauggccuagucggccaucacugcaaagagaggcccauuggacacgcaaacuguauaugccccaguacaggggaacgccagggccaaaaaaaugagaauggguggguagggaaguugagggggggaggguaugggggacuuuugggauagcauuggaaauguaauugaagaaaauauguaauaaaaauauuuuaaaaaaagauaaauaccuaaaagacagcucaugauccugagucaucagugauaagcaaauuuauacuaagguaaaauuuuauuucacacuccaagacaacaugaccaaagauuaaaagagauacagaauacguucuagcacugcuugucaucuuagguaaaauggcaguaucauuuuacaaaagcauucuugcagugcuucuuaagguuaaaaauguuauuuacuucacaaccacaauccuccaaagugcuucuucaggagaaaugaaaacacuucaacacuaagaaugaaaacuuuauuuguaacagccccacugucaugauaauucuauugccaauaacaaaaggauaauaaucaaaaugcauacauuaaucauaaucaaucuaaaacauuauuuugccauauuguagagauaauacuaggauauucccauuaaggcuucuguauuaccauguuuaucccuguuaugaauuaccuuuaaaacugagcagcaauauaaugguugccacuuuugugacugguguuagaagcaaauaugaaugauaaauuuuuauauucauuaauaauugccauugugcuuagaaaugauauaucauaugacauguuaugguuuuuguuuugcuuuacucugaauuuuguuauuuaauuaccuaaaagcugaauaaauaacauauuugcuuuucuauuaaaaaaaaaagggcaaagcaagaguaaucuucuacaaacuuaaaugaauaaaguaauacuguaauauaaauauaacaaugauaauguaucauuacuagacacaguuaauauucauucuauuguuaacauauuugagucuuauagcucaagugaucuacaaaaagauaacuguuuaaauaccuaugacaucauaguggaugccaaaaagacuacucugcauuuugaucagucacauuagaagauggggggaaagaucuuucagaauuggauaguagcauauuacagaaguagaaauaagggcauuugacuagagaacgauguuagugguaauacuguccuaagaauuguucagaaucacuaguauacaugguucuucccaaguaucuuaaagacuaaauaaugugccaucuuacacaugaccaaaaauaaggcaaaggguugagaaaauaugagacuuaaaucauuuaauucaugaaauaaagcauuagacugcaugaaaauuggaaauauuaauacaggucuauuuuugagcuuacuuguuugguaaccaguaccuacagauacaggacacaaaagcacacaucuacauguuugaugaauaaaaucuuccuuuuuaagaauuaaacaccuuaccuaaucacaacagauucccucguauagccaccgucauacucuguaguuucuucuagugccuggaaaucuagauucugaaaauuauagggggaaaaaaaagcaccuuaacauccauaguacaccaaaacaaaaaacaaaacaaaacacccaaaacaaaaaaaaaaacaaacaaaaacaaacaaacaaaaaaaagaccuuuuuuguauaugucuuucuuacccggcuuccacauauaagcaauucaauuucuucuggucugaauaaguauuuuaagggcgauucauuagucaccauaugaaaaccucugcgaaaugccuugaauuguuuuucuacagauuuauugagaauguagucugaauagagauugacaaauuccuguaggaauauuaacaagaaagcauauucuauacaaaugaaacacaauuagcuuuuggacuaguuuuaauacccacccuccaccccaagaaaaccuucagcaguauuuuuuuuguuacuauguuuaaaaauuagauuucagagaguugguucagugcuuaaaaaagcauuagcaacucuugaagaauaaacauaagucuuaaaaaauuaaucacauguuauauguacaaagaaaauuauuuucacaauuucucacuucugacagauauaaaaguuguauucauaugcauaguuauacauuaugauucuaugaguaaaucaaagagaaauuauauaaaauguaauuaauaguaauaauaaugaaauaauguaaacaguaagauuaaaauaaaagauuuaaaaagacuguauauauauauaacaacagaaccucuaguaugcaauauaaauuuguuaugaauacugaacuugagaaaaccagaaugucucagguuuccucuggaaauuaugguacugguaaguuagcuacuguauccagcucagcaaaaauguuauuuguugguaaacuaagcuauuauaacaaauuauaaaauuuuauaguuuuuauaacuacuucaaaccauacuagguaauucuuugaaaacuuuacaaauuauaaaauuuguuauaguacaaauguaguuuguaucaugacaguacaauauuucaccaaaaauaauaguauaaauuaauauaucuuaaaauuauacuauguaauauuuucuuuugaagcuaaguuauuuccuauugccaaguaaauagcuuuuaaaguuaguaaaaaccaaaucuaaugugaauaaucugauaugcauaauuagaucucaugacaguacaauauuucaccaaaaauaaguauaaauuaauauauuucuuaaaauuauacuauguaauauuuucuuuuuaagcuaaguuauuuccuauugccaaguaaauagcuuuuaaaguuaguaaaaaccaaaucuaaugugaauaaucugauaugcauaauuagaucucaaauggaaaauguauauacacacuaaaccagaugucaaucacugggcucuguauaccucuuagguuuaauaugguaaggcccuguuucuagcguuacauuauaguaauauuuacccauucaaucuuuuguagucuguuuagucuuucucuaaaggggaauuaacaauucuguacaaucacauaagcucuuaucuaagaggaaaguguagcuuuacuauuuagauaaauuuguuuauguaaaguuuuuauaacugcuucaaaccauacuagguaauucuuugaaaacuuuacugcuuugaaauuauauauuuauaaaacaaugacaaaaauuuaauuaccuuccuguuuucauuuguaauuggaauuuuaucaccauuuucuuuuagaucauacaucauuggguuaccaaaaagaucugucugugauaucuggaaagugaucaucauaucaucuuccacacucccuucauauuccaauaaauccuuuaaacucugauauaaaaccuaacaaccagaaagagaagugagguugccaaauaaauacuaaaagaaauaaaaauaauagauuguucauucuuuguagaaacaacuugucaacaaaaaugaagccauaaauauuccacaucucucaaguaguuuaauaagauagaaagguugucacaggcaaugggucaaucuuaaaaauucuucaaaugaucaguucagcaacagauuucauaccauggucuagaauauacacuuucucuccaugauuguggcaggguacaggaaaugaggaaaaacaaacaaacaaacaaacaaacaaacaggaaaacaaacaacaaaaaagccacacacauaucaacuguaccuaucaacaacuuuacuacauagacucauaugggacauugaaaacaugauguuuucaacauuuuuuauggggucaaucaaaacauacuugauaggauauauaaaaaaugauguuuauuauacuuaaccagauuaaaaguauuuuacuuuacuaaacagcaguaucaacaaaaguuuacaaauaaauaauguuccuauauaaacugagauaaacuucuguauuuagauacaaucuuaaagacuauuaacgaaggacaacuuacugggugagagucucccaagucacgaaagguuccuuuuuuccccauuagcuuccuguauacaaccaugggaaaauggacauccaguauacaauuauuguaaauagccagacccaggacuaugccaaucagaguaaacugacccucaguuucaaaagaagauggauuaaaccaaaauaauuucguagcuucaucauaugugaacauaccuauaaagaaauaauuaaaagucauuuuauccacuuaaugacugaaaauuacauaugaaacaaaugcaugauuaaguaaaaaaaaaaaaaacaauuggagaaaguugauuaacuuuaaguuacuuaaaauucauaucaaaucuaagcuaauauaauuuuaaaaaauauuuugugaucuuucagcuucacaugaucuucauuauucaaagccaaaguccagagauuuuuuuuccuaucaucauuauuuuaucuaggugaacauuaagagauagucuuuuuuuucuuuuuuuacggaacaucaaacaauaaaauaaaacaaaacuaauuguauaugccuuucaauuuuucuaaguuuauuuucaguugcuucucaggaaauacuuuuuauacaaagucuaacaagcugggggagagagugggcuguauaccuuagcacuugguaaaaugaguaaggaaaauuaugagcuuaagguuagaguacuaauacaauauaaaaagauugucuaaaaaagccaaaaucaaaaugagcaaaucaaaaaguuuugggaaauguuuuucuaauggaacaagaguauuaaaaaacaaauaauaaagcauuaaaauguacuuucagguuaauuuuaauauuuaaaauguuuccuuauuuucacuuucaguuuuaauuaaaaagaaaaguacacuuuucuccuugaacuguaguaauauaaauuaagucuaagcuuuuucuugcaauuuaauauuuguggaauacugguuucacaaguauucaauucauacuugcauuccagcuugaaaaaugugaguuauguaugucuguaucauuugcaugccagguuauacauccagguaauaucaaaaguuccaguucacaaauaauaaaucugauagaaugucaccaauggaugcucuuggucucaaggacaauuaagcuauaaauuaaccagaggauaaauuauauaaccuaugauucucaugacuucagguuuucaaaucuaccacucuaagguuuuucaaauuaaauuucccuagaaggcaacuguguucuacuagaauauuugacuaaguaauauauggaagaaccuaaauuaagugagugauagaacagcuccugaagcagggauauggcauacucaauuuuuuuacugcuuaccauaacugaaaauauuuauaaaccaaguuuauacuuuaaaagacuaacacaccaucauaaucauaucacuaauacuuaccaauaucuggauuaaaaauuuccuccacaaccaacugaaaaaacucuuuggaaacgccucccucaucuacuccuuguucuccuucaaauuccacauacaacugcuucuucaagucugcaggauuuuccauagcaaucaucucuagcuguugauugaaaauauaaaaaagaggacaguugagaagaggaaaaauguaagauauaaguagaagaaaauaagaagcagcaauaacaaaacaauauggaaagaaaacaaugaauuuuguuucugaaaagaaaaaaagcaaacugacuuacaguuuuuggcaagauuuauuucaacacacaagaguauguacuguguuuaagaagcuaugcauuucuuaguaaaggauauagccaaaaugcuguugggggugggguggggggaauaguugcaauuauguccuguauaucuucaucuuuaggggucuaagggccuaugaauuuauucuguaaagaaucucuauauuggucuacuuuaacuaauuuguaugucuucauguauguauauucacaugucuccuuccaccuaagauguauuuccucaggaucuguccaccuuguuugucaggaaaggaucucuccuugaccuggaagacugcauaacacaauagguuggacugucaauggccccuggcaucucugccaguaccugccuaccuagcaucaggacuacaaugcccacuucaaguuucuuuucuuuaauagaguucugaagauuaaacucaguucuucuugcaaguugaucuaccuucucagcucgcauacccaauuuucaggucaguauucauugaaauuuauuuucagcaguacuuuguuggugaacauauaagaaacuguucuuucacaaguuccacauaucaccacuaaauauuaacauuuaauuacuaagcuucaauaaaucaauccuauuuucuaauguauuacagaaacagagguaauauucuuccuacucuaaugguauaugcuuaauauaucauuucuaaggagcaaaacuguuaacauauuacccuucaaaacuauagacuuuuaaaauucauaaauuuauguccccaagaaauuaauagguaggucugacacuuuacagccaaauauauagauuugaauuuaaccuuagaaauggagaacaaaauuauaccaacaacagcauuagcuagaaaccuguucuaagacagaauaacuuuguacacuuaaauuuccaugaucaucuuagcucaaauuuggucccaacacaauauacuauuauuacugugguuucucccaguucucaacuugcuaagaaaacauguuaauuauugauucaaaggcuuguugguuucaagacagcauacaucuguccagucucuacccuuuucccccaauucugguucuaguauguucuauuaugaucacuaaaaauaauuuucuauauuuuugcuuucguuugaaauguaaaauaagcauaaugagauaguaucaaauaaauaagugaaguguguaaauuaaugcucuaccauuaacucuaaguuugaaguugcaaguauugucauucuaguaauuuuuaaauauuccauguuuucuauauaugauagaacaagcauuucaucccagcacucaaacucgguaaguuuagugcaguuaugucuacacagaaaaucugaguccagugagagcuuuauagugauucucuaucuaaaauaugauaacaaguaaauaaguauuuccaguuuugcuagaauauuuaaccacaugauuuuaaaaacagaaguauucccggaauaagagcagcagcagcaacaaauuaugaaacuuacagcucacuuuacaauuaaaauuguucugauaucuacaacuccuuagcaaguaggcugcuaaaaccauuuuacagaaagucccuugaaguaauaaaaggauaaauaacuuaagaaauaguaauucagaagagaaguuuuaauccagggagcaagcuuauagcccacaguuuaccuacuuuuccaaagaaaauagagauaauauuugcuuuuagauuuugugugacuucuuuggauaucaauauuuucaacuauauucacauauuauuuucagaaucaggauauauuuguauauaauuuaaaaauaguuggcagcuuaauucuguaagugaaaauguccaacuagcaauuuaagaagaccauucucaauguugccaaagugacuuuguaaauucuuauuuuguuugagaugaugcaucaguagccugucuuuuuaaaaacuaugguaacaaaacaaaacauaaaauuuaauacuaaccauacacaaaagccauuagcaaagaaagucacauuauuuuuuuuuccuuaaauauaguaacucuugcugagaggugguagcacaagccuuuaaacucagcacucaagaggcagaggcagguggaucucugagaucuagaccagacuagucaacagagcgagcaaguuccaggacagccagggcuacauaaacccucucaaaauacaacccgcccaaaaauguaacucuuagaagagacacacacacacccuuaaaccauuguuucaucaacuaaagaauaguauaaaaaaaaaaauuaaaguuauauuuuaaaaaugaauuuguaaaaucaagcugucuuacauguaauuggauacaugaaaacuauugggauauacuuaaaauucugaaaaaaauauaagacaaaauagguaguauuggcuucauagauagcgcuggagaaaaaauacacugguauuacuaugcuguauuaauguacaauaguaacuaucacuuccuaacuguacuucucuucauacuaggaaaucucacucucaucaacuguuaaaauauuauucuuaauuuauuuggcaauacaaaauccuagagagaucauuuuuuacaagcugaccuuauaggagagcauuccaagaaaucuaagcagaaugauauacugauuuaaaaaaaaaaaaaaacauucuauaaccauaucuucaaggaucaaaaaaaaauuuagcgccaucauuuaaaaccuuuagacagggcuggagggaugauguaucagcaguuaagagcacugacugcucuuucaaguccuaaguucaauuccaagcaaacacuugguggcucaaagcuaucuguaauaggaucugaugcucccuucugaugugucugaaaauaaauaaacaugaaaggaaggaaacaaggaaagaaggcgggcaggcaggcaggcaggcaggcaggcaggcaggcuaaauaaaaccuuuagacauccagaguuaccaucuaaaauccuauguuaacauaacugaaaacaaaaaacuacuaaugauacuauuuaaguugaacaacacucaaauuagcucuauuuaaaaauguuuagacucuccaagaagaguaauuuauacacuuugauaaaaaucuaaauaugacuuucauuucuauaaguaaaaaucucucuaaauuucuuucuuuuaaauuauuauaugaugcuaagcucuuaucguacugacuacuucaucucccauucugguuguaagaaauuauuuugaagauaaagggaagaggauuccauuaauuucuuuuuuuuuucuuucuuucuuucuucuucuucuuuuuuuuuuuuuuuuuuuuuuuuuuuuuuuuuuuuacacgagacaggguuucucuguguagcccaggcuauccugaaacucacucuguagcuggccucgaacucagaaaucugccugccucugccucccgagugcugggauuaaaggcuugcgccaccacgcccggcuuccauuaauuucuauuagaauaauuuuaaauaagagaaaucacauuaaguacaauucuauuaaugaaugaauuacaccuagagcagcacagaaaaacuccauuauuaaagcaauguaugucaaaugauuuuuuuaaaucaaguucuuguugcaauagguauuuauacuaagagaaaugauggaagcucagcuagacaaugcaucuagacuuucagagaaauugaggaaguaauucaaacaacuuuuucuucaucgaugugugccagcuccuggguuuuuggacuuuucuuuccaauucuacaacuuagcaauuauuuuugguuaacuauggaaaauucuagaacuuaacuaaauuuauucaugucccauaccacugucaacuccuauuuuagucacacugacuucauuauucguuuuaaacacuggcaauauucuacacauggauauuauucaauaauuuauacuuauaaacuguacuaacuguuguuucccaaauauugauuuguagcauagauguaccaaaacauguaaagaacagaccacuacauuuucauaucagaauucuuuuuuuuuuuuuuuccuaucagaauucuuagucugaacuccuaaaaguccagaccuuaaauucuguugcuguguuuuuauuuucugggcaauucugcuuuuagauugugaacgcagucuaaagcaucucgcacauggcaauacugucucuggauacaucugaucuuauuccacuuuuuaaaaaaagguuuuaagauuuuauauaugcuauauccuugaaaucacuuuauuuuuuaaaaagaggagaaaaaugugccauuuauuugcuggugguagaagaaaacaugugccaaggaguuaauuacgucuuguggauuaaacucagucaucaagccugguggcaagugacuuuacccaauaaaccaacacaacagccuacaaagaauaucuguuuuuuguuuuuuuuuuuuuguuuuauuuguuuuuuuuuuuuuuuaagacuguuaaaacuucuacacuaggauuguuguucaaauggaagcugggaucucauuaguauuuauaucuguauaauuuucucguuaaaaaaaaaaggccaaaaccauucaaaauaaagcaaaagaaauauuggaguuuuuuccuuuuuaguagaauuuguagauuuauuucuuuauuauuuauuuauugcuuaguacauacaaauuuuaaaaaauaguaccuuauacuuuuauacugacuauucucuugugagacagaucuucuaaaaauaacaguugggggaaagaguuguuauacugauugaaaauaaugaauaaacuuuugcuuacaaaaaagaauuggcuaggaguguuauacacacauaauuuuagcacucaaguggaaaagauaaacaagaucagaaguccaaggauaggcuaaacauucuuuauuaaauaaaaauaaaaagugauuuccaggacagccagggcuacacagagaaacccugucucgaaaaacaaaaaacaaaaacaaacaaacaaacaaaauuaauucuaauuuacucgccuacugucuaccauuaagccagcuaaucuaauuaacacugaaaugugagauucaauagaaaacuuacaaaagucacauauguaaucuuuucuaggccucacuuauaaacuaaggagaaaacgguauuauuuccuucauagcucaagguuaggguucuauaaccuuucuuucuuucucucucucucucucucucucucucucucucucucuuucuuucuuucuuucuuucuuucuuucuuuauauuuauuaauguugaguucacugcaaaacuucucauuccuucucuauacaaccuuacuaugcaguucaaaaugaccgggucauaaaagauugugauuaacaugaauauucugccaaguuuuuuuaugaaagaaagaacaagguuucaaaacaauagggauuuguggagaauaaagacguggaaagagaguagaauuccaucaguucauauguggguauucuuuugaauacagcuugcuguaaaccuccaccuuuuugcuauuaaucuaauaugaauauaauaauuauccuuugcucagggucaucaauuugaucucuaaagucugagucuuugcuucuauuucuaacccuuucccacuaguaugcugaaaaaccaagaaauuuuagagggguucaguugaaaaugauccagaaagagaaaaaaagaggagaaguggaaaagaaagcaauauaggacaaagaagagcugggugaaacucuuaggaauuuucucaaaaaguaccuaucuuuguaauucuacugcuuaucaaugagacaaacacacagaauugaugaaggccagggcuucuauaaaauacuacuagucgaauauggauauuaucaaaugaaucaugucaaaccauaugacuaguucacauaaauaagauuuacuagcaacaguuuguuagcauaauuacaagacucaacuguuaauuuuacuccaacuacagaaggggcuaauuucguccuaaaugaaauuuuacaaauacuauccaaguuuuaacugguucuuaacucaauaacuuuauuauagaaaaaaauaguauaagaagauaauaaaaaaaaaaucagguaggacaggugcauaaauuuuuuauuaaauguguauuuagcucagucuuaaggcuuuucagauuucgacaauccauucccccccaaaaaaaauaaauguucaaauaaauauuauuuguuaguuaucuguuaaugaguuaauauuauuuguuagacuauaaggaugaugcuucaaucuguaacuaguacuaaaucuuacaucaaguuuauacaagaacuagcacuaacaggaacaauuaauaccaagggauacccugaauuacuuauauauaauuuuguuaauaugugacugacaauuuucaaaccaaauuucugguuuaacugacagggacucuguaauuuuugucgucuguagaaaaaaggaagacaagaggcaauguuauuugaaaacaaaaacaaaaaucacgcaguaagaaguuccugacuucccaguuaaaucaucuagauuuaccugguauuacuaacauuaauuccaagcucccaaaauagccacuuuacagaauuuucaagauucauguuauuauuauuuaaaaaaacaaaauccuacaaugucacacaagacagaguggcuuagaacuccaaagucuuauugauaauacagacuaaccuuuccuggucauaucaucaaguucacaauagaaagcugaguuguguuacacauaauggaauuugaagagcagcucuuauucuuuuacaauguacauuuauugcauuauuucuuccaauuccaucuuccauucuuaaaaauguguauaacaauaccauuugucauguguuccaaucuuugaaaaccaaucuuuucuucuuaauggaaauauaugaggcuggcuuucaagauucagaaaauccauuccuuuuacuugcuuugugccugucugucugcgcaucugugugcauauguaugcaugcaugcaugcaugcaugugugcauguaaaugccaaaaggggaaaacguauguguggaggucaaagaacaucaaguaucagacuuugcuuucuaccaacugagacagggucuaguuauuugucaguuuauauaucagauuagcuucugaggauuuuucugucuauacuuucuaucuugcuuuaggcaguacuauuacaaauggaacuaccauauccuguuuuacauguauucagaaaauccaaggauaaguccucauguuugcacaacaaacguuuuaaccacugagucauuccccuaguacuagaaaaaucuauucuucuucaaaagagaauuaucauuagacaaccaggauaccaguauuuuugguaagaagcaacaaagguguagcaauacagaucagaaauguuaacauaauccuauuuuuuuccaaaauuauagauaaaaugaauaaauugaaauacaucacugucuagguuuuaguuuaauuccaauuuuaaauaauagucaaacuuacccggaccagugcaucaucuauaauauggucacgucugacuuugagucucaaauacggauucaacugcuguccuugaacuaggcuguaaagaacagugauucuucuuucacuguacaugcgaauucuauugucauaauauaaucccagauucuuugugacagcauucaauauaaagggacaugucauaaaagagaauuuguucucuguuucaacuuugaaaaagguauaaucuuuguccauuucuagaacaucauucagugguucauuaaugaauucuucaaaggagauaagugguuuucgacagucuagaguuuuaacgccaaguucgguuucuaguggauccacucgaggaccuuucuuauuucuucuuucaucucccagaagcuccugaaguguuaauucgcuggacucagguauggguucuucaucaucuuccucauuaugauuuguguccacauccccucccacuacauuugcauaguaaaccauuuucaaacacuuugaagcagcaacaauggcaucaucaucauucacuagauuucggcuauuaaauucauugcuuaugacuuuguagguaauaaguugcugaaauguuuccaucauucuccgaaucuggucagcacuguauuuagaccacagccuaaucaguuuuccuugagcuucaagggguagcuuacacauagcuuugcaaaauaauggcaacgccauuuccagauauucaggacuguggagauuacuauucuccauuacaauaaugaacaaauugagauaauuaggaucucgaguauacacauuaugauaugucaaaucacauuccacguuaggugacagauauacaagugcauucaggaaggcaguuucuaauuuuucauuagcgagcaaacugcuguagacccuucuaauagcaucaauauccacagucacaucaucaggaccuaauuuuuguacauuguugucucccugugaacuaucacccauccuugaagaagaugcuucugagucuucuuccauagcagcagcagaacaugcagcuuuuuccuuuucaucuucauccuugucuucauccuuuucuugaagagauuucaauuccuccuuugugugcuguuugacuuuccgaaagcucagaaccagugccucagcacuagaaaauauucuuccaauuacacgaauuaaaggggaauaauccucacucucucuacaaaauucauaaauuucauauacuuucucuucaguuagguaaaucacaucuagaaaauggaaagaaaaagaacauuuauguuguaauauacauguuuauuuuguuaaaauaauugcuagugaaaaaguaaaauaucuaaacauucuggacuugauuuagaauuuuuaaaugauguaauuuacuuauuaacaaguaaucccaacaaucucacccuuucuuggcauucauugaacaaaauauaauuauuaauuaugcauugauaauuaagacaugccuuguaaccaagacauguacugguauguaacauuaauuguagguaugaacaaauauauauacuugucauuuccucauuguacuuuauuacaaccuuaacaaaaagcuacuauauaaaauccugaaaucauuuuccuuugcauuguucucaaaaaacuaaggagguaagguuuuauaacaagguuuccuuagccccuucauuugcaaucaacucuuucuauacuuuuguauauacuaaaaccaaacugacucaucuuauguauuccuaauuucuuccagaauuuccauucagaggcugaggaaaagauauuacuacucauguaaacucuacugaaguuaaaacugcuacuacaacuacuacuaccuaugaccauuacucagguucuaacaauucuuaacagagcaacuggaaauuauuacagucaucagucauuuaaaaacaaacagaagaaagaagcuaagaaagcaaaaaccacaagcacuaaaaccuauauuuauuuucucccagaaauagaauugggaucauaaaagucucuagcuucucaccacuaggccaaauguaaauuucaacaaaggcuuuaccauuucagguuaacaaaacaaaagauacuuaucuuuuuggaaaaagguaacauuuuacauauuaaaguuuuagaaaguaauauauuuaucaaauaauaauguugaaaccacuaaucucuuucaccaaagaguaacauauuauaauuauuaaacauuuaaguuaggauaauuuuaugguuacauugauaauacaccucauacauugccaauauaucuaacauguaaaaucuuuauuaugauugcuacauauuauuaaagguaccuaauucaaaaauaagaaacaauauaaaauucaaguccucauugauggaauggcuuccaaaacauaaaccacaaagcacuaaacuauauauacuacaaaccugucuauggcccauucuagaguauugauacuuuuuaauuuuaugaucuucaauucuuucuuuuaaaaaaauguucuauuuacuuauuagaggugaugaggguauugagcugaguugauaaccuaaaagaauuaauuuucuccuucuacagugugaguuucaguaguuacaugucccuaucugaggcagcauggcaagccaaguucaauucuuagucuacuaagaauaaguaaaaaagaaaacacuaacauggagcucauuucucguuauucuaacugaaaaaaauacauggaaucuucuuuaaccauucaagucuaccaaauuucucuaaacuguaaccaaaacacagaaaauaucaguaaugaauaaauaggcagacuguuagaauauaauguuuuaucucccuaucauugaauuauaaaauuaguuagaaagugcaaauucuacauacagaacaauauacauccugccugaaagagaauaaagcucuagauccacacaccuuugauuugcaaugucuuccuuucagagcacagucauuaaaucacucugacauucuaguaauacaaacuacuauucauugauauuuguuccacguaguacucuacuuaaaauguuuaaaauguuuaucuccaucucccccaccccucucaugugugcauauaaaucacugcaaucagaaauaaaaaguucuaaucuggguaucaacaaacaguuaaguaaagaaacuuuuuuuuuuuaagauucaccuguacauucuaauauaugugugcuugaaaacuguuugagacaugguuucacauaguagaaacagaacuggaaaucagcucaaaaucuuuaaaacauaacauuuuauacuccaaacaguuucacgcaaaaacagaguugugauacacuagcugauaacuacaccucuaacuaaagugaacaaauauaauuaucaaacugagggaaacaugauuaagcauauauaauucaaaaauauuaaagaaguaaaggcaauaaaauuuggagugauccacaaaaacaaagaaccuguaaaaaaggaacacccaugggcuaaaacaaggcaacuauauccauuauauacuagauuuuucccacaguuaguugcauucaacuaugaugggauacuauuuuucauuuacuguuacucugucauguccacucuguuguagaaacauguauaauugagccaaugcaauuuucacauucaaaauauugauuagcauucaccuacuuaucuacaauguaaacaaauucaugaaauaggacuggcuauauauuuuugaguagcaaagcugaaaguuuuuuuuucugauuuuucuuuaguccuauugugaaaguaauaucaugaaguuguacuauaauuuuauuucacuaauucauuuaaacauguuucaagugauaguggaacuaaucccuggcaaucugaaacauucaauuacuuccauuaagagaaaaaaauagauugaacaaaaucaaucaugaggcaaaguaggaaauuugaagaauuuucaaaauauagaacuauuuuuaaaauacuagaugcauuggggacauagcuuaaucgugagugcuuauuuuucacucaugaggcuauccucaguaccagguaucagaguauaaaacuuuaauuucauuacuggggaaauagaagugugaguauuaaaaguacaagaauagugccacuuaacuugcacaaaacaaaaugaaacgaaaccccacaagagcugaguaaagacuauuacugguaaguuacgucccuaagcaguaugaaaauaucuaauuccugacguagagagggcagaauguaagaaggaaaaaauguaauuuucagauaacuauugcaaaauuuuacccugcuuucuuaaaaaaagaaaagaaaaaaaaaaaaagacuacuuuacacuuuauauuuguauuucuccuuuuaccacagucccuggaguucuagagccgauacuagguauucacggcaaaugcaauguacauaguagauuuuugugaccuaauaagguauuagcuacaauauaaaucauuacaaacugaguucaacucaucaucauauuaauuuuuagaguauaacuugcuucugacugacaacuaaugaaucaguaaaauauaagaauaaaauguaaacaaacuaaauaccaguccuuuaccacaguuuaccagaaaaggugacuuuuacuauauuauagugcgauaacuuaaggugauaaaaaaagcaaaaacaaaaauaaaaacaaaauaacaacaacaaacaaaaaaacaaaaucaaaacaaauaaacaacccccuccacauuuaaaucugauauagcuuucaauuaaccauuuugaauugaaauauaaucucuuaccuuuaaaaucuuuuccuuccuucuuguucauuuuuaucucugaguuguuagaugcaccuuuugaguucucaagguaagcugagcuugcuccuuucuuggagggaugaggaucacagaguuuugcauuaauuuuauaaagcucaagggcuuuaauagcugcugcauuguuauccauacgaagaaaaguuggacaggaagcacaaaacucauucgugcaggccucauuuccacagcccucaguuaacugaugguaguagcguucuauuagaugcuuugcagcugcucgcuuccuguaccagacauucaaacaauaagcacauuuauuaguauagcucagaaacaaagcccaacagauaaggcaaaaguuagcuaagcaauaaagcaauaaacuaaauauuuagauguagaaacuggaaauucacuacuaccucccaaaguguuaguaaaauaauaaacauuuucuaaaaaaacugugauaaacuaugucagcuuauaagauaauuuuaauauggcaggcuuuucuuugguuuaaaaaaagauaagcuuaaguugaugguauaggacccuuaacuauuuagcagaaaacaacaaaaacaaacuucacugcuacaucuccauggcaguuucccuuuucacuaauauaaaaucacuaauucauuuuaacaguuucaaauacuugauuuccaguuaauaucaaacuucuagagauuaaaauuuuuuacucaguaaguaaucaugagauauuuaaaagugcuuuauaaauaaacuaucuaauuucauauuauaccgagagagaagcaccaaggcauacaaccuugagcccauacuugucacuaucuucauuaaauccuugucauaggaaagauaaagguuuaaacuuccaucaggggaaacucauauucaucuuacuucaucaacuuuaaacauuaaaauuaacauuugauuaacauauuuuucaugcaaaguaaccaauacaauuaaaggaaugaauuauuuuaccaaacaagaaguuguucuacauaaccuaaauucuauaauuugacucuaaaauucuauucuuggagauuaccacaaaauuuaaguugaaauguauaucuggcccauaauaaugucauucuaaggaauccguuugguucuauacaagcaugggaacugcaaguagaaagaaucuaucuaauuucauucuaaaacuucaugucauuauuuuagauagaacuaagugacuaauggcacuagagauaaacaaauauggcacugauaagugacuuuaggacuaugucauucuuuguaugacaaagaaugguaugucauacgauccuaacucauucagauacuuauauuuagaaauauucccuguauauuuaccaugcauaguguacaaaggccaagccugaugacucaaguuugaucccuguauccaacuuggugaaaggagagaacuaauuaccacaaguuguccucugaacucuaaacacaccaaaacauaugcccagucacauguaucuacagaaaauaaauaaaugugaugaaguuuaaaauguaucacgaaguuagagauaccacuuaugagaaaaauucaucaaaaggaagacuuauuucccuauuauuuauggaaacucagcaugcuuaacaacagcaaaccgcuucaauauacugacagcaugcaccaaauaaaauaauuaccaacuacuuuaauuuuguuacuuccuuaacaaaagcuagugaucaaguuauaaauguaggaugaauguuucgaaauauuaacuauuuuucuaaauaauugacugaguuaauucuuccuagcuacguuuuuucuguaaguauguaccuaaacacuaaaaauuucuaaguaucaguacggaaguuuuaaaacuucaucuacgugauuuaaauagagccaauguuuauguuuauauccaggauuuuuaagcguuaauuucaaaguucaaaacacuaguuuucuaagaguacuaggccgcccccccaacccauacacacacacacacacauacacacacuacuucuuuaugugauaaagaacucucaauacugaagggagaaaugagaccauccaaaagucagcucaauguaauuaguugaaugaacuaauuuucuaggccucauuuuaccaccuuauguccuuauaauuugucuagcuagcacucucuacaugccaaauaauaaacucaguacauugucagguacucugauuaucauaugaaacuugaacuugaagauuaucuucugucuacagcuaguaaaagagaaagaccugaaaagaucaaaucuuauaauugaucuuaugcuauguccauuaaagaagucaggacaauuuucagcuucagaauucaauuuauuuccaaucacuguuuuacagauuauaauuucagaagaauuaauucuuaauaccagcaguccuaaaaaguuuuaagggggaaaaaaagaccuaaguaauauauaauuagaaaacaaaaucuuccaaaaaauuccaaucuaaacuuaacaaccauguguacuaucuggguacaguauagaaacuccugaauaaauuauaucacuauacuuaagauaucgguaauuuauugaaaauggauaugcuaagcacuuuauaagaagacucagucuguaacagguagaaauucacaauuuugaggccagauuguuuggguucaugaacaguuucuguaucugaguuaacuacuuauuuagucucuuucugugucucagcuuccucauccuuaggaugccaguauauuucagaauucaaaugauuuaagaauuacaaguguuuagacuauuucaguaaauuuuggaagagguaggaaaaaaauaggaggugaagaugagcaaaaugcauuguaucauauaugaaauccucaauuaauggaauaguauguauuaccugcuacaugcuaggcccuaaugguaaguaucagaugcuauugcaauugcuauaauuucuaucauuugcaugaguauaugacuuggucaagagaacuccauugcacuaaaucugaaaaauuaaaaucuaggcuuaauuccaaaauuugaaauuuuagcauuacuaaaggggagacagcagagaaaauguuugaaacugaccagcuuuuuugcaccaaguuacaaguaguagcccacuaauacuaauaauuauauuaaauuaaauaaacagaggucauaaucaaccauauuaaguugacuaauuugauuaaugugcguuuauuaauauuaaguuaauuaaauugguuaauaugauugaauaugauuaauuaacaauaauaagcuauucuuuucucauuauaaaugauaccauugaaugccaaaugcagggcauauaaauucauuaaggacauguaaaaggccucuaaaguuggaaacauacauacuaauaauagcuuuugauaaccuuccaaugcuaauccauacauaggacuggucacuaaaucauaccucaugugucaaaucuacuuuuuuuacaguugaaguuuagaauauuuuauagucuuaaaucauuaaaaaauuauauuuuguuucaugugugaaaauugcauaaaacuuaaaugucuauguccauaauuucuaauguaacaugguaaauuucaaguacuuguauauuuccuguauguucucuaucauaauguaucuagccaaaaguaaaaugcuuugucaccuuaaaaugaauucccugugcaugccagugaaacuuucaaccaaucaucuggccuccuuacuuucucucuuuguccucagaagaugaauagaguaagguucuuucuuccuacuuaguacuuuaacaaaaagggaguggggaaguaggaaggaacauaaaagaaaaaccaaaguaaaguucaggaaaugaagugaauccguuuccugauauucauaaccaaaacucuacaaaaaggagguagcaguuacuuuugccuauucauauuccacugacuucguggaaaucaaaguacaauauagugaguccuuaaauaaaaauaugccuuuuuuauuuaguuuauaagaaucaagugaauccuaccaguaaaaguguuccucuuuaaauaauaguuuccacuucuuuauuacuuucuaagaagccauuaaaacggauucuacggaaacugauagaagcagaugcagggacccacagccaaacccuugaagaguccugcugaagaggggaagggagccaaaggacaccacaaaaacauagcccacagaaucaacucagcagggcucauaagggguuaacagagacugaagcaacaauuggggagucugaccugggucuucugcauauguuauaguuuuguauagcuugauguccuugugugacaauuagcagugaaaguaagggaugucuccgacucuccugccugcuuuugagaacuuuauccucccaauggcuugccuuguccacccucaaugggaagguuaugugugugccuaaucuuauugaaacuuguuguuaugccagguuugguugauauucaugggaagccugcucuuuaaugacgggaaagaagaggguaguggaucugaagcaugagggaagggaggaggaaagaacugagaggagugcagggagaagaaaaugcagacaggauaaacuauaugaaagaauuaauuaauaacuaauugauguuuuccacaaaugacaauaaagagaaauaauuuucaguguucucaguagcacuaauaacauuauuugcuggguccuaaguuaauuucgggauaguugaauacuuaggaauaguaaguaaaucauaauaaaaaugauaaaguuauaagauauucauaacuauauauagauagcaucaaggagauuauacacuagaagaauaaagaauucccacauaguucagcaugagaaucaaaaacagugaaauagcugccaugaaaacaagaaacagaaacaugaaagagauaacuaacaauaugacuuauucaaaguaucuuuuuuaaaaaaauaagcagaauaaaaacaaagauuggacaaaagagguaagaaacauauacagcccaagacucaauuaacccaugcauaaucuaguaagcacugcuuagugucuuucauagguaaaugucucauuauuuuguaagggguuuuauaaaggauguaccuuuauaaaaaucacuacuccuccaagaaaugguggcuuaugcuuauaauaguagcauauacuagacuaaggcaggaagaucuugaguuuauuaugaacuuuauguggaggaaucaguaaaccaaauuucacaacuugccccaaguuauuuuuaauguagaaacuugucaagaguaaaaaaugugaucucacaaacaccagagauauucauaauacaguuaaaaccaguauaagguagggucuauugaagugucaucaaaucauguauuacaagacugaaaguacaaauaugacccaauuaguaucaggaaccauuugaaagucaauuauauauaaaauaaggaaaauuucuuaaagacagauagauggguggauggauggauacuaaaaaugcuuuuauucaucuuuacaacaaaguacuaguuguaaaaauagaacuguggaauuaaauuuucacauagaauuauuuaucuuuuaaaaugaauaaaccacuguuuuugggguuuuuuuuuuguuuguuuguuuguuuuucaccugcccaguuucaugguuagaagaaaguaaguaaacauuuacaaauuuagaaauugacuaguggagcuggaaacauaguguaguagaggcacaccaccaauauauauuguauaaauauauaaaacuuucaaagaauauuauuuuuuaaacaaagaucuuuuccuaaaaccauagguugacucuucuuucuguaaacagaaggugaauauuggcugauuguagugaaugcuaguuuuagaacuuguauauuuccuaaguaagaauuuugaaaauggaaaucuguccuguauuaguuuggaaagaguuaguaccacugccauacaaacagcagauaccugauaggagacuagagugauggcucacuagucaaaagcacuagcugcuuuuucagaggaacagaguucaguuccuagcaugaugucagguggcucacaaaacugccuguuccuccagcuuaagagcauuaaaugccacaggcacccacacacauauagcaugcauaugcauauaugcauauauauauauauauaaauauauauauauauauauauauauacacacacauauacauauacacauauuaaaucuaaauacagucaaaaccaaugcacaaaacacauuugaaaaagaacacauguccuugcuaaaaucccauuacuuaaaagaaaucuugugaagccaaaaggcuuucagacagacucauuugagaacaugaauaaccacucccagugauagagauaucucaguaguuaagagcacugauuccuccucuuccaaggaauccagauuugauucuccacaccaacaaacuggugcagucagcugugacaccuggaggaguuacacacucaucuggucuccaugggcaccgaccaugcuacauguggugcacagagauauaucccagcaaaccacagauaaacauaaaaaggaggaggaagaggaagaagaaauggaggaggagaaauauuuacucuuaccaccucuaauggaugaaguacaauaucuaggcauagcuaucagauaagaaaaagauaaaagauacaggaacauuuggaauaagaugcaagacuacaaggugcuaaugugauaaagugaaugaaaacuuccagaguaucaaaggauaaauucaaauucuaagagagaugaagaauauuggaaaucacaaaagagauacuacaacugagaaacagagaaaaauacuauguagcaaaaaggaaaagcagcaaguggcuccagccaagugguggugauaagggauaucucauccauaagguaaaacagaugggacugacuaaaacaaugcaauagucuugaucacagaacaagcaagaguacucacaaagaauuaauuggagguuucgucaugacacugacuuauucuaagucagcacuggaaagggaaaaauccaguuuauaacuguauucuggagaacuagucaggugucaugaaaagggaucuacauuuguuugaaaacaaacaaucuuggggguugaaaaacaugaaacaauuacaaauaaggaaaaggggugaagucuugccauagucuaugggugggaagaaagcugagucagguagauauggaguagagacuugauugacugagaaacucaagcaaaguagacaaggcuugaagggcacugugucaauuaaccagcccuucuguggcaaggaucaaacccuacaauguggaggauaaagugucaagccuacaaaauuggcucugucugucaugaggguugcugccuacaguacuugacaacucugaagguaagguccaguggagaaauugauuccagcugucugauaccccuugcaauguggugacgacaggcaggaucuaaaaguauagagaccaguucucuagaacaaacagugcuuuuuugacuucccucauuuaaagcauacuugggagacacccuguggcuugaaaguagccaacuaagacagaaaagcuggaaagucccugaaggaaauaaugaaugagugaaugaaugaauacauaaauaaauaggugaaaauuuaaaaaauaaauguaaaaaucccuagguccuguacagcaaaguucagcuagcaaagacacugguauucaaaaacacugacaaucucaaaccgaagauaguuuucuaugacaucugagcuuugacugguuccaaaucagcaccagccucaauaacaggacuggaauauuaggggaugcagaauaaauuacuccaauacacuuccuuuuacuuguuauuguuuuagacuuuauuuuuuguaagacuauuauuuacuuacuauucuauuuauuuguuugcuuucuauuuuguuugcuuucuuuacuuauugaccauuuguuccauucccauuauucuuaguauucuacuucuuuucauuuaaacuugcuucccuuuucuuuuccugccccuuuccccuuuuuuuuuuccuuaagcugcuauuucuaauuugacccuaaacaaguuuugacuacuuacauuauucuaaacauauuuuuaauuaucaauggugcuauaaaugcuggcaucaaucaauucaaagucuauaucugaaaauuguuugguuuuauuguauguguuggagguuucuuuccuccuuugaguaguguuaaggauugaaaacucaacagaaggcuaauuacaaauaaaacuggaaaacauauccauacugacaaguguacaaauuagaacacaaaaacaaacaaaacauuauaaauggaacaaaguuauuucagaagaucagcauuuaauaaccaauaaaaagauggccaacuguuugaaaugcuguucaaagaauucugaaguacaugucaaugagaaguuuagcaaagaaauugagacuggugcugggagggaggaugauggaaauaaauaaaauaauuaaaaaucucaguggaaaccauaaauaauagaccaaaucaaguacaagacagaacagcaggaauugaagaaaaaucuguauucagacacacaacaacacaauaaguaaacacaaccaaaccuuuuagaacaugaucaaaaugaaacuaaagaauacauggagcagaaggaacuuaaaagcacugagacuaagucaaugaaauaacagcagaaauuuucuaaaauaucgagaaagaaaugaacaucuauacagaaagauguguaaaacccaaauaaaucauggacagaaagaauugcuccugagcacaguguagcucaaauccuaacacuacaaagaaaauaaaaguaucaacauacuaacaaagguaaauucacuguaacauccaaccucucacuagaaauuuuuaaagacaaaaaucuuuucaaugauuacuauauccaaaguuaucuuuuaaauguaauauaaaaacuuuccaagguaggcauaacauaaggccacuugugaccacuaaacuacaguauacacuuaaaggaaacuuacacauagcagaaugauacaaacagaggagcucaaggaaaaugaauuuuguaauucuauauaugaaaaauuaagaaagaagcaacugugucuacauaaguuaaugaaagaaaaacagaacaaugaaagaaacaacaaaauauaaauguuuuuagcguuccauuuaugagacagauuagccaaaugaauuaaaagcaggaucaaauuauuuguugucuauaagaaauguauuucacuugaacagaagcuaaaggaaaaaaaaaaggagacugaaaagugaguggaaaucaaaaaagaacuggacuacugacauaaguauaugacuguauacuauaaaagaaaacaacugggcuggagagauagcucagcgguuaaaagcaccuacugcucuuccaaaggucccgaguucaaauuccagcaaccacaggguggcucacaaccaucuguaaugagaucugacacucucuucuggugugucugaugacagcuacaguguacuuacauauaauaauaaauaaaucucuuuaaaaauauauuaaaaauguaauugaggaaaauaccuaaaaaaauauuuuaaaaaauauuuaaaaaaagaaaacaaccaaugagggauguacaauuaauuauaaguauauaugcauuaaaugaugguguacccaaguucauaaaaacaagcacuaccagacuacuguaaaauccaaccucucgggcuggugagauggcucaguggguaagagcacccgacugcucuuccgaaggucccgaguucaaaucccagcaaccacaugguggcucacaaccaucuguaacaagaucugacgcccucuucuggucugucugaagacagcugcaguguacuuacauauaauaaauaaauaaaucuuaaaaaaaaauccaaccucucaccagaaaguacaauauccauauagaaaguaacaagucaaaauacaguaaaauacaguaauaaucuuaacuuuccaaauuaauaacuuaucugauggaaagaaggaaggaaggaaggaaggaaggaaggaaggaaggaagauugauuuuaucuaaacuguaccaaacaucaaauggacuuauuucaagacaucuaaaaaacaucucaccuucugcagaauaaaccuuggcagcccauggaacucucuaagagauaaaccacauuuuugaacauuaggcaagucaacaauaguaaaaauuacuuucuuguacuuaacaaauaauaagagaauaaaauuaaaaugcaaaaaaaaaacuagguaugcuacaaauaccugaagacaauauaauacaaucuuaaguaucauaagaguaacugaaggaaucagaacagaaguguuuuaaaggaauaagucaaaugaaaagaaaacacacuaggaaacagcaaaaucauccucagugaaguaacucagacucagacagauaaauaugguauguauucacuuauaaaaaaaaaggauauuagcaguuaaguaaauaauaaccaagguacaaucuauagagccagagagguuagguaaagaggggggauccaguagggauacaaggaucucccuagaagagugaaauagauuauacagccaacugggaguagauagggagaguaagcagguguggggaggugagcagguggagggagagaugggguugagggaaagugugguagaaacagcuggaauuggggaggaaagaauuuccauguugguguagaaaccuagugcauuggaaauguccuugaauguaugaaagugacccuaauaaaauggucuaguaauggaagauauagaaucuuaaguggccaucucuugucuccagacaaccaaagugaguugcacuucaguuaagugaagagggucccauagaaauucccaaacagggcuggaaagauggcucagcaguuaagaccacugacugcucuuccagagguccuaagcucaauccccagcaaccauaugguggcucacaaccaucuguaauaggauccaaugcccucuucuggugugucugaagacagcaacaguguacccacuuauaugaaauaaauaaaucuuagaagaaggaggaggaggaggaggaagagggagaaaagagaagaggaggaggaggaggaggaggaggaggaggaggaggaggaggaggaggaggaggaggagaagaagaagaagaagaagaagaagaagaagaagaagaagaagaagaagaagaagaagaagaagaagaagacgacaagaaagaaagaaagaaagaaagaaagaaagaaagaaagaaagaaagaaagaaagaaagaaagaaagaauaauccccaaacagccuaagcuguugucaaaacaacagguugcuaccugaaaacuaacaguagagcccuacugcuaaggacaauauccacacuacccaaugaacacggagaagccaagcugcugccugcauggacucuucaccccuacacucuacuucuuugguguaggaagguacucuacaagcuaccaaaagagauauacgcacaccaacccagccacaaaaccuuugaccuacaaucuguccuuccuguaaaauaugcuaaggcaguaggggcaaagaacuagugggaguagccaaccaaugucugauuugacuuaaggcccacuccaugagaagaagccuauauccagacugcuuggauaacuaagaaccagaaaccuaggguaaaacaaaaacacuacuuacguuuuaaauuuuuuuuuuaaaucuuaaaaaauuuuaaagucaauaaaaugauuaugguauacacauuguaucagugccuaaucuaguuacugucaaaagagguuuucucuggcagcagauggaaacaggugcagagauggagagaccacagucagacauuacauggacagaauauuuaaaugggagcucucaaucaaauacuuuacagcagagagcagggaagcccuuggaagagaagguggaaaaacuuuaagagccagaggggauggacgauaccagaacaagacccucuaaaucaacuacgaaagucucauaggaaaugucauaaacugaagcagugggucuguaccagguauguaugucuguauguaugucuguauguauuuguaagugucuguguguauuauauauguauguauguaugcauguauauguaugcauauacauacauacauguacuacauguauuacauauauuacguguauuacauauauauguaguauauuuauacuacaaauauguauauacauauaauacacacacacauaggcacacacgcaugugcacacaaacacacauguaaaauagcuauagguuuaguauuguaugguacucccuggugugagaacgaauuaggcuucugacucuuaugccugcucuugugacucuuuuccucuuguuuaccaaggcagacuaccaugauaguuuuugcuucaucuuauuguauuuuauuuugucauguuaaaaaaaaaaucaagaaaggaaaauauauuaugauacagaaaggcaucucuaacagugaaguuucacuccuuccuuuagaaaauucggucagaauucaaauaaaaacuuaacaaugcacaucacaaucucagaaaaauaagaacaacccaaacuacaaacuaauaccuggaaaaaaaaaagaauaaagaccaguauagaaauuaauguacugaacucuaaaacacagaguucuuucuuugaagagaauaacaauuccuuagcccaaauaaccaaagaaaggcaagaccaaauuaauaaaauucaagguuaagaugaggacaaaauaaaauguaguacugaaaacacaugaggucuuuaguaauuaauaugaaaagcaacauuuaaaaagaaugaaguaucuagaagaaaguuauaaauuccucaacagguaugaucuauaaaaauuauauuaaaaggaaauuaaaaaaaacuaaagauacagaaagcaacaaaacugaagcaguacauccuaccaauaaagaaaagcaaagaauagauucauugcuaaaauuaccaguucuuuauagaagaacaaacggcaaaaaaccucaaaguguucuaccaaacagggaaugaaaacuacuaaagccauucuacaaaaauauuauuuugagaguuccaaaccagguaagagcacuuagaaaagaacacaccucaaacauacuaaaaggcuauaaaauaaccugagacuauuguuauguuaaauaaaaaaaaauacugaagucauuuuucucuaauaucagacaugugacaaggguguucaguuucuauaauauuauucaauguagcacucugaagucauagagaaaacaagaaaaaccagaacaaaacaaaugggaaagaaaagaacaaauuaucucuguaaguacacaaaagcauucuuuacuuaaggacucugauaaacacuuguagcaaaaagaaagacauaaccagggcuuuucuauauaacccuacaaagaucccaagaaacccagagagacagagugacagagacagacacacacagagagagagagagagagagagagagagagagagagagagagagagagagagagagagagaaaugaauauagcaaaaacugacaaaugagacugcaacaguuaaaaggcaaaucaguagugaagagacaaccaaaauaauggaagaaaaucuuuaaugcagaaaacuauacaucuaacagaauuaguaucuagaaugucuaagaacaaaaaggcacgugccaaauaaacugauauuccaauccugcacuaaauuagcccucuuccucaacauuguaaaacucuucugugauaaaaauagaacaauccaacccaagggcauauguacuggagaucugcuuuagccccacaucugaggugggacggcaugggguagggagagaugccuucuucuaccccccucucacuaccuacagcagguagaacuggcccuuucccuuacugauugaaucacucaggagcacagguccugcaaauugacuauaacagcucagaaaagcuggcuauggugauguugcagguaagcuggaugcaaggacauugagagcacaagggcugauccugcuucauuggguaaguuaagcaggauagugcuugagaguugaccucggcugagaaaaauaacucaacuaccucccaagcacagacccagggccuaccccaacaucuacuccaauuaugaucugcuggaacuuaugaaguugccaguucugcacauccaaaacugcaggaucuccaugacacaggguaacaacaggauauccaggaguccugguugaggauccaauacggcagaaccuagaggccucaaaauagaccaauaacucauugcaaugaacauuugcaaguagagauguguggacaaaagccuagaaaaacacaauacaaaaggccaguaaauaaauucuucccaacauauuauaguuaaaaaauaaauaaauaaaacacagacuaaaggauacuaaaggauacaagaaaaaagugacaucacucauaaagcaggcucaucaaaauuaauaucuauucaacaaaagucuuuaaagcaugaagugucuggaucagugauccuuaaccuuccuagugcugugacccuuuaauacaguuccucauguugugaugacucccaaccaaaagauuauuucauugguacuucguaacuauugcuacuauaaucaaucauaauguaaauaucugauaugcgggauaucugauacgcaaccccuguggcaguuaugacucucaggcugaaaacagcuagccuggauccugaaagaucacaacugguaacacaaagcauuacacuuguaaaacuuuacacaaaaauucaaagacaaauagaaauuuuccaugauaaacagaaaaaacacacaucuuucaagaacucugauuguaaauggucuuaauuaaucccuucuccaaagauacaaaauaaagaaaauuagaggaaaaaucuaccagguggauguuacaauuuuagacacauaagcaacacagaggcgcacaauuucauaggaggaaugcuauuagaucuaaaaccacgugucagucucaacagugacugauagugggugacuucgcuacccaacucucuccagcagacagaucaucuggacaaaaauuaaaacagaaacucuggaguuaagucaaaugaauguaauagauauuuguacaacauuccacccauauacuaauacauucuucucagucuauggaauuuucuacaaaaaucaacuaccuaucaagacacugaaaaagucauaauauaugaauacuguaauaccauacuucuuuguauagaauacaauggaauaaaauuagauauuaacagcaaaagauauuacagaaaccaugggaacuaaauaacacauuacugaacaggugaucucugugagcucaaagccuuccuggucuacagagcuaguucaaggagagucagggcuacacagagacaauuaucuccucuagaaacuaacacccacaguuuauucaucucugagaaaagcaucauaaaugaugcacaagaaaauaucuucaaacagcaaaucccuguuaaaggaacucaaagacaauauaaacaaauggcugaaugagaacugcagaaacauguaggugaaucaaguaacacaauccugagaaccuuaggacacagaggauaucucaacauaauaaaggaaaaacagaagaaauuccuggcaaacauguuaaauaacaaaugaaaaaaaaaaaaaaacccucagagcauccuuacuaaaauuaggaacaaaacaagcacauucugggccugugcuuguuauuucagguuaauauaaugcuugaagugcugaugagagaaauacuguaagugaaggaacuaaagaaaucaccagucaggaaagaagucaaauuaucuuuauuuacaauaaaaugguucuauuaaaaaaaaauccuguaaguagcaaacuguaagaaucuaccagaaaacuccuacaguugauaaacacucagcaaaguaacaauacaaaaugaagacacaaaacucaguagucuuucuuuguacaaauaauaaacaaaaagacaaagaaauuagggaaaccaucccagucacaauaaccucaaaaauuauuugaauaaaucaaacuaaggaaguacaagaguuguauaauuaaauuuuaaaaaauuaaagaaaauauguugaaaaagcaaccagaaggugaaaaaaaaccacccaugcucagaauguuguaaaaauagucauucuaccuaaaacaauuuacagacucaauauaauccccaucaaaaucauagcuugauuuuucauaaaaagaaacacuaaaauuuauuucauaauacacaugacagaaaaacaauccugaauaguaaaagaagugcuaucaguaucaucaucuaugauuuuaaguuauacuacaaagcuuuaguaauaaaaacagcauggugcugacauaaaaacagacacuucaaguaaugaaaucgaagugaaaacuucuugaugguaagaucagauugcuauagacaccaaccacauccuugaaucacagagcauggagacauuaugcugguacucacuggaaaacuuuaucacaacuggcuauaauccacugugcuggcaagugcuauauaaacucucuugagaauaaaggccucaaucucauccaguuaugaacccugaaggcuaaaaguggccugacaagauaggauuacuaauaauugcauagguguuuuaggaguaacuagccacuauaugauugcauuaaaggucuacucuauaaaguggaggccauacuauuaaaggagccaagaacuugugaauagauaagguaauaggcccuaggguagaacccauaccauuacucugcuaaaugcacauaauauuaaaaugacuccuaaugauuauugcuauaucccgagaaaagcccauuauuuuagcuuucacuagagaagcuuugcuccguaacauauggcaaguaacagagaugauccuauuccaaaacugguaagcauggcaagaaaaagaaaguguuaagugcucaaucccaaaucagacauuuaucucaccccaaagagcuggaaagauggucacucacaggugguaaauaacuucaaggaaacagucuuuuccaagagcaagagacuagaugcauauaugaacuuaugacaagucauuacgauaauacacccaagcuacagccagccaaaaccccagcauggggggguggggguagagaugucauccuaccacaagugucuuaugaaccccugguaaucugacuacacacuacagcaggucccaauuccaagacuagccugacaaugcaaaacuagacucaauggagaauaaaggaaaaaaaguuugaaaaaguauaaucuuaaaauaauggaaggguugagagggcuguaagaggaggaguugaggaagugauuauauucauuuagagacuagaugaaauuuucaaauuuuuuuaaaggaaaaaagaauuuuguaaaaaaaaaaaaaaauuaaacuucaaccucuugaauuguugaccagugacaucccagugaucacucucuuccaaugcuggcuauuuauuuccauaguuuuugguuacucuccagaacuugacaguaagacacuacuacugaagauauaacacacuucaguaaagaaauggaaaaauuaagcaaaaacucaccuugaagcuugaucucuacuaacuaggaucuguacaacuugacaaugcuaugcaaacuaucugacgagaaaaguaaucaggagauauucaacuuauaaccaaccaaugguccuuaguuauaucacaguucauucccaaaguuuccauaucauuucugugguccaauagcaaucacugacuccacuauuccacacuaacuauauauagugaaagcaugacccaauaacuaauccuuguaucuuccaaaauaccaaauuacagacucaauaaucucuaauuucucuuuuguuauugcuuacuuuuuuuaguugguauuccucuaguuauuugacuuugaugaaaaacuucucagauuucuucuccauauuagaaggcuaaucuuagguuaaagaaccuucaaagguucaaucugaccaagaguaugcucaaaaaacccagaaaaauuuuugaaaauagaaccaccuauaauuagaguucaguuucacacagaaacuuaaaagcauccgaucuuauaaccagaagucacccugauaaaaauguucagcucucauaaaaaauucugaaaaaacauucaaggaucaacaaggcaaagugauuugucaaauggcauauucuuaagauguuauguauuaucccucauaaucacaggcugagaauauguaauaguuauuuagaaauaaacugcuaccacaauauauuucugagacacuaaauauuuuucauacauuuaaugauuuuucacuaacacuuaguaagcaagcauuaacucauuaacuaacuauuccuuauauauuuugcuacguauucaagguagcuuuaguugugaauuugauagucuaauguguagugugaccuaagggacucucaauugagggacuaccuagauuaaacuggcccaugggugugacugggggaaaggggaaggucuugauugauguaagagggaccaguguacuguggauaauagcauucccuaggcaggugguuuuggacuguaaguaagugguguuagcaaugcuuaggucugaaaauugagucagcaacaguauaaaguuccugcccugacuacuuugaacgauggccuauaacauguaagcugaaauaaacccuuuacuccccuaaguuucuuuuuguuagacuguuaaauauaaacagaacauuagguucccauucuacugagaccuuaaaagaaaugaagugauacuaaaucucagaaaggaaaauaguaagaauugagaagaugggacacaaucauauuuugauagagauacucagaaaagauaccuaugacaggcauuaucuaagaauucugaaacaaguaaaaaagaaaaacacguagauuaacucaagagggaacagucaguaaguuccagaacuaaaaccucaaaaguugcagguuaagaacauaaugcuaguacaggaugucacauaaaugaaagagccaguucagggcuguaucaauuucuaaccauaguuuaagaaauaggaaaccuuugaaaaguugaguauagaaaagauggcuuaacuuuuuuuuaaucagaaaagcccauugaauuguugguaguaaauagagguaggaacaaaaguacugagaaacaaugaugucccuuaucaaaagauggcaaugguacuacaaaugcuuuuuaaagaagcugaaauguauucugaagauaaaugcaacauaacuugcaaacaguuccaauaugugacacaaagagaaacuaaggaugcuuucuagaauuugguuuaaaauaaaguccuacuaaauaagaugcaaaugucuaucagauuucaagggauugauagcauacaaauaacaguucuauuuuggaugaauugauuucuggcuuuuuuggggggugguguauacauguguugugcacacaaacauggaggcaugcaugcccaugcaugugcauuuggagaccagaaagcaaaggcggucauaauuuucuaaugcuccucacacaauuuuuuaagacguggucucucccuaaaccugacacuugcugaauuaucuagacugaaugaacacauuucaaccaccauuccauuucugccccuccaccaaggcugggaugaaaggccuugccucacuuuuuacauagguucugaaauucuaguccacauaguuggaaagcaggacacugagccaacucuuuaggcccugcuuuuagcugcuuuuuguguuuguuuguuuguuuguuuguuuguuuaaagccaugaucucauguaacuuugacuugccuuacuguauaggcgaagcugucccugaauaagcucccaaguaccgggaguacagaaguggagcaagcaaacauacccagccaaauaucaaaauucuuaauacuucuauaugcacaaauucauaauaugaaauuuucauauaauccaccuagauaucuucugguuuucuuucuucuucuauuaaacucaugggcuaaaggacaucaaugucaaugugcauguuauaucccaguauuaagagucuccaaaauuauuuguauuucuuaauaagagaacuuuacaaucucuuuauuuccaaccauaacuccuuuaucuuaagcauaauaaacaccauauguaggauuauuaaaauguuauucgucuguuaaaaacacucacucaugcaauaauaauuuuaauauaugaagacacggcuguuuuuccaaaguuuuuauuuucauugacaaauaagaacuacauauauuaucauaugcaaaagugauacaucaaaugaguuuauaaauucuaacauagcacuuuugcacauauacuuaauaguugacuuuuagugauauucaagaaaauauacagaaagaagucaccaugcucuacaauuuugguccugaacuacauucuauucauuuugcauuuuuuaugucuaucauuuauucuacucuaaguaacaaacaauuuuuagaauguuuuuacagucuauguacaggaagaugaugcacuaccuguuuuugugcugauuuauuucauugaaaauauaaaggaucauuuccauccauguugucaccgacauaagauuucagaaaaaaauuuuaauggcgaaaaauuacaucaucauauaugucaauuuuuauuuguuuagccacugacaaacacugguuuauuucugcauuuuguuuaauuaaugcugcaaucaaaauuaaacugcagguaucucuuauaacacacuauauauuucuauaauacaauugcuaggucauugcaauuuuuaggaaccuguuauuuuccauaaucgaucuaauuuacauuccaaacaacuguguacaagauuucuguuugcuuacaaccucaccaacaugaacauucauauauucuagcagguaggaaguaguaucucacuguuguuucauuucuuagaugauuagaaagguaaagaauuuuuuuucucaugaauuugaugcuggucauggugguacaacaccuuuaaucucacacucagaaagcagaaacaggagaauaucugaguuugaagucagccuugucuacagagcaaguuccaggacacucaggcuacacagagaaaaacuugucucaaaaaacaaaaauaaauaaauagguuuuuccucaacacagaaaaagagcaagaauugaaauauuugagauucugcaaagaauagaggaaaagaaaaaauauuauaauaucaaaauaauuuuuaaaaacucauuuaaccacuuugccauuuguacuccuuuuuuccccugucuggucuauaccaccuuacuugucauccucuggacuguaguccaguuccacauucuuucaccagcauagagcuuaccaaucagauuagccccauggauccuccuggaucuuccuccccagcaccggaauuuuauguguacacuaccacacacugcauuuuuauguuguuaugaaaguuaucaaaucagguccuuaugcuucuuaggcaagcauuuuaccuacugagcuaucuuccuaccggaacuacuuguucagaagcaccuauuuagguccccuauccacuucuuccaugagcugucugaauuacacauuucauaaaguaacuauucagcaugugaaugcuuucauucauuccauagggggguuaucuguuaacuauaucuuuucuuguguagaaagcuauuguuuuguauaaccccauuagucuauuuuuuguaguuauguuuuuaaaacaaaauuuacaaacacuaauuaaaaagcuuuuccuguuuuaauauauuaggugauacuuaaaagaggauauuaacuaaggacacaacuuuguccuauuuaacauacugguuuuuuuauucugcaagaguggucagugcuccuaauagcugagccaccuugcagccucaagaaugcuugagucagagaguaaggcaauauggccccuguaguuaggcagacuuggguuuugauuuuagcugauguuguuucuuuuggggauuucaagacaguguuucuugauguagcuuuggguguccuagaacuuccuccugacugucucugccucccaagggauuaaagauuaaaggcaugcaacaccaccauacugggcuaaaauaaauuccacuuaauuauaaugaauaauaauuauguauuguuuaauucaguugguuauuccuuucugaagaacuuuuguuacuagccuauaguacuagacuuuuguuuucauaugagaguaaugacuuaacuuauaguauuaguucuucaagguuuagugaauuucaucagugauaucauuagguucugggcuuuaugugacaaaagacuuaauuccugauuuuuccaucuucugaugacacaacauucucaacucuggccaucaauaauagcaugcaaacuuaaaaugcucuaaugcuaaaaguguuauacaugaaacacuacuaaugguuuguccuaucuauucugcuaauauucaaucuaaaauauuaucuauuagagacuacugguacagucuaacugcaagcacuaugagguuucuaaacuaagcaggccauucagugcaugaaacuuucaacauuuggucuguuuuuuuaaaacccuucauaucuugguaaguuuucaguacacucaaucucaacucaauuauaacuauaguguuccacaaaacaucauuaaaccuuuuucaaaagaaaaagaaaaagaaaaagaaaaaggaaaagaaaaagaaaaaaaaaguacauggggagcaaagaugugguggcacacacuuuaaucucagcgcuuaggaggcaggggcaggccagucucugaguuugaggccaaauuggucuacagagccaguuucaggacagccaggguuaaacagagaaacccuaucucgauggggagggggaaaaaagguacauggggaaggcaguucuuuaguuucuacuauaccugcagcuaucuagguauacaaaauaaacgaguuuucuuuuaaacaacaacaacaacaacaaaaguuauuuggcuacuaaacuacaauaaaauauaaccucacauccauuaggaugacuauuguuccccaaagaaauuuuaauauacgggucaaguuguaaaaaaaaaauguauaaaacuuuuauucuaagaaauguaaguaaaaugguauagcuauuguuuaaaacagcaugauauauucucaaaauauuaaaaauacaauuaccaugauauucuauaggaccaaaagaauuugacaaaagauuagacccaugcuaaucacaacauuauucacaauugcuaaagcacagaauuaacccauuaacaaaugagcagaauauagcauauacaagcaagcaaguguuauucagccaaaaaaaaaaaaaaaaaaggaggaaguucuaguauaugcuacacauaaacuucaagaacacuguguuauauaaaauaagccagucaucaaaacaaaacaaaaacugugugacuacacuuacuugagauaguuagaagcaccaaacccacagacaaaaaguagaauuuaauugccagccacaguggaagaaacaggucacuauuuaaugcauacaaaguuucaguagggcaaaaugcaaacaguucugaugacaaaugcucaaacauauuaauauuuacaauaccacuggcucauauacuuuagaacaauaaagaguaaauuuuauacauuuuauaaguguuuuaaaguuaucagagaaguuacauggucucaaaaauuuaaaggauaauucauaguuguuucuuaagacuucacaauguacuuaagcauuuaaagggauguaaucugcuucuaguaaggaaaaccuggacuuuuucaaccacaccuuaaacauagcuauacacaucuaucuuuacuuccuccucauuucuuaagacaggaaugcauaugugugugcauuaacauagaugguauagguagauuuauacauguagagagguguguuuagaagucagaggcuuguuuucacuauacucaaagcuugucaauuaugcuaaccuagcagccagcuugccucuuacuccagucuucuuaauacuuacauagcaagugcuauauucaccaagucuuugccacaguccccugcuuaauuccuucuaguuauuccuauuuucauuuuucauuccucauugucaaauuuugaaaagguucucaauuuccuacuuuucccuacacucaagugucuugcuucagaaccuuggcaaugacuuggccuagaacacuguucaaauauccaacugcuuaauccccaguaacauuucaggauucaaccuaguuuuacucagcuauaccaauguuccuacuaugcacuagauuucuuuugcauaauuugguacuccucuguauucccacuguauaccaaguauaauucuaucucaauaauuaaaaaaucugauucugcucuuucugaagcauugagauauaagucucaagcaucuuuauacccaaaacauagcaccugaugauuaauauuuagaacaggggucauauuuaaacaaucuugcuuucaggaauuauaaauuaauagcaggcacauagauguuugaaucuuccucuaauuccccuauuuaucaacaacugccaagggcacaaaaaacauugaaaauucagaaucauguauguaauuaucuacuuaccauuagacaucuaauuuuuugcagagguuuggaaguauuugguuaggagauauaaguagacauguuccaaucucuagauacaauuuaaaguuguuccuucuuuuucuuuuuuuaauucaauuuuaccuuuuuuuauuuuaagccugaaagguauuuucaaauaaaauaguguagggcaacuugagacacaaaauaaccugaacgaaguuauacuuacauucggcuagcuucaauguccucagacugggauucuccuggugaucuguaaaauguaauuaaagacaaauauuagugauuuccaaaaaaaagguauagaaauauaaguaaggaagauaaacuggaaaacaagacuuaaauuccaaugaaagggugcuuuaaaagauuuaaaacuaagaaaaaaaaaguagaaagaucagauuaucacaacacauuuaagaacaaauuuuagaaaccucaauguuuaaaaagaaaauuaaaaucuuuauauuuagauaucaaauuaguauaagccauaauuauuuacaaugucaaacacauauuaaaaaacaagacuguuacuuucuauuaaguuggguugugguauucauagucuugaaauuaaaugaaguguuugcaaacuguaaccugagcaaacacuaagguguaggauaaucaccuuuauuuugaagugauauuauacugagagauuuguauucauuuauacacugucuauguauucagaaaaagcaaggauaaguacuugcagaaaaaacuauuuccuucaaaaccuaaaacauuauaaaaaaaaaaaaucccuugaaaaaugucugccaauuucugcaguagacaauuuaaacucaaauauaacaguguucauagaucuuuaagauauuuaaaugcuaugcaccauucuaaucauaauuccugugguucuauaaggaaauuagauuucccuaaaaagcacuaucugccgucaccguguauauggagcauuauguuugcuagauaauuguaggcuaguuuuaguuuuaauaucugcugguuauuuucuuuauuuuuuaauauauuagcuaauauagaaauacauauaaagcaccaaagaguaucccauuuuuauuggguggaacauaagccaauuucccuauucugaacaucugguuaaagaacaaauuccagugaugcacacagcaauacuuugcuauacuuccugucaucagaaugcuaaaccaggauuuagcaugaggacaggcuguucuacauagugagacacugccucccaaaaagaaaaaaaucuguuacccuacauaucuuuacugugagacaaucaauguucuaagguaaauuuauuuuaauaccuauuucuaaugcuuuaaauucccaaaauagguuaagaaagaaaagaauaauuuaaauuuucaaauuuguauacaaagacaaucugugaauuuacuacugacuuuagucuuucaaguuaaagacuugauuuguaaauuuaucacugacuucagauauucaacuuaaacaaaaaguuuauaaaaggcugguuguggcuuaugguuauggaagauuuuuuaaagcaaugauucuuaaguuaggggauaaagaagaggcucacuaguuaagagcacuuacugcucccagagaaaucaagguuugccucuuagcacccacacagcugcucacaaccaucacaaacuccaguuccagcacugaugcccucuucuggccuaugugaguaucaggugcacaugugcaucugguacacacauacauaccugcaaguaaaacucacacacagaaaauuuaaaaaucuuagccaggcaaugguggcgcacgccuuuaauccuagaaguuggagggcagaggcauuggauuucugaguuugaagccagucuggucuacagagugaguuccaggacuacacagagagaaaucccugucuuaaaaaaacaaaaaacaacaacaaaaaaucuuaaaaauuaauguauucacuucuuuagugucaaagaaauuucacuucuuugcuugacuuucaaaauaauacucauuguaauucauuuagauuccaagucaguaacacacacacaaagaaaaaggaaaaaagauacgauuaaaaacagaccccaaaagcucagacaguuuagauuuucuuaguaguuuauuuauauuuuucuguuuaucacaaaauuacauaagaauugaaaaauguagauuaggagugauaucaaauaaaaaauucuccacccucuucccccagaaaacaagcaaauaucucagaaauaaugaucucuacagccuuaagaaacuaccaagauuguuuccaaacuuauaucucauauaaaauggcuagaagaguuaaaacaugaugguaacccaugcacuagcuaacucauuuuggaaugugucuuuccaacaucucauauauuauuaagacugugagauaaagcugacuugcaaaacaacaacaaaaaccuguuagcaauuaggaagccaaauuagaagucucuaaacagguaggaagcaaaguguucuaaauguacaggaaaagaaaaauuuagagaagguuaagaaugaugagagaaaaaauauuauauaagaaaauauaagauaagagaaaaaaagaacuauaucucaagagaauauuauagaacugcugcaguuucaagacccuaaaaugaacuauagaacaaacauauugucaaauggccaacuacagcuauuuucgcaauuucugauugcuacagaguaugugaaugccaguaacauaaugccaaccaaguauuguaaauauacuagacuucuauuuaauauucacaaauauuagaguaaguuauuaagcaccauuuagccaaacuaaaauuuaagaaaccccagaaagaucagaguaaaauuaauccaaacaaauuauucuucuuaaauuauacucuucuugaucucuuagacauaguauagcagaggcugcucccauucaaacaguuuuacuuuagucaagagaaaaauauauaaauacaacaaaagcauguuucugaucauuguguacaucugaaugucuaugcagacaauuuuaauaauauucuaauuaaguugccaaaauauauccuaaaacuagaguuaacuuucaaaguaacucuauuuuuauaacuauuaguagguguuacaaaccacaaaguauauguaacaccuacuaauaguuauaaaacuguucucugcucuuaaaaugcuugcugcuuuuuacugacaauacauuugaaauaagaauucaggacaugcuccuaauuuuaccaaauucaaaauauagaaccaacuaaaaguuaauaaaaaauccacuaccaacccaagacugacccaaguuauccuaaaguuuaccagaauauuaauaaaggaaugaaugaaauuugaaaccugaaaaauaccuaguaacaauggugaggaaaaagucuuuuaaaaguaucaauuuuagguauuaacuuuaaagacagaaaauguaaucacaaaacaaauaaucugaacacuggaacaugaccuaguaaauccauccuuuuaaggagguaaaggugcacuuuuaacuccacuguaacucucuaggagaaaaaguacacucauuuuacuaaaggugcaacauuucuggagaagcacugaaacuccugccacauaaaauauuaaaaauaauacuuaagauauuuuccacauaucucuuaaaauguccacacuguaaucuucaaaauacuuaagacauauuuucuuauuaaucuaugcagaaaaacaggucuuugaugauuacuuaucuucaugaacugaaggguaaguaagaaaugcacuauaauaaauaucugagaaaggagguuaaaugaagaaauggcuccguucuuaggucuuuuauucuuagcaauauuccugcuaccuaugcauuuuugucauuuuuauagcacauaauucaucuuacaaugacagccuuucuaagacuguaaaauaacauucaaaauuaccuuuuacaagcuguggccauucggugacaucagggugauaacagcuuugagucacugauuaaaaacagguugucacaccagucuagcugcuaacuugaucugaacguaggcuuaauaauucuaauaaauuaaacaaaccuuuaguuagaacacuagcauaaacccaauucauuguucaagucauuaucuucaaagcuuuaaaucaguagucaauauaaaauuagaagaauaauuaucacaggaaaaccuuuaugaacuauucuucaguauauuguuuucuuaaauggucucuucauuugagaaaaugagguauauucucaauccaaaacuacuccaaaauccagaauguuuuaaaucaucauggcagcaaauaaaaaagggcuggauuuaggaauauuuccgauuuugaauuuucagacuagguauguucaaacaguaaagucuauaggaacaugccaaaaucugaaaaauucuuaaauuugaaacauagucuggucccaggcauuucugauaaagauaauaaucccuacuuuucaauguaguacuauauggcucacaaaauacaacaaucaacuguacccuuacauuccacugacuuuagcucuacaagaucaaaauagaagaauaacaauaagcagccucagagugauuaacugacuugccgaagauuuuguaaauaauguugaaauuaagaccaaaaaaccaauaucagcuaaauuuccacuaaguauuagaauuuugcuaugguuuaguuuugcuuuacaguguuuuguaauuuaaauacauacaaaaagcaaaaauuuagacuauguauuguggcaguaauuagaaugaaacugauuuaguaucaagagucuuuaacugaugggagaaaucagcuaccaaacaggcaaaaucuugauuaaaguuuuacacacacacacacacacacacacacacacacacacacgcacccacacaugaaagagagagagagagagagagacagagacagagagacagaaauuauuuaaguaguauaaucuaucauuaacuuuuagaccuuuggaucuauaagaaagcauucguuuucaaucccacuaagacucaauucuaggaaguaauauaaagcaaaauaugaaugaauauccuauuauucacauaucugaacuaucauaugugauuuuaaacaaaucugauucguuucacagcccuccuuaucauacuauacuccugacaaaaugccaauacuguuaugguuuuauccaguuuucccccaaaauccucuuucacugaucuauaaacauagaacaaauuugaaugagcuuaaaacaaaacaaaacaaaacaagaaagaaagaaagaaagaaagaaagaaagaaagaaagaaagaagaaaagggaguguaagauuaggaagaggaagccccuucacaauuaacacccucaaauugacagcacagacaagccagauggcugaaagcacggaaucagaacccaacuuaaaacaggaaguagugagaaucccaaaggaauuauuaaagcaucaauauuugaacccauauuauuguuagaguuggcucaaguuuauauuauauauauauauauauauauauauauauauauauauauauauauauauauaaacaaaaucagggggucccaauaaauaggauuuauaaccccuguuaagaaauaacccaauuucccaaauuucccuaucauaacuauuuaucuucuacuaagaacagaggcaucacugaacuagcaagggagagaaauaacauccuugaaauaaaugugguccauggcauaguucccuuaguuucucaucaaacagcuuauguggaauuaugugaauacugaaaugaaucuaacuucuaacuuacaaacacaaagauaacacagcuuaaauaaaaucaacuaauucauuaaagaacuauauauacucuuaggauuacuaaaucaaguacucuccacuagucuccucuuuauuagguucaauguucaguugaacaguuuccaaagacauucuaagauuccacucuccaugaucacuuacuauagggaaaucuuggacaaguuacauaaccucucuaaaccucaauuaucuuaaagcagaauuaaaacccuagucuggguuaucauaagagugccuuauauaaaauauguuugcaaauaaaugaaagagauuuuucauacccacagccuaacagccaagucuauuuccuugaccuucuuguucauauuacuuugucucauaauacaguaaacucacaaauucuuccaacaccccacuuauaucccucacagucuaccugguuguauacucagcaccuaguaagagucuuuaaaauugacaggcgcccaaauuuauugaacgcauuugucauuauacuagccguaauauuaaaauaauucaugcaauaugaauuucaaaaaauaaaacagaaacauaccauauuucgccaaacuucugaggagcuggugaacucuaaaaucaggcucuuagagagauuuuuuaaccuaaaauauaaaacaccucacucaauucuuuuaacauaaacuggauagucuuucagaaaaaaaauuacucaaauucauuauaaaauaaaagccaauuucucuucaauaauacuuauaaagauccaaaaauauauugaaagacaaauuaccccacuccuauugccaagaaaaguagcaggguagcucuguaggcugugagcugaauauuuuccgacuaggaaagccauguuucccaucuucauguacaaaaaguaaugcuccacaaucccuuuccucaaaccccuucagauaucuacaguaaguccacuuccagguaaucucuauaugaaaaacuucugcuauauaaaaccuagaguagcaaccauggcuaaauccucugaccugucagucucucaagagugcuaaguuguugaauuagagaaaauguauaaaaagaauauagaugcuuuccugacacauaacagggcucuguuacucaacuaagucacuccaugucuaucacaauucuuuacaaauaaacaauaacaauguacuuauuacagagcuuaaaacaagcucuccuaugauuuuaaauuuguguucauaguucauuuauaacuugucuugaauauuuuucagccuuuaauaucuuuuaaucuuauuuugucauaaggagaaaaccuaauccuauggauuaagcaacuacaaaauaaauaaaucugcauauuauuuauagguaaauagguuggcagguaggugagugagaaggaaagaaggaaaggcaaauggaugggcugauaaaugauggauggguggguggauggacagacagauuaauaaauugauagauggacugauauaacacuauggucuccccaaagauaaacuuuaucacauacuaguaaauccuguggcauaacaguaggauucucguuccaaugacucaaaucagaaaaguucaaaucauccugccaaauauaauauauugcucacucacugcuaccaauuccaccucagggaucuccccacaauccaacacuaucccuaauaauucuccaguggccuuuacuugcuuucgguauagcuuaauugcuccaucacaauauguaaaacuauguuuccaaacccugcuaguauacccuuccuuccagacuagacaaaacauugagaguauguccuuaauuuuuauacuaaauguuuuaaaagguuuauagaauaaaacagcacagaaaaaaaaaaaaaaagaaacuuggguagcuauguaaaugcaaggcuaagaaacuucaaucuguuucaaaagacuauccauguccauuuccuuauaaaccagucuaacucaaagucacgccggaaaaauuagcuuuaaaauucuuuuuuguaauauuucaucuuuaaagaaagaauccauugcuucuuuuccccacaugguuacuaagauuguugugauacagagucuugucauuuuaccucauuucucucuuacauauuugacagaacuauccuccuagaaauuagaauuuggucauaucccucucauauuaaaaaaaaaucccuaugccuucucaauucuguuaacauaaauuucaaacuuuuuuuuacauauuaacugauguccuugucauauggucacauccaguaauccaaacauuacccauauaugaugacauccugaaauaucaaucucccuugguuauuguacucuaucauauaucagaaaucucuauuucugguccuaauaauuuugcuucucaggauauuccacaagaaauguuuuccugugcucugcaauuuccauccucucuuuaucuauaaaagccuauuuaaaaaacaaacaaaacuauucuucuuaaaacuuuagagcaccccaaaugaacaaugacaguuaaggacugagaaugacaauaacacuaacaaugaaaaaaaucagaaccuucacauauuacuaauaaaaguauuucaaaggaauauaaauauauagccacuuugagaaaaguuuuaaaaugccucuaguuuuaaauaguugccauauuucccagacaacucacaccuagauauauaaucaagagaaugcuauauauuuacaacaaaaguuaaauccauauauauguauguauuauauauuauauaucuauuauauaauauauaauuauuuauguguguguguauacacacacacacacaaaauaccauaacaacccaaaaugaaagcauacagaagcccauauacugaugacuggacagauaaucagcuauuuaaaaaacaaacaaacaaacaaacaaacaaaaaaccaaaaaaaaaaaagaaacaaaaaaaaaaaccuuguagaguuucuuuucuuuuaaauuuuuuucuguaaauuauaaaacacacagaaaauugcuuagcauacagcaggcccuggauuucaaacuccagcacuuaaaaaaaauuaauuaaaaucauuaaauugaagcauguagaaaaaaaucauaaaacucuuaucauuuuaccaaccacucagaauuaaagcaaacacaaaagaugccauuugauaucauuauuuaaaaucuaacuauuccaaguacugguuagagaugcuagaaacaaaaauguucauucacuggugauacaguauauguuggcaaaucaaauuuacauaaaauuugccguaucuaaucaaguuaaggauauauccuauuuucuaacaacuucaucccuuuaauuuucccuaaagaaaaccuuuuacaaaggaaguauaaaaaugaucugcgcaauauaggaagcaauucaaaauauucauaagcagugggauacaauacuauuuaguuauccauauacuauaauaccauaaaagauaugugucaacauacacaucucaaaaacagauaaaacacauaaaauaaaacacauaaaauaaagacacauaaacugauggcaaguauguaugaaacacaucuauaaauucuuaagcaugauaucucacuuauuggcaaaggucauauuuaaguacaaaacagaagauauucaagaacuucaagaaaucucuuacauggauaagaagagaggguauuaggacuuggaggaagagauuaaguuuccaaaacaaaaaucaaaacuggcauuuauauuccaggaugguagguaaguagauuauugauauacuauuaagugcuuuaaauauuuuauaacauguuuuaauaagaaacaaucugaauauacaauuucuaagcuaaaaacaaaacccuaagacuauggagacuuccaugacacaaucuucccaauuuauuaaaaguaugcuaauaagauaaaaauguauggcucuugagauuaucuccaugaguaggauaaagccauauaagccugacacuuuaaaaaaaaaaaaaaaacacucugggauuaaaguuaaaaauugagagaccuuaaucuaccuaacuauccucugaccuccacccgcaucacagcauggcacucuuauguccaaauacacauuauacaacacauaaugauaauaauaguaauaauaauucaaaagauuaagacaaaauauaaaggacuaaaggacuagaagaaauguucccuggguuuaaugccaagaaccccccccaaaaaaaacuauuauuauaacaugauaauuuuaagcgcagaauaggugucuaaauaauuaagcuauuaucucuugaccacuaaaaagacgaauuaguaucaauuuuuaaaagaccuucagaaggucuuuguuaauuguccaggccacuauaguacugcuuaauucuguuuaccuuuaaauucucaagccuagagaauuauguauuaccauacauacauauuucaagagccuacagcagauauccuaacccagaccugaacaaucuagaaaguaguucauucaauccaacauuuacaaauaccugcaucugcagaagggaaaggaaaaggacaaaagggagagaacagugagagaggaaagaacugggagacaugagguuagaaagagagaaaaaagagaagaggaaagauggaaaaagggagaagacaaaggauacagaauacaaaauguguacacaaacauuuacuguucucccagacucuucaguauaggaauagacaucuaauuucaacugguuaaguuaugugcauauaucuguuuuuacguucaccucuucccuguguuucauuuaacucaaaaaaaaaaaaaaaauggaguaagagaaaauuucagaaucaguagaaagaugauccauacaaaguuaaaucagaccaaaacaaucuuucauuuuuaaagugacaugaaacauaauguaccagccaguaauuauacaugauguuaaguacagauaaaagacuaaaauuagcucaguucuccuacuaugcuuuaagagcucuuacuuuaaaauuauauagcccaaucuguagaggaaaguauauuccuccuuuaaguuccuaaacuuguacauaacuucuuauucccaucuccagucuagaauccuguacaauguuauagaaucagugagaaacaguaacagagaggauggagaaugggacagaauuuccaagcggagaaauuucauuucuuugaaacuaaggauuuggauuuucuuaauguauuuucuaucaguaacacaugauacagagucaggucacuucaaaagugaggacaaaaacauauucucuaaugagucuuuaucugaaauaagauuuaucuauuauuauacauacuauacaacagguacucaaaaaacaacauuuuaaguuaccaaacaaaaacacauuuagcaaaggcaaauauuaucuuuauuuuuagcauauuguacgcuuagcaaauauaucuacacaaaggggcauaguaaauagaaaucuuaagggagaaauacuaauaaauugaggcuacucuacuuccccuuaggaugcacuaggcauuauuuuucuuaaaaaagaaaaagaaaaagaaaaagaaaaagaaaagaaaaaaaaagaaagagggacuaugcauuucaucuuuuccuuuccaaaaaaauagcaguaugauucacaucugauacuagguaaagugcugaaaccuauaaugagaagagugguaucaacuaaugaaaacaaggaaugaguuucagaaaagacaagaauucaaggaaauaacaaaauauaaaguuuguucaaacuaaaugguacauuacaugguugguuucuuuuaauuucuucuauauuguucauaucuucuauauuuaacuagagguaucagcauuuauuuuauaucacagauuauaaaacuaaauuaauuauggccaugguuccacaaugguaucucuaagacuacuuuuucauaucagaaaguccauuagaaguuuuaagugaauagccaucucuuuuauucaaaaaagcaaaaaaacaaacaaauaaaaaaaacauagguuuuuguuuuaaaaaaagaaaaauuuuaucacauuaaaacacuguucugucgggcagugguggcccacgccuuuaaucccugcacuugggaagcagaggcaggcggauuucugaguuugaggucucccuggucuacagagugaguuccaggacagccagggcuauacagagaaacccugucucaaaaacaacaacaacaacaaaaacaaaaacaaaaaaaacaaaaaaccaccguucagaaaaguacaacacugacaguaucuucauucaugucauagcuauguaauuugugugccaaacugcuugcuuuaaauguccagaagaacauucugaauugaagauauaugcauuggacaccacacacacacaaaaaaaauugguucacacccauaguccccagcacuggagcaguguaaucagaaggauaaguaggugagguuaucuucaacuacuaagaaauugagaccaguguggacuacaagauauucugucuuuuaaaaaaacauauaaaacaaacaagaacuaaaaagugucucagcacuugggccgaagaccaagaauucaagggcagucugcacuacauguccagauacagucuauccuagguuacauaccaugauuuuuaucaacuacuacuacuccgccgccaccuccgccgccaccaccaccacugccgccacagcuaccaccauccauccacgcacacacccacacacauaccccaucaccauucaaacuagauuucuaaggcuccauaacauauuuuuuucaaaguauuuuuuucaaccuagugauguagcucacugcuagguagcaaggcccuguauucuauccccagcuauguaaaacuaaaauugaaggauuuuuuuuaauaucugauuucugucaaauuaaugagaguugugcuauacugcuuaaaugauguugacagguaagaaagaccaaauucugaaauguacugagcugcugcuaagaguaacaacagauuacacacaagguuauguguaaggaaaauuuuauccugcucauauaaaaaguucaguaccuauauacuacuacuacuacuacucugguuucacucaaauaaggaugccagcuucagcaagauuuacauaggauucuccuucauaagccuaaugcaauuucuucgugaggcuucuccucagauuugcuacaacugaacugcaagaauaagcuuaacuaugguacuauggccccuaaaggcuacccuuucccaucauucuuauaacugauucacuugcaauucauuuaauuaaaaaucaggucaagaagagcaaaugacaaggaauucagcuuugcaaauaacuuaucacuaacaauuucauguuaaauguacauuacuuauuucuagguuuuaccugaagccacagaaguaauaagugcuucagaacuucagugguuuaggaaacaaaacaaccuaagcuuauugaaauaguuaucaaaucugaaacuaauucauauauuguaauugcggcuguaaaggagauauaccccugcaaucccagcucucaaaagagguacauaccagaaagaccaggaggcuuagccauguuaacagaaaacaauauaaccguauuccaucauccuuucuccuacaaauuuccugggcaaguuacuuucuuuauacaguaucuaucaauguucaagaaguaucacauaugagcagcauaauccucuguaacaagaaggcaguaccacuuuaauaugauuaacaaggccuuagaaagauaaauggccugcuccuauuuagcucacucuggcucaagacagaugucaggaaagcagcaacuucugacaacaugaauauugcauucuuuauuccauuucaauaauccuaaguuguuuuguuuccuaaaccacugaaauucugagccauuuacuuauucuguggcuucagguaaaaccuaaaaguaauaaguaauguauauugaaaccucuuucaaaaaucaguauaaaaaauuuuuuucauguauagauaggcccaauacuuauaaucuuuccaaauuacuauucauuaguuuaguuguuauagacaacugaaaucaagaaaguauagguaauauuuugaaauuaaaugaaaacaaaggaaaucugauguguacauuaauaagucacuuuauuaagaaggaauaagugucauguauuucaagccuuucaugguuggaaaaagaaauugagaaaaauaauaauauuucuacuuaauacaauuuauuucacaucuuuuauuuaaaagaauuaaauccugugcuaucuuauaaggauuauauuuuacuaauaguauaaaaauauauaacuccauaaaagugaauugcuaauugcaaaauaaguguagcuauucuuccaaacaaacaucucugacucuuauuauugaaucagaaugguaaucauuguccaaauaaaugaguccuaacaggcugaguagcauacuagacuaaaucuauuucauuuuauauauaccacaugugcauguguacuguaaaaggauauugaugggcugcaaguaagacaugaacacauauaccaaggauacaaaaaaggauacaaacaguauccuuuacaauuguagcuaagggguuaagggauauuaagucuacagaacugcccuaaaacuggaggggcacagacaauuaaauuccauaacuuaacagaauuaucacauuaaaaaauaaaaugguguuaugugcaauaaauaaccaaccuaucaguuuccaaaugauagauauuuucuuuuuuuuuaacccuuauaacccaugucagcucacacaauucaaaggagccucagaaacacuaccugauacugauaacuauuucagacauauucuucuaugugaucugaaucuuugcacccccccaaaaaaaaacuucacuaaaagccuaaaaucggaggugaugaaauuacaaguguaauuuuuaggaggaccuacauugaugaaugagagcaauguccuaauuuuaaaagaccauuuagucuuagcugaagcagguggaucuuugaguuagaggccagcuucgacuauuuaccuagcuucagaggcuagugagagacacugacacaagaaagggaagcggggaggggaaaaagacaaaagaaaaaagaaaggaaggggagggaaauauagggaaggcuggagagaugauucaaaaguuaaauuaaaagcacuuguugcucuuccagaggaccuggguucaauuucuagagcccacauggcaauuaacaacugucuauaucccagucacagcaguuccaacacucucuucucaccccuacagacaccacaccaauguggacucucauauaauaaaaucaaaaaaagaacaaacaaaaacaaacaaacaaaaacccuaauaaacagagacagagauacagagacauagugauacuggccugcaaucacagcuccuauggaaggcggcaggacucccauuucaaggucugagcuggaguguguacagaggacuaggaagugguagagcaguuccuagaacuugagaggcccuagguucaguccuuaguccuccuaacacuacucaaauuuacaaugaaaauuaguucugaucuuaagauuucucaguguccuugacugugagauacauuuuuuggaguuggggggaagggggguguugaccagucuuugguauuuuauaaauaggccaaacagacuuaaggauucuggaaacauagucugaggccagccuggucaauacagcuagcuccaggacagccauggcuacacaaagaaacccugccucccaaaaauauuaauuaauuaauuaauuaaagaaaaaaguuuucaauuacacauucuaugacaucucugauugauaacuuuuuugagacaaggucucgccucuuagucuaggcuugccacaauccuuccuuagccucucaauuguugguuuacagaugugagacaucaugccuaacauaacauugucuuuauuuuuaucaguaagaaaaaguaacugucaaaaccaaaacucuauuauccuaagccuuucugaagagaacaucaaaagacuuagaggacuauuuuuauauuuuuauauuguuuuuccguauuugaaaguacuuaaaagaccaccucuuaaaacucaucuccaguugcaaaaaucagaacacugauguuuuuaauagcugcauauaaauauaauauaaauccauuaacaguaauauuaucaauaauaacaaacaaaccuaauuagaauaaaugauaauauaccaguaaccauucauuuaagguguugguuuuuuuaaaggacauuugaaaagaucaucuuaagcucuugaacagaaaaaaaaauagcuauggccaauuaaaaagaaaauguucauaaaaauugagagaaacaauuauuacugcaauuauuugagggaagacacaaauguuuaagaaauacaacugaauaaaauuuacaugucagagacauuauagauaccuaaugaaugcaauguuaaaaaaaaaaaaaaaaaaacgaaucaaauagaaugaguuuugucucagguagaaaucacauuuuucuaauuuaaaaccauaaaaaggguaaauagccgguccuggugguauacauuuuuaaucgcagaacccuggagacaaagccaagaggagaguuagacgucauccagcgauauaccauaagacccuuucucaaaaaaaaaaaaaaaaaagggugaugguggcuauuucagggauaaaaaagccaccuacaaaaccugcauacaaaaggaauuuucuaaacucaaaguuaagcuccucaguuauaugaagagcaacauccaaagaaguauguguauaccacuucacaacacaccaugcaagguaaauauugacacaaauuauuucacaaccuacauucugauuuugaaaacaaaacuacaagucaucucaucuuuauuaugugcuguaucuuucuuaaacgauagacugcgaauuguugaaguucucauuuuuauuacagauucugauacauggcuuuuuuguaaagcuaaguauuuauggauuuacagucauccuuacuuaggcuuaucagcaauacagaugcaguauccacuuccuuaaaagugcaguaagcagucuauuuaagaggagaauuuaauacuaaagcaauuucugucauacauaacaagacaaaauuuuccuuuuaucucuccucaauucuaaauuuacauaauuuaccaaaaagauaucuuaagaguauuaacuaaucugaggugugucaaaaacauucgucgugucucuuguccaauagggcuuugauauuuagcuuuuuaacagcuguauuucuuaaaguucaggccaucuuuauuucaaacgcacuucccuauccaaaacauuuuaacauaaucugcugcuucucccaaaaccauggguuauacgaauauccuucacgaaguaagauaaugguggauaacacaucccauauacuauuuaguuaacauuuccaacaguacacuagcuauuuaacgcaaucccaaagagauuuuauacuguucuauuuuagcaugcucaaaagacauaaaaaaaauugacguaaaauugucuuuagaggauucuucuaaagcugauaaagucuuauuaaaauuauacuuucuauuuuuaaggcuaacgcaauuauagcacauucaacucugauucuuccaacaaaaagccuccgcaucaaaauggggaaaacguccuuuucauuuucucaacugaaaagggggaggggagaagaggaggaggccaacugcuuacagguuugcauugaaaauuaacacagcaguuucugaggaaucaguaacucacguucaacuacugaauccuaccagaagcagcacacgaauaaaaccagagcgcaauccuugggcuugaggugccgcuucauccgucuuccuuccaauccacccccaauaccccaacccacuaagcacacaucuaaauaugucuuccccaccagagcgccccuuuggaggaaaaggccugccuuucgcagccugaagccacggcuggcucuccgaucucugcuuagaugaggcccccgaucucgacgcccugcacguccgccccaccccgggcccacucggguacccgugggugacaaaacccucccuccugcguccagccagcacugacaguuaaggcugcagcagccgcagccaccagggccuaguccuggcaccggccccuccagaccacgcgccccaagcacucgcucacggaggcgggugagggcccggcgccuacccugucagcgcgggccggagggugacgaggggaccggcgguacagaccagagggagcgcgccgggcaggccgcagccgcagcagcacugaccuguccucgcccccgcgcgugggcugcggcccucgcagcugcggccgccucacugguccuugucgcccucguccaccgccgccgcccgccaccgccucguucccuuucgcuggcgccaccgccgggucucaugcgggacccgcgcuucuccucaggaaaccgaggccgagaggccaggcgccugggcaaccuugaagucggcgcugaagcgcugcugucgcgaucuguccacaguggggggcgagggcggcgagcaacuccgaagagaagcagaaggaggcgccaccgucagcgacaggucgacggaagagaagcguaacgaggcggugaacagcugcguggcccggugcgcgagcgagagagcgagcgcaggaggggcgacgaggugcuggcaaagacgaaaggcccugucgucuccuggagucacccaaagaggagcgccaccaucuugggagaaauacggaucucgcgaacgcagcacuggacgagaggacuaggugggcggaccgaguaucccgacaggcagcgcgcgccaacccugccgggcgagggcucggaguccggaggcgggaugcgaggcgggguugcgcgugcgugggauggcgacgggcucugccccgccccgaucgcagcucuguggggcccuccucuagcucgccuucgccugcggcgcaggggccuuugggaaggggagauggccuugggcuggguggaagcuggccagcaucgucgccaucuugagacugggcugagagaggcuugguguuuuuagccucugcuccuuuuacucaaucuauagaccagugugcuucgguguacucgcgagagcggacaggucuacccagccuagcaaagcccaggagucagagggacgaauaggccaagaggguguagccuacuggcggcacgaggaggcauagaagcguuuuguugcuagagcugacccuuacgacuuuucauccgaacuguccgaguaaaggauucaggcguugagauugggcaaccuuucagcaaacaaggccaucagccucugccagaacaugauaugucacuggcuuaccagacuaguagguaaaagcccagccccuccuguguugucuuccaguagaugucaacugagaagaaaccgccuugcuugaucacacguggauagagacuaauuuugauuuacagaacacccgaacccuguuagagccaugugacuuguugguaccggagugaggguuuaacuuagguuuguuguuaaugauuuugacacuaaauuauuauaaagacuagcugacauguuauuuccuggcuugcaacuuaguaagccuuaaucaucuagugcucaaaauguaacaaucacauguauuaaugugcuuuucuguuuauuacagcuccuauaauguguguguauguguguguauauauauauacacaucauauauauaugaaagaucuccccacuauaaaaaauauuuuuauuauugguuuuucaagacagauuucucugugaagcccuggcuguccuggaacccacucuguagaccaggcuggcuuugaauucagagauucgcuuucugaaugcugggauuaaaggcuugcaauuuuuuaaaauuaaaaaauaauaggcguguguguguguaaacuauuacaggauaaauaauaagugcaacuguuauaucagauuuuaagauacuuuaaauuuuuucuauucuuuuuuuuucuccauccauuaaagauccucauuuggaauaccauuguauuauaugaaaggggccaguaauaaauguaacccuuuaaagaguuaucuuugcaaacuauuuaaauacaaaaccaaaacugaaaaucauuagacugcuaagaaaaguaaaguacauaaacuguugcagcaugugaagacgcuuucagcuauucacuccuaaauaaaagucugaaaaugaaaggucauggucuagucaugugaauuaucaaaauguagccagcagcccagacuucuaaaaagcuuaaaaguuuaaaggaaauacauauccaagugccagucaaguucuauauggagaucauggagaauacuaauuucucuuaacaaucugaagaaauuauuuacuuaauguucaauauguauucuuauaugggccucugauguucaggacuucauguauuuugauuuaucauuuuuaaaauuuagaaacauuaaugcuagacauaaagguacaugccugaaaccccaacauaggcaggaaaaucuugaguucuauggcaggccucacuauaaaaagagacuaucucaaagagagguugagaagucaauauuuaugcuaaaaauuauuaccaugaaugauuccugccaacauauuuguauacuuuucauaauauuuuuucauuuuucagacacacuuucuaggaaaggcuacuugguaucuagguguguaauaaggucuaaaugagccucaauaguuugaaauauuuucucauuucaaauguaaaagaaccaugcaacuguauaagcauauucauucuuuaaacaagcuuagugucuacuauuuauuuacucagaacaaccugagccuuguaaaacaauacaagaaaaucucuguacauaucuucaguaaaucgguuaaagaggaaaucaggccuguaaaaguuuuuuagaaccguugagcacuuguaugguuuucugggugucaacuaauacuuauaugcuacuccugagcuaggauaaaaugaucagaaaacguauaaauccucaacacaaaaaaauggucgggagaaaauguccuuaacagagcaccaaugccucuggcucuauggacagaucaaauauugacaaaugaaaucucauaacauugaaaagcuucuguaaggcaaaggauacugucaacaggacaaaacagcaaccuacagauugggaaaagauuuuuaccaacccuacauccaagaaagggcuaauagccaacaguauacuuguauacauaaaauaaauaaauaagucuuuuuuaaaaaggcaucugguuaaucaauaauuaugaauauaauacuucauuuaaaggcaaugucuuacuugacacugauauaugcagaauacaaaauucuauugcugaaaugaucuuuuauuuguuaacucuuaccacugcugcagaacucuauuauuaaagcuuacauuuuuguuuuguaguauuaaccuagucuauuagcauacaaggaccaaacauuuugacuguaguaagacagauaucauucuuagcaacauauuuucuguugcuuuuauuuauuuuguuuaggaugcugaucacaucuauauaaauuugaguaguuaacagcaaguuucugaagugcuaauguguugcuuguaucuuuuccuaccccaccuaagcuccuagaaugggccaagcuaccagccccaacccagcuuccuuugaauccauggauaaaagacacacacacacacacacacacacacacacacacacacacacacguuguuccaguucaacuugccuuuugacacaauuucugggcaacagacuuggcaaguauucauuuuguauauuugcaaauugaauuuauagugagaagugagcaauuggcccauguuucacaacuuaaaaacuaauagaauuacaauuuaagcaaaggaauguguguguguguguguguguacacaugcuuguguuuuguuguagaauuugcuuuguguuuuuuguuguggaauugcuguauagaagcuuuugaggguuuuuuguuuuuguuuuuguuuuuuucaagucaggguuucucagcccuggcuguccuggaacucacucuguagaccagccuggccucaaacucagaaauuugccugccucugccucccaagugcugggauuaaaggugugugccaccaugccaggagaagcuuuugaguuuuauggaggaacacuugacugcuguuaacauuaauucuugggcaagugggcucauauucuuacagucuccauacauccuccucuaagagcauuccaacaucuacauguuagagggcacuauguuuucuucuaacaguuucaguauuucagugguuuucuuguuuuguuuuaagauuuauuuauuuuauuuguaugaguacacugucgcucuugucagacacaccagaagagagcaucagaucccauuacauaugguuguaagccaccaugcaguugcugggaauugaacucaggaccucaggaagagcauucaguguucuuaaccucugagucaucucuccagcccccucaguguuucagaguuuuuugggguuuuuuuuuuuuuguuuuuuuuuuuuuugguuuuguuuuuuggguuuuggagauggcauuguuguuguuguuguuguuguuuugaaagcugauugauaugguucaguuucauucuucuccaugucaacauccacuuguccccacaccauuugguuaagauauuuuuuccuccaguguauauuuuugacaucuaugucaaauauuaaaugacugaaauuacaugcucucaucuucaugauuuaaauuuuauugcauugguuugcauaucuuuuuuaugccaguacaauguuuucuuuggcucauacuuugaaauacuuugaaaucugaauugcuaauuucuccagcauuguucuuuuagcucagcauuguuuugggauaucugugguauuuuaugguuucauaugacuuuuaagguuuuuuuuccuauuucuaugagaaaugaguuaaggauuuuaauucaaguugcagugaauguguaaaaagcauucgauuaaaugaucaaacacacaaaauuaaaucuaccaagucaugagcauaucuucccauuuuauacuauucucuaucuuuuccuuuagacauguaaacuucucauuguaauguucuuugaccuccuuggcuauauuuaugcccgaguauuuuuuuucuuugauauuguugugaguggaaacaugcccaugaacuaucucuuaucugugcuguugguguaccaaaaaaagauugauuugugcaaguucauauuauauccugguauaucagugaauuuuauuguuuuuaguaguaguuuucugguagaauuuuuggcaucucuuauguaaaaugucaugucaucuccaaauggcaaauuuuuuucuuuucuuuuuuccuauuuguagccucuuaauuucuuucucuugcuuuacaccagcuaguauuucuagcacaguauugaaaaggacugaggauaguggacagcucugucucauuucugauuuugaugagauugcuuuaaguuguucucaaauuaauaugaugcucacugugccuuucucauauauagcuuuuuuauguuaauauauuuucucucucaucauaauuuaucuaggauauucaaaaugagcuuaugauagacucugucacaguuuuuugaugcaucuauucaucaucucaauauauggucuuuuuuucuucaaaucugccuaugagauuuauuacauuuauugucuugcauauauugaacuucccugguuuuucaagaauaaauaaagccaauguggucgugguggauaaucuuuuugaugggucucuguauucuguuugcaaguauuuuguugaauuuuuugaaucuauacucaucauuguauugacuuguagauugacuguggcuuuaccuuguuuaguaauagagugaucuuugcuucauugaaggaguuuggggaugaaccuucuguuccuauuucuuugaauaguuuaagaacaauuggcccuagaucauuuuugaaagccuguacaauucugcugugauucuaucaggugcuggacauuuuuagcuacaagacuuuguauuacuacuuuaauuuccaaauuuuuauggguuaauugagauuguugacuucuugcuauaacuuugguuguuugacugaaucuuaaaauucauacauuucuuuugaacuugcagcuaaaugggguucacacuuuuaaguauccccuuauuuuggauugcuuuaguuucuguugcaacacuucccuauucauuucagaucccauuaaaguccuuucugucuuuaauuggcuuagacaggccaagggucucuaaaucugguuuaucuucucaaagaaccaucuaauagauuuguugacucuuuuuauuauuuucacuguuuauauuucauuguuuucugcucugacuuuuauuauuucucaugauugacuacauuaaaauuuaguuuguuuugauugguuuuuccaaaauuuugagugaaauuauuaauucauuuauuugugcucuaguuuucaaauguaggacuuagaauuauaaauacuuuuucaugguauuguuuuugaugugucccagagauuuugcucuuuacuuuuuauuuuguuccagggaagauuuuuucuuuuuucuuuuuccuuuucuuacuucucuugauuucuuccuucuccacuucaucauucauaaagaguuauuuaaucuuccuggguuuauauguuaauauguauucauuuacuaccaaauuaaguuuuauugaauuauggucuuauagaauacauagagguauuucauucuucaaugaauuuguaaauauuuguuuuauaucccaggguauaaucuauuuucgagaaauucuaugugcugcugaauugaauuuuuauuuuucauuauuugggucaaauauucuagagacaucuguuaaguccauuuggucuaugaugucauuuaauucugaugucucuuuauauaacuuguccauuggaaaaaggagaaugccaaaaucaccuaauauugauccacugauguuacucuguaucuuuaaguccaauagaaucuuuucuaugaaauugggcauaccauauuuugcuguauauagaauuaggauaauaaggacuucuugauuaacuuuaacuaguuuaauuaauuauuuaauuaaauaaccuaauuagcaugaaguguuuuucucuuuggauuaauuucaguuugaagucuguuuuguuagauagaaggguacuugguuccuguccccauuugauuagaauauacuuuccuauccuuuuauuauuaguuaaaauuucuauugaaauaugggugugguaguuauuaugguugauuguugauauuguuauauucuuaggaguacuucgaguuuuaauaauuauggcuuuuuguuuccuccuacagucucauggcuauguucauuccuuucuucaacuugaaauaucauuuuauuuuauuuuuuuacuuaauucacuuuauaucuugcuuacugcccccuucuucuuagcccuucccacaauacuuccccuauuuccccuccucuguggggugguagaccaggagaagaagccuaguaaggucgagcaaaggcuuaaagaacugggcacccugaagagacaacagaaguuucaucuaucccaguaucaggccccuuucauguagccucagcccccaucacauaggggcagcacccauaagccccugcacaugaagacgaggcaucccuaacaucacagaccaagccaauaggcagcaccuacugacagacaacaacccaccccaaaacuguaaauaagaucuuauccagaaggaauaaaggugugugagaauuacuccuuagucugagaguaucugucacaagagcuguaacacuccauggaaagagaacugcucccugaaacuuucaccaccagaagcuccacugcauucaccuugcuggcuagccaggccgcugccuguucaacauggcucagcucagcacuuucagugcagcaucuuggagcaacagcagcugcugggauggcagcaccauagcagcaacaccagaggugguggcagcaucaccagaccuggagacaauuccccaucccugcuagugcccuuucccuuucacuugaagccucccaccuggccaguccagcuaucucugcagauagcuuccaauauguagacuggcagcugacacccaacaugggguggggcaugaacccacaagaaucucaugcucuacugauucagcuagcugggcuauaaauauugucauuggccauacauggagcuaucugauggaauuccuuccaaaacaugaaggcuuggcuguuuuuauucugugggauuauaguaguguauauaucucccuggccuggaggaauuuuuuuuauucaaugaugaguugccaaugacagaaaagaggagaaacguuuguccaauggcaacauuucccuuggucuauuggcuuuggggaauuccacagagguccaagauguuaagccuuccugcagaguuaagaacuggcagcugcccugugccuuuuaagucgcugcuauguuaccaggguguuuguuuguuuguuuguuuguuuguuuguuuuuguuauaagaagaaguuagauagucuucaccaaugccugucaggauuaagacaugguccagagggaccuucagccaauaccuagcucuggcuagggggcuucaguuaccccuucagcuuguccaaauccacaccauggugccaaauaaaagcacaagaggaaaggacagguugcuugucuacagaguuacagaagaggggaagggcucaccuuccugugguaucuguucauguaguugcuaugcucgagccccacgugugaucucacaguccccuucaagguccuugucuuacuuaggguuuuacugcugugaacagacaccaugaccagggcaagucuuauuaaaaaaaaccaacauuuaauuggggcuggcuuacagauucagagguucagugcauuaccaucaaggugggagcauggcagcauccaggcagguauggugcaggauaagcugagaguucuacgucuucaaccaaagguugcuaguggaagacugacuuagggugauaguauuaagccaacacccacagugacacaccuacuacaaccaggucacaccuauuccaacaaggccacaacuccaaauggugccacucccugguccaagaauauacaaaccaucacauuccauucccuggccuccauagacuuguucaaacacaugagucuauagggggacauacuuaaacauagcauagugcaaaauucauuuaguccaacuuuuaaaguccucauagucuauagcagucucaacaguauuggaaguccaaaguucaagguuucuucugagauucauuuaaucacuuaacuguaauccccaaagaaagacaggaagccagcagggcaaacuccaaacucuguaucucccuggcugaugucaaagcggucuucagaucuccacuccuuuuucaucuuuguugacugcaacaaacugcuuucuccugggcugguuccacuccauguuagcagcuuuucucagcauguaucccauggcucuggcaucuuuaacaucguugagucuccaaggcaauuucauuguuacagcuucuuguuucagugucugggauuccacuugaucuuuugggcuccuccuaagggcuggcaucacuucuacagcucuguccucuguagcacucuaagcucagguugauccacuccacuacgguugcuguucuuggugaucaucccaugguacugacaucuccaauacacugggauguuccauucuaucuagacuucaccaauagccucucauaggcucucuucauggugccaagcuccaaauccuuugcaugacccuuucaguccugggccaucaacuacagcugaggcuauaccuucuccaauggccuuccaugacuucucacauugccaagccucagcuguucuucaugacaccuucaugccuucaaaaucaguaccaccugggugauucuuacauauuaccaaguccagcacgaggaacaaccuuggcuaucucuggaacacagcuucuuugugcucagagaaaacacuucccagaagauuucaccuuagugaugcuggucucuucuuaaucacugcuaauuucuuagcucuagcuaacuagcaucaauugucccaguaguuccuuccauucuuaacucuggagccagaaucacgugccugaagcugcggaguucugcugcuugcaggaacuagaacaugacccgcuuguacuauuacacugucacuggcuuucuguuuuccaaauccuucacugccuaagcuuggcuguucuggaucuugcucuguagauugaccuuaaacacagagaucagcaugccugucuccugggauuaaaggugugcgccaccaugccuggaucuaaauuuagcuggguaggaucuugccccaaggucccacucccuuaaucuguuauuucauagaacaaagcauuuuguuccauuucacuuccugauaugccuuuaauacucgaaccauauaguuuauauuuuuccuuucuaagcuugcuaugcuuguucaaacuucucuuugugaaacuuaaccagagaacaaagucacugcugggcuuuuuaaaacuucuuuugucaaugcaguuaaugcaauuaauccaagucucuucaccuuagucucaggcagacuuuucagacaagugcaaaaaguagccacauucuucaccaaaaauaccacaaaaacagucuuuauaccacauacugaaauu

SEQ ID NO: 17 - RNA, 21581 nt, Mus musculus
aaauacaauuuccauuaaccacuaaaaagaaaaaaaaaguucuuccaauuuagugggauaguacugaaccaaagaaaacauucuuauacauauuuccauaaguauauugaaaaacagaauuaaagggaaauaaaauagcuagucacaaacacucuaauuuuguauuacauccagugucaucauuuuaugugugaagacaaguauugcugugguugacuagguccaauugacuguaguguuccagugaccuauaccuguuaugcaaguguuuuuccuaugagcuauagucccagguuaccaaggcauccugauaauuguugugauuuauagauauaauccuucauuaagacugcauaugacuucccuucuuuggaaaaaaaagaagguagaucaauggaacaagauggccaguccugguauagaagcacagguacacagguggacaggugauaaauuccaaaggaguagcaaugccaaacaaucuugucuuccaaccuaauaagcucaacagauaugucauacuuucaagaaugaaaauaggcuacuauaaaaaguaacauuugugguauacaaugauccaaauauuauaccuaaaauuucuuuuuuuuuucuagaagaaaaauaguguauauucaguuucgcacaauguuucucagcuuuaaugcuuauucacugagaauaaguuuuuucaggacuagaaauguggcucagugacuaagaauacuugcuucccauguagaugaccgaaguuugguuccaagcaccaggugcucaaacacuucugauguacaggcacccagguuuacauguacauaacuacacauaggcacaaacuuacacaguaaaaaggaaucuucaaaggaagaaggucauuuguauauaguguagauaaaaauauuuuacuccuaacauauacuauuagaugaugacaacgagucaccuauagcagucuauguaaucccagagaguugcaggcaaccucaaacuuuagccacaaguaaggcaaagaguagaguguguguaugugugaguguaugucggggggggggaggcuagagagagguggagggaaagaggggagauuugugugauuaccaaagauagcauggagauaaaagaaaucacaagaaagaucacuaaucauuaggaagaugcaauuagaaauugaagacauugauauacuuacguggaaaaaauaaaaaaaaaacaaaacccaaaacuuuaaagcaccuuauccaagauuuccauagauguggaggaccugacucuaucacacaugauaguauagagaugaaaugcuaaaaccuuccauuuaacuuuuaaaagguaaacaaugaauuaauauaugauuuaaacauccaguuucuaaguggcauauuuccaugccugguugauccucacugggagagaauaauccugcuguaucuagaugucucagcguggggugguacccaaaggggacucccuuucuuggaagagaugggggauaaugaggauuuguaaggaaaugacuugaaagaggggagggagggugacugugaucaggauguuaagugaagauuucuaaacaaacaaacaaacaaacaaacaaauaaauaaauguuuaaaaaaaauaaaagguuuuuaccagaacaguuacaucaauuauaccuaucgggaugucaaauuggagaucaagauauuauuaauaauuaaaugauaaauaaauuuuaguauguucauacaguaucaucauuuuguuuugacuaugaaaacccucauagguucauguuguaguaggcuauggaagauuuugcaagguggggcucaccuggucaaaggaggccaccagcaacuggguuucauaugaauugugaucauguuuaccuacauugcaccucuuucuuuucccagcuaauaugcuucuaucuuucaaauagguuugugcaaguauuaugcagguagauacagcuguuacacguucaugauggagguaagacuguaauguuagagcccagaaacacauuguagcugcuaucuguucuuaguaugcugcuauucaagugguucucacuucauguccacaccacaauaaaaccugcuuuguucaucaugauagacugagacucucugaaaccaugagcuaaaauaaaguauuccuaacauauauuguuggucacaguauuuuagucacauuaauauaaaaggaauagcuguacaauacuauucagugagggauuaaaaucuagacauaucuuaaacaggaagagucucauaacuacaaaguagaaaggugucagagaaaaugaguaaaagagaaauuccauuuauaaccacuauugaaauugcagacaaccuuacugagucagaaaucagcucacugcuaaacugagaagacaaaaauggggugcauuggaaaauuaugaaaggacauaaaaaagaaagugaugaguauauuuauuauauagugguaauggauacauggauacacaugucaggaacagucaaauuauauacuaucaauauguggauaucauaggggaucuuaauaaaaaguauagagcuguagugauuuauguaaauguaauauauauauauauauauauauauauauauauauauucaaggugugggaagcaaauauacccaaaggcacauaucugacaacagcaacaccuucuuucuacugcaucaagaugaguagacagcauauucccaaggagaguucggugauuccaaaucacuguccuguagcugucaccgaagcuuuuccuagaauagagacauuuaagaacaaaauauaagguauaauagacaccaaauggacaaaauuuuaguaccagaaagagugaagauuaaucugguguuuuaugaaaggcuagacccuacauacaaauguuugguguuugcaucugaauccaaaauccuguguacuaucuucaguuacaggaguguccuuauuacacugaaacaguaauuuaggguucaggggauaguuaauaaucaagaauauuauuaacacuauggaaacuucaauaggcuaguauggcaugcaccuggaguucugguuaaucacucacuaaggguucaauuacaaaauuuaggagugauagauaauggguuuguaugccacucuucuauugauaaauuaagaccagacuaucugacacucauuuuuaguauaagcauaugcaucagucaugaaaucagaacucuacuuucccuauguguauuagaguauucaguuuacagagagaccgcaucugccugugaauagggaugucuaaucacuaauuuuuguaaauacaugguuuauaaaacuauguaaacucauuuuuuuucucaucaucuuacuuggcuccuuuucuauuaauguaccauuuguuaauuuguguguguguguguguguguguacuguggcccuacaaccugcagggauucaccauggcacuacaaccugcagggauucggucucucuguacauuuuauauggaaagaauugagcucuggcugucaggcuuauuggcaacucugcuuaccuguuuuccauaucaucaaucuuguauuuuuuuuaauccaucucuuccaggagauaaucuuuggagaaaaaaaguuuguuauaauuuguuguuuauuuguuuggggauuucuuuuuaaacucucggguuauucuuuacuuaucagcauaaugcaaugucuagguuagcuuaaucuggguuuggccauugugguuaacaauauauagaacccuuuaaagaguggucauguuccuaauaacuggaauguguuaauauccaucucauauaaaaacaaagaagcaagcaaaucaaaguaucuuuaaagaugugauuaagauaaggccuuugaaaauauuuuccuagacuagauauuccucagucuaauaagugauacacuuaguaagggagugaagaucaaauaaauggaagaaugguuacauagccauuugaggacaaagacacauauaggaacucuacugcuacaagcugaaaaacgucaagagccaucuauacuuagaaaggugagaaagauugaccagaaacuacaugccuauaauucuagcacccuaaagauugaggaagcagaguuauaaauuuaagaccagucugggauagacagcaugacccuguaauaaaauaaaguaguaaaaugaaaugaaaucaaagaaaaccaaaaggguauucuuuuguaaaauuguguggggcaugaucauuccaacacuuaauuucaguguccugaaugccaaacccauuacaguuuauacuucugcauuuggaagccacucaaggugaaagaauuggugguacaauauuuaguaaauuaauauugugugccugugugugugugaaugugugugugugugaacauauuggguucagugugggaaacauccucacuuaaauaaauaaacaacuguguaaguauuucaagagcacauuguaguauucaauugagaagaagcaaugauuauccaugucaacuugagaguugagaagugauaaguuuuauacaggaggucaaaaauauacauuuuucuagaucugaaggauaaaggugagugccagaaauggcuuaaugggaaccgaggagccugccaagcaugaaaaccuguuuccaguccccuucucuuggguaauaauuggcuaaguagugaaugccuucaaucccagcccuaggaagagcaugguuggacacaggaagaucucugagauagccagacacucuagcugauugaaaaaccuccaguauagugaaugaucccaucucaugaaacaacauggagagccauugaggaccucuggacuccacaagcacacacauggacaaaugagcacacacacacaaacauaaagaggagaaagagagggagagaagagagagagaaagagagagagagagagagagagagagagagagagagagagagagagagagagagagaauuauauuccugcaugcacuacauacauauuaauguugaauccauauuauccucaguuucuuuuccuaggaaaagaaguggaaagcccuaggcuauuuucaaggaaagaacacagacagaccuugaagagguuccugaucacuguacuuaaguuagauagaacaauguaacuaaauauacugcuauagagaaaagaaaagcuguauugcacugaaagagcacacuuggaucucacugggacagagaugcaaaugucaagcccuaacggguaaaacuugucugaagaauuaugaugagaagagaugaagacaaauaacagagaaacaaguagccccaaccuuuaggggacagcuagagaaaaaaauacacagccaaagauccuaagcaugggcaaucuugaauauguccaggcugccuaugauguaucuagaggaguuaggggucucuugaguguagguauuuguguacaaccaguggaagccuaaaaguagcaauauagaugaauugaucacaaagggaguaagaggaaauauugaaaacacuauggcacacauaauuuugaaacauuauauggaaaccaugaacuaucaacaagaaagagauaauuuaaauaggucuacaacaacagauuuuuaaaguuucgucuauugucacgaacuaucugcaaaagaauucucuaagcacugaaaaaaugcuagucaccauuuaaagaagugaaucaagagcuacaaauuuguuuccguaaaccaaagugggaaagagcaguuuuaugagauuauaccugauacaaaauccagguaaagacuuugcaaaauaugauugauggcaaaaggcauaagaggauauacuacacacaugauuacacacauaauuuugacagcuuacaugaaaaccauguaaaguuuugcaguaaaaaaaagaaaagugagaaaaguuuaauuguaauuuuuucugccuucccucugguauucccaaggaguguagaggugggaaacugggaugugcauuguauacgaaauuuaaucuuucuucuaugccaggaauagucauuauaaagaauuugguucuaggaacuguaaggaugaaaguguuuaccauuuuaucuccaaaauuuuaucuaacugcagccaagaugucuuuaggauaauuguaugcaguguguguguguguguguguguguguguguguguguguguguguguggugaguuuaggguuuacaggugagaaggagugacacuguaucacuauugaacuuugaacucuggaucacccaaacuccauuauggaguccugggauucagauaaaugccaccuuuccuggcuuuaugaaggucuaucccaggcauguuaagucaguauuucugacuacauagauuuccaaaaugcuccugcauauuguggucacacagcaauguuuauucagacccacuacugaagaagauucaucuuccuguuuuucacaucacagaugaauaucucuucacugguauuucuacugaacauucuuuacuuuuguccagucuagaugucaaaaucgcugcucuuucaaaacacacaucaaaacaaugacuacguuauugcuugauuucuuuuuuuuuucuuuuuuauguuuuuccuugucauuucccuuuucccauuuaucauaugucuuucugcauucuauuucaggcaaagaccuaaacuauaguugcaauaggagugucaaaugacuugccuacucagaacaccaccaccauuuuuuuuaucacuagcuccauucuaaauucuguaccaagguaagcauuuaggagacacccugaacccuaguacucucuguguaucaguugaacaaguugugaguuuguacagaacaaagcugaacaauaugggugaguguagcuaccauuaaaaagaaacaagcuugaguuccacaccauagagaagaugcaaauaugauaggucagaggcuggucccuccuccucccucaaauuguggaaugcaguuuucugucccugauuccuauuuuuguaacaaaaaugguacuuaacugcaguacuucugaugcaauauuucucuacaagacugaucuaaaugaaaaauuuaaaacuaagccuaacacugcucaaaaauauuugcugaaaauauuaaaaucaguuuucuguuucaguuuuuggccugaaaaggcauguggggcccauuugggggcuucaagagaaaggucacugccuauguagacaagaaagagccaggaaaaauucacguuucauccaaggacccugcccugagagcauguguaguauccucaggaggcuccaggaugaccccuccuuccucagcucucuauggaagccagugccagaagaggccucuucagaggagucugccaagaacagccuauuccacagcuguauaaucuguuccauauuacagucugaggaaacccauuggaaaaaaauguccuuuccaaaagaucugaagacauaaugucuccauuuucuauuucugaaucucuucuugaaucuuuucugggagccauuaauguaaguuuccugcauuuucgucuuaaauucuaguguaguaucuuauuuucuaucuccucuuaaacugaauguaaagauaacccccaagucuaaauuauucccaacauucuuagaacucuagucccaauaucccuuggauuuagaguagucauggacaacaccccaguacugguuuauuuuccuuuacuuaauguuacuucccuuucauuccuuuuuauguaaugucuguccagucucuauaggaguaagcaauauauuguguagcuaucaacucccaagcuuucaugcuaaaugugcucucugcuuaaagucugugcucugugauuaaacauuaucccaaauucucuuccuucucucuauaauaguguguugaucuucuucagaaggauuucuuugaauagaugaaaccauuaucuguaggggugcuuuggaucucugagguuaagcagcaccacaguuuauacugggcuccuuuuaaguugaacauuaauuccguggcuugaauucuugaagcacuaucuaugagugugguccuaaucuauagucucugguucagcauuaagcaacuuucuuaucuguaggaaugugucuagugagcuucaguagggguucugccuacuaucaugcuaacagcuucuucagcuugaguuccagcuaggaauucaacuauauagcucaucuuauucaguagcugaugcccagguagcucucuggucccaucucugguauccucccugaacaaaaaacaacuucaagauugucagccccauacuugugacuuguuuucaugaauccauugaguacaagaugguaaauacacuguauauauaaacauagugaucuagugcagaaaauucuucaaacucaacccacuugcagaaaaacaguuccaauuaaugagcaucagagaacuagagcacuuuuagcccaaacacauaaaaucucaaauauauacaaucugaaacuuuuuccaggauaugcaggaugucacaagugaaaaauuccacaucagagcucgcggaguagaucacaacugagagaaaguguugccuucaaaaaugucaauaagaagcaaacuaauaacacgucuaggcuggaguuuaaaacaaguuauuguacaugugcaaauauucucaaaucuggaaaacucugaaucgcuucuugccauaacuauucuggguaaaagauagcuguuauaucuaaacaaacauauuuuagaaccuaggaaugccaacaugauaucuuaaaucuguccgcuuuaagugaugagaagggcuaaggaauuccauuauuucagaacaagaaagaugaucaaaucuaaggacuucuggcuuuggaagcuucaacaauggucauuguauaaaggagaguuugaggaaauaucagcuuuagaugaccucucgaucuaccuuuuuauuuuuggacaccaauauguugcaucuuauucaugagagacuguuagguaucgaaaagagcugcauuuaaaauauauugggaaagauuuggaugugcucccaacauggaauuagucauuugugaaugacauaauuuaagaaguagaagauuucuuauaaacgcagaagaugcagugagcagggcaaaaagguagugggaaaauaugaaaaauacacugucauaaaauguguauuaauaaauauguugaucauuuuccacuagaaucuuaacggaagcuuuagaugaaaacaaagugaccuaauagaaauggagagcccaaaucuauaguuauuaaaauaauucaaaaccaacaaacugagcauccaaugaugaaugaaugcauauauauauauuuuauauaucccucauuuucauguggggccugggggauuuaaauucugguucucaugcuugaacugcaaaagcucuuaaccacugaaccaagucucauuuuaauuaaaauuuuaaacucccaucaauuaugcuauaugaaucuacuacuucuagaacauucaaaucucacauggauuuaucuccagugucuguaacuacacuuuacauucuuccuuguuugaucugcauucagauauguaagaauuuaucucuauuaauaauuucucaauauuccaaucuuaaacaacucaucaucaucauaagguacagcuuuccaaaagaaaaaagaaaaaaaagucauuucuguuucucuuauucuuuuguagaaaaaccaaaaucaagaauuaagucuuucuccaggaccuucacauuuaauuugauuuugcacaaacucaguguguccgaacuuaacuucaccaucucagcuacaucuuucuccuucaacuuguuucuuucccuaccaucaucuaguucugugccauacaggagaccaggaaaucuuuuacauaagccuagugguacccucccuuagaccccagugguugggcuuugcugcuucgcuccuuuccagcccuaccacccuucuggcuucccaacacgcaugcgcaauaucgcaucagccccgcccgcccgcugcugcggaaggcgcagugcucaguaaagcgcacuuccucugcuggucuccaccgagggagugcccgcuccaagagcuccaagccgcaucgguccugcucugauccgaaggcgcagacaugucggaacaaaguaaggaccugagcgacccuaacuuugcagccgagguccccgacugugagaugcaggacagcgaugccguuccgguggggaucccuccucccgcuucucuggccgcuaaccucgcagggccaccgugcgcucccgaaggcccuauggcagcccaacaggccucgccaccgcccgaagaacggauagaagauguugacccuaaaauccugcagcaggccgcagaggagggccgcgcccaccagccccagaguccagcccggccgaucccagcaccgccagccccugcccagcuggugcagaaggcgcacgagcucaugugguacguguuggugaaggaccagaagaggaugguccucugguuuccagacauggugaaagaggucaugggcagcuacaagaaauggugcagaagcauccucaggcgcaccagcgucauccucgccagaguguucgggcugcaccugaggcugaccaaucuccacaccauggaguuugcccuggucaaagcccucagcccagaggagcuagacaggguggcgcucaacaaccguaugcccaugacaggccuccugcucaugauccugagccucaucuaugugaagggccgcggggccagagagggugcggucuggaaugugcugcgcauccuggggcugaggcccuggaagaagcacuccaccuucggagacgugaggaagauaaucaccgaggaguucguccagcagaauuaccugaaguaccagcgugugccccacaucgagccucccgaguacgaguucuucuggggguccagagcuaaccgugaaaucaccaagaugcagaucauggaguuccuggccagagucuucaagaaagauccccaggcguggccuucccgauacagggaggcucuggagcaggccagagcucugcgggaggcuaaucuugcugcccaggccccccgcagcagugucucugaggacuaaaaagguccaggggcacacugauaguuucugacccauacuagggcuguguaagggugggguugagucauuagaguaucccaaauccacagugcaguauuucauguauaauuuuuaaguuuuccauacagugcuuuuguaccuuguaaugcuauucauuuguguacucguguaguguuuaagauugaugcaugugugauaaguauuugguacuuucacuuuugugcuuucgugcauuuuuguacaagagaugugcugugcuaaacuugugaaauacauugagguguucuguaucuuguucuuuguaugggacugaugaucuguaucgacaaagaaggcccuggagaguuagcaggacuuaacagcaacgcagaccugagcaagagaaaggucaaggccuuucuccauaugacuucaacuggcacaggaagcauccauguggaauggacugauuugaacuggacuguucucaguguaggcacuuagcacccuuuacaaaacauguaugcaaccccaccauaaauaaacguuaaaaugagcauuaaagauacugugaaauaauuucuuggggggggggaggaggcauuuauuuuugaugaaagggggagugggaauggguggggaugagaaagauucucccugugugcagcauaagcaaacacgguguccuaacacagugggagaccacacgaccacucagaagaaacuugcagugcuuuaaucaauuugucacauaaaagguauaacaacaacaacaaaaaagcucauuaucacauaacauggggauaauaacagguauauggagggccugccccuuuucuguugcauuuuuuaaaauagucuuugauggacacuuuagcagaauaaacccuuaucaugcauuuucuucuuuauuuuguccucccaccagccauaagaaguaaggaauaacuguaucaucacagagcaagaaaaaauaaaagggguguugguaaugaacuauccuaaaaccuuuauacaggagucuugacaccaagcuccccauggccaccacucacacacgcacucuggccucccugcuguaugcauuaaggguuugauuuuucuaauuaauuccaagaguuucacagaaaauuagcuucugaauguacaaauuaggaaacucguuucagaaagaauugaugaccuaaucaaguccuuaucuugcuaagggguaaaaacaagaucugaaauuucaucuuuccagaaggaugaagaugagcgaaacuauucugacagucguaccaguaagagccauggcacuaaugaaauagaggagggguugggauuaaggagcugcccccagaagcauagucacauuugccacucagcagucaguauguugcagugggcaguaggugaagagagggugaaaugggaugagaaucacuguaaacagcaacaacugggguaaaaaucuccuuagaaagcuuuuggucuggggagaaagagagacacgaggcuuuaaugagauuagaaauccuuuagaauuugugguaaaagucauuuaguaaaagcuaaaaaguaauuuccccccugggaaaggugaauaaggggagauaccugucacaccauaccgaguaaagaguaaacgaggaguccuauuaauaugaaagagaugcaaccaguguguugacgugcagaacugccgacauuuaguggcauuaccuagcuuguaaugcagggaauuaaaaggcuuauaauccaugugucuguuaaaacggaacucaucauauuuaguugugcccauagucuuucacuggagugagaauggaaagugggaagauacugacuguaaccccaaugugagugacccggcuuucagcagacuucauaaagagcugaugcuagcuggcacaccuauuuaagacguuuaggguuuuucugcuguaagaauauugaaucugcuuugcauggaucugcuuggcaaagucuguucugcagauugcaguuuugcagaccuacguaaaacagauucgagaucacugacacuggcaucccggccaagcauucgcugaggaauaggagagugagaaacaaggcgcugauuacugacaggcccaagagcagggcugcucuccaacugcguugucuuggagacagcuugccauagaggaggaagcuuugcagauauggaggguuuaauucauggugucugguucaguagacaccacaaccugcggacaaaggggggaauuacucaauaacuuucuuauauuuucauauuggccuaaaaauuaaaaaaaaauaggagaguacaccaaguauuuuggaaaagaugcuuaaauagaccaaucaggaaacauuuagcagacucaguuugugaguccauagcuaugaugauuugauacucuaccugggagagauuucccugauuauuuuuaucuaccaacaguaacuucauuuuuaccuugauauuuuacucuuauagcucagaacuauuuguuccuuuuaauuuuuauuuuucaauuaaaauuuacuuuauguuaauauguuuaauugaaauagaauuacaucacucccuaaucccuuuccuccauccaguuacucccagcuaucucacauuaauauuuucuguuauuucacauuuuucacuuuaauugacuucauuuuuaaagucaccuaagguggagagagccucuagaguuuaaauauaaacuauaauaucuacuuuaagcugaccucagagaaaaauaugguucugaguuaugauuaaauaagaaaugguuauuuaaaaugaaccaguaaaguuauaucuuuccuauauauccuaguauucuuaccacuaccauaauauugcauaaccaacauaggaagcccuaccagguacuguuuauagcauccauauuuaaaugcccacucagaauacauauggcauuuauaaauaagugcacuuuguuaaacucuugugaauuguuagauacaugaaggcagagucauaucugaaaacugcccaucauguaacuaaagucucuuuacuaugggccugucccauggauguucuuggaaaauaaauggagcauucuuugcucuuuuuuccucucauuuaaauuuuauuuuucuaauauaauauauccugaucacauuucucccucccucugcucaucccagcuccacccaccuccucauccuccccgauucacccaguuucugucucucacuaaaaaucaaacgggcuucuaugagauaaugauauaauauaguaagauaaaacaaaaacuagcacaucagaauaggacaguacaaucagaaagaagggaacauccaaaggaggaagggcauagacacaagaaaaagauauaguuacagagacccgcucauuugcauacucagguauccuacaaaaauacaaaacuaaaaguuauaacauauacacaaaggaccugaaaacucaaaauauuaaaaaaaauaauaucuucauaaaaggaaaggaaaaacaaaaacagcaaucacauucaacuagccugaaacauagaaacgugguagcaguacaaggaaagaaaugaaugcagaaaauauuggaaacaggagcaagaaccagguuuuuuuuuaaagcucaauaauaugaaucaguuacuaauaguuccagggguucuuaaagaacaaauaauacaaauuaacaacuucuuucuggguaaacggaucgugaaaacaaguagccagacggggcuggagggaggaaagaaaggaaugauaauucuauuuuaauuaaaauaguaauauaauuuuaauaaaaaacauaaagggggccugcucauuucaaaaaggaaauggagaaggaauggaucuggggaagaagggggaugcuugagacugggggaagagaagggagaugaggcuguggucaguuuacauccucugagagaagaauacauaaaauacaauaagacauucauaaaaaauuaaaaagaacaaaagcaagucaguacuguuggaauaaaauaucaauugagaaaaugaagaaaaaagccaauuuaagaaauuaagauauauuuuauacaauaagugauuaaauauauaauaaaagugaaugcauaauccauuccauuacuaguuaauuaaagucggcaaccacaugcccuucucuaguuggacauaugcuacauguugccuucuauacccauuagaaugcauguugagaguccaguguucagaagaugaugugcugggaguuaaggauuuaacaauaaacagaaugaucauugugcagucaaaacguauuaauuaggugaauaacaagaaucacccuucagcacaaagaaugccacacuagaaacaauaugaggauagagggagacaaacagaugcauaaaacacagguuuuccaaaagaaguguuguauaaauuugcauguguauuuaaagggugauuaacaacuuaaaagugauacugggaaggguuuauuugacaggaggaucucuuugugcuuaagggcuguacuaagaaagcaaacagacuugugauacuacauauuaucuugaaauaaaggaaaauagaaaguaaauuccauuucaacuuguccaaaaauauuuuuaggcucuuaauuuccucuguuauagacacuuuugccaaauuauuuucccaguaacuuacuaugagaagauauuacagcuuuugggauuugacguaugcauuuauucauuugguuaauaaaacauugaacuucacuguaugguuaacuuguaggaacuuggagacacugauaaauuagaaacguggcuucagcgaguguauaauauaugcuguauuuauaaaaagaauugucagaaacugucuugugauuagcucaacagccuagguaucugugguugaagugauucuaauguuauucaguaaugucucccaaaguaaaauuucaaugaaaccaaugacuguuucauagcauacugguccguguuuuugccuuuggaaguugagugauagaggaugaggugagaaaugagcaacaggugcugacuuggguuucaagcuuuaauacagguuaaaggucagcuuuaguugaugagaccggaacaggauaggggagaacaagugugaaggaaaaauagcaguuucuauguugaaaaucuauuaaauauacuaaaagauagaagaauuauacaauaaacauaucuagcucaagggagaauauuauaguucagcagcagagaaaugccuuuaucuacagaaacucugaaaaaaaaauguguccaugcuuguacucugaaaaccugaagcauuuccucaucaaguucugcaggaaugucuggcaaugacacuacaaagagugccuggauaagaguucaaaaagaaagccagcagaguacaaggucaugaaaucaaaauagcaacauuuucagagagaggaagugcccaaggguaucaaaugcucuugaaguaucuuaaacaauuuggaaagggauuuugcauucaauaggauccucgguguuuaaagaagaaaguuuagacacauauuacaugguuggcaauaacucugauaagucaggugagcaagaauugaggauuuaaccaggaaauaaauaaugaggaugggaauaaaugaagaaaauuugaaaauaucuauagaucagguugacaaaaggcaaugauuaaguaagugcuagagauaagauucguaggaugaauggaggacugugggcagcuuccuggcaugcugggcuucuugaguaucagucguuuauuuaggaaguaaacacagcagacucaugugggaggaugauaaaucccauugaaaagaaguugauucugacaugagugugagauacacaaacagagaugugaauuugacugaguagaaauucacaagagaaaacauugaaguguggaauagaguccaaugaacucaugagugaggagacugcugagagauagugcugggauuugggaagguaaacugugcuguucccaugcaguuugggcaggaaaugcaaucugcugcucauuugcagacacuaucaucagauaugcaugguacuucuuccuucuaaagauaugugugggaaacuuuuaaacaucagauaugccuguucccucuuccuacuaaagauaugcuugggaaaguuagagagaggaagagagaagggauggaggaaggaagauggugggggcggagggaaagcaaugaaucuuggaguuagagacagaacacucaaaaaguaucaagaaaauauaaagucuagugaaaucuagagaauuugguuuagugauguuguacaaaucacaggggucauggggaggguaugccucgggucugaaguaaugaaaaagcagaaaagugucuacugaaauuauuuauauaaaaaacuauuuuaaaacuguuaaacaaaucaccaaaagucugauuccaccaaaagcugaguuuuagcaaagugauaauugauaauuguacacaagcagguugaagauugaagauugcgagaagcauaaagcagaugaagugacaaucaguauaagcagggugacaagccuuaaguggaauugggaaugcaugugguguauagaugagacaggucgauaaaaaugauugauaguugcaugccuauuugugucugugacaaacguugauggugugauauucuuagaaggcagcaggagguaauuuacuaaacacugauccaaaugaguuaaucucugcagucugucauggcaaaguccaguuguuauuagagauuuuaacuuacuaauauauaaaaagaauaauacaauucugucguguuuuuuuucauuuauuccaggauugcaauauuuaaaaaugaacugccauaacucaccauauuaauagucagaaaaagaaaauauauaagaucguaucaauucgcacagaaaagauauuugagaaaguuuauuaauacugcuauuuuuuuaaaaugucaguaaauuagaguuggaaagaaacaucaguaaaauuaauucuuuguuuguaaugguuucauauuucuuccauacuagagaugcauucgaugagauggaucgcaagacugguauuggaaauccagcuaacauuuccagcuugugaagucauggucauuggagaagaauaaauaaccacuaguuuaauagaucagcauaaucccuaauaaaauucuauaagcauuuguccuuauaccuacaaagaaguuagcccuuaccucucaucaaggaaaguugucuuugcaauagacagagaccacuauagaaaaugauaagcaaucaaagugcagaauuguggccacuaguucuaaugaauauaccuacaaaauacucuguggcacuuaagucuccugaaacauuucagaagaggaucagagugggcuuuguuuguuuguuuguuuguuuguuuugugcuauugugucucauaguaacaucagaaaauagacccauaaacucucagcaguaugaccacauuaacaugagcugcacaaauaugauaucaaaauguacgcuagacugaacaaggaaaaacauggaaggccuuucacuauacaaauaugggcagccaagcaaagcuggaaauggaagauguaguccuccccaggaacaggacaacaaauggcaacccagugccaaaugaccagccuucaaaacauauuaaaaguaacaccauaugcacucaacaggcuauacuuaggaauauguuuguauuuuuaaaacauauauccaugcaauaaaaauuaaugaaaaaagagggcaugaauuaggagagcagauaaugauuuaugggguauauugaagggacagggggaaaaaagaaagagucccaaagaaaguaaaaaggagugacaguauacaguauuguguuuccaguacuggcuuacguaauuuaacacgagcccauucaauuuaauguaugucucagcaaaacugauacaauuucuuuuugggcuaauaauacuuuacacuguucauaaaccacagaucuuuauccaaaauguaucuugacuuuuuaguugauuucauauguuuguuauuuugaaccgcacugcaauaacugugggggcgaaggugucucuuugauaaaccuaucucauuuccuuuggcucuauacccagcagagggguuacuagaucaucuuucccaacacaaagaaaugauaaauguuugacaagaucgaaaugcuaauuacccugauuugaucauuacacacuguacacacacgucaaaugaucauacuaaaucaauauuuagaaaugucacguaucaauuaaaauuaaaaagaaaugaaacaacagccucgugaaguuuaucuugaaagcacuauaauuaguauugcuucauauuuaauagugaaugcuagaaugauuuauuuuuucaauuuuuuauuagauauuuucuucauuuacauuuccaaugcuauccuaaaguccucuauacccuccccccugcccugcuccccuacccacacacucccacuucuuggcccugguguuccccuguacuggggcauauaaaguuugcacgaccaaggggccucucugauagaaugauuucugcuaagauuggaugugaaggaaaaguauccacuuuuauuccucauucuuccuuuucaacuuagcagcaaaauucuucucuagagaugauaagguagguaaaaaagaaaucgauccuuauuuacauauuaugauaugauugucucaaguaacccuacaaaaccagaagugaaauauuccuagaauaauaaaaguguuuaguaauaacaccaaauucaagauuaaugggcaaauuucuacuuucaagcaacaacaguaaacagacauguaaaacccaguacaauuuauccuagcucggaaacguuuuaauauauaucaaacuaaguguggucuggaucuguauauugaaaagcacauaaagcacuagaaaauguccaagaagacaaagagaaaugucaugauuauaaaucagaacagaauaaagagacaaaucaaauuauaggauuagugcaauuccuauaaaaaucaaaugucuauauuuuuccuacuuuugguaccaaaaacucucacuuucuggguagugauugugaaauauaaaaaucaaauagcgugugaucuaugaguaaauauguuuaggguuacuaaaccuauucacaaucuuaaaacagcucaagggcaucuauggucaaacuuguagagaaaguuuguuuucucaagccucugugacuguuuuccccugaccauugguaacacaaugaugaacauccugaaaaccuggaccaucuaucauuguacaaucacaacucuugugacuuauuuuuucaauuaugaaguguucugaccaugagcaguaaucagaaaguccuuuaccgguagauuugcuguucugcuuuuuaucaauuuagugcuacuucacauuuuaacauuaugaguacuggccaugguuuucgggaacucuaauagagaaaacaagaacaacaauaaugugaaagcuagcauagucugguaggcuaaauuauggugcuauuuuaaugguuucuagagggaacauauaaauggaugagauugguaaguaaacaagagagaacauugugugcagcagaggaaaagcauuucugauugagcauaauggagaaagcaaagcaaucucaaugccuuuccagggcugaacagcaauauacugaggccaggugguuuacacaaaauccaucucuucauaaugaaggcugaagcacaucaccuagguaacagcaguauuguuucuuucugaaaaguauaggagaaagcgcucacuugaguacaccuuuggcuugcagguggaugcccucuggacucuguauguuucugcagcuuuccacaauaagaaaacuaaaucucacaggguuagcauaaaacaugcauguaaaaaugcucgucagugucuguggggcauuguucuaggacaacugaagagacacaauccuuccaguacuuuaagaaacacugugaccauguuuacauguaauuauuacacauucacauacuucaucauuucuccaugauuuuuuugcaccuaauaaacuuaaccauccagaaaagaguuaauguguguguuguuuaggaaauaacaagaaaaaaauguccccacauguauaguauagacauuuuucauauuuuuuuaaucugugaauggaugacauuaaucgaguaaccacaggggcugaggucugacuaucaucugaauguauuaaauguuucuauuugucucccaagaacaucccaguauuuauuuaaaaauuacagaagcuagauuacuuaaguaacauggauaaacaagcacauauacaccucuaauuuaaaaaaaaauaaaaacugggaaaaauuacaucuccugacucauaauuuauaacuaauauccucugggcaaaaaauagcaacuguggauagcagaugcauucgugugcagcugauucugcuaggucuauucaucaaucaugcuuguuauuauauaucaagggaugcaucaaauaggaaacaaaacacguauuuccaccuaccucugagucacuuuaauuuaaaaaaauagaauuuccaauuaucuucuuguuuuuuaugaaaauuuuaauuaagucucagaaaauc

SEQ ID NO: 18 - RNA, 22615 nt, Mus musculus
accagaagaaaggccugcuuuugccuggccaggguuccuggagguggacuuuugcuccuaagucauucauagagacagcucaagguccagagggucuugauuccaaaagaagcacuguguagaguuucucggagugacaaaggagcccaaacccccucccuacucacuccuggauacggcagucccuuccugcaucgcugaggcucugagaccugcaaauaucccuuuucuucugaacuugagugugcagagcuuuacaacccccauuuaaggccuaccugaacccugaggcuuucuagguauggcaauaccuagacuauggguccuuccagccaucugaguuuucuuccagggcacugugauugucuucucuuaagcagaagcuagcccauccuucucaucccauugugggucuggaccaugauggucacagccaucuuacaacacggcugguuuuuuguuuguuuguuuguuugguuggguuuuuucucuucccaguauagagcacccagaaugugccagagguacuugugaaagugugugaacaagaguuuggaaguauauucgaggagagugccccugaggccugaggccugggagcuuugaagguaguuguuagaaagaucuggaagccggacuagcauuacacccgccgcucuauauucccuugucuucuccaguuucagugucucugaggcaaaucuguaucuccuuucuggggacuuccuugacugacagcagaguguaguaauggaacaguuccuuugccuguuccuguccuggguucaacaggacaggaauggaggaaacucucuuuucuacuguccccucauuaucacagggccccagaaguagaaguaggaccaugcguguuuccugaagcuggaaagagaggucuggaauugggggcuuggcguuagaacgugagaagcuggcuggaagagagcaccuugaaaccaugguuccccaggaagguuucauguacuagggaaagcgggacuccucuccacaguaagguuaguagacuuggcauguucucccuggucucagaagcucccggucgccucucccacagaggccacggagucaaggacagcaauguagggcuacacucacgaugcugaggggcacuccugcccugccuaaguuugcaccgugacccacuguuuguccaggggucgggucuuuguccuguuugaguucugcggucagugcccuagaacuuuacccuuuacauuccuguuuacauuuccugacuagggagggacugugggcuggguuucugcugauccgagcagugggaccauuuuaccuucuagaaaguuccuccucuuuuuuucuaaugcuccauagcugguccuaggaacuaucuuuugguugcccuaugaagcuuagggaccacugguuaccuguaccagugucagaugucagaggaugguuggaccuauagacaguuuccucuucuguagaggagagggaaaacucagugagguacaugguggagcugguaugccagacuuaucucuuaagucccuuuuauuagaggccuauccacuguguccaguauuccaauuugccuugccucuauguucugguggugggaauccaacauccagaacacccucuuacuggcacagaaggcugccauacccuaaguucucaucuacagaguuucuguggugucccuagcuagugcacucucccauggcaccccagguaaacuuauggaaaucuuugugaauggagaugccccaucuggaauggaagucucaaagccaagagguacagagcagccaggccacaccaaguggcuuugccugcaugggcuacauacguaacaacaguuguuaacuaggucauguuguacuaugggagcugccugaucuugccuggacacuaaguuuuaaaguuuaaaaauaggaucaggauaugacucaguugauagaaugcuugccuagcaggcaccaagucuugaauucaauccuugguucuacgcaaacaagauauggaggacaugccuagcacuugggagguagaagcaggacgaauaggaguucaagguuaucuucagcuaccuagugaguuuugaaggcuacaugagauugucucacaaaaucaaaauaagcaaauaagaacacaucugugcuaguggaguaggaaggugagggcuucuggagcuaaagaaaaauaaaaccaggaaacauggcucauguucuauggacuggugacugucagggcucaucaacugaagguuagggcuggugggaagcaugcgaccuuucugacacagucucuuuuucuggaacuuuucccagaggcacccuguuuaccccuuuccuauuuucugcaacuuuccugcauggaauggggacacugcccuuaaagaacaauggugaccuccugccacuguuuagccuccuucccuggcuccaggggaggcuaagaguccucacacccauucccaccuccaugaauaagagccuugccugcacccacugagugcuaugggagucuggguucuguagacucugcugccauuuugaaagugccacccuaguaaaaggaggaugguuuuuucucucuggaaguggggaccucaaguuucaucauaaggaacaccuacuuguuaacaacacgagccaccagcaugcugcauauucaaggcaguccauuucugagcuauucauugguguacccagauuaggguuuggaagcugucacagaucccaucaggcacaugugaacaugcacacaugcacccuucuuaagacaccagaaagucacuggccauagaguugaggcaucagauauagauaaggcauguguuaugggacucacaggccuguaugaaaggggcacacagacucccuguuucauagggguaccuaaaucccugcuugcuagucucuuucuagggcccaccuaggcuuccacaaggagccucagugagaugaguugggagcacuaccagcuggguaagagaucuuggaggacuucucucuuggaggacuacccuuccaugccuagugaggucagguggauagagaugggggggucuucuuccagccccacacccuuuugguuacacaacaaagguacccugaggccauaucuagguagguggggggcauaaggucugaagucccuuuuccaggagaguucaccaguuccccggaccccuucaugagcauguacccuugacuugagcaucauguaaacgcuuaaucuaauuaucuuggcucuuucuaugccugucaaguuuuggcccacauaucucuagcacugccccccugcccugaucuuguauagguuggcagucccuuggcuagggcuuugccuacccaaaucucagaccacauucugucauaguuaggcaguuggaugauggcaccucauaauggugaaggacgauacuugggacuuucaggcaucaagggaaaauauagaaagcuaggagagcugacagccucguguggggacugcucuguagcugcacaaccccccgcuccugcagguacaaacacguaggagggggaggccaggguugcacaaagcccuacagccuggccuugacucccacgccccccucagcccccucuggccccuugcccacugggaaaacagcuuuuuaucucagcugcuucucaugaacugcaaacagccacguggcccauggggcccccucuuggcacacauguacucugccccacgacccgagggagagggaggccauucacccucuagcaggggacacugcugacucuggugaggggagggguucaugcagggcagagccagguuaacagcucucacaaacagagaccacuccacagggcggggaaagggagggggagugaaaggacaguuguauccaaggcccgcuccuggggaagggcuguuggaacagaaaggcagccaaugggaguugggauuuagugaccauugguagguuccuuccuacuagccccagagggcucucccucccaguuugucagcucagucucccucugugccuuugggccucauugcuccccuccauuuugccuuucugcucucacucagaugugcugugacccuuuaagggcucguggguauuggcucacuggugaugaaguccacuggacaugggacuauggaggaggcaggacagaggauaccuggaucuucuccuucccaucucucuuaccccuuagccaguagggcuguucuggccuaaagaucccacugcuucagggaagcccagucuauauuuaccuccuuaugaaaguauccuagcuucagguaagccaggauucuuggcccaaguggacucaucccauucuggucccagaagauuccugggaaaggagcagcaaagcagaaccccaacggggagcucccacaauggugguggcagugggaguggcauagcuaacaaaggcgaagcuagccugaucagcuguccugggcugcuggcucugcagaaaacguaccuacuccugguguuagccaccacuuugggaacuguagcucucuagaggaggagagcccccccucccccgucaccauuauccaaguggacacugggaaucgaaaacuucaacuccucucuguagcugggguucggugggccuauuaaucuguaggagggauaagcaggguucuggucauacauggacuccagagucugacaccaggcaccauaacccuuucccaaagagcaugcccuacucugaggggaaugacaaggccaggugggcagggaugguugucacaauggcucuugggaugauuuuucugacaaguggccccucuacaagaacuuagggucagagaaggcaagucuacauggcuggccccugugagagagaccccagagucccuuuaggguucucgcccagccucuguucugugcuguacuuuuggcuccauaaccacaugcacagacugcaggccucugugaccccagggccucaagcuccuuuccagagggagagggagguagggccugcauacccucuggccagggaugccuggagggaaagaacugucccaggaccucugaggugggugaaagagcaggaggcaccaggauguaaugauacagccaccacccccaagacccuaacagugggccaguguguggaacgagugaggugggggcccaggcggggucgcggucccgcuccauaaacccuggccagccaggaagcugcagacauggugguguugacacaggagugaagucaccaguagccaauggggaacuuauugagggcuuuguguacaccucccuuagucccaugggcucuggcacgcaugcgcacaaccugaaugccaccugaauaaaccagucuuucccagccuuucauggggccccacuguucccccaggccccgucccucacagcacuacccugagaggucaggcucggauugauguuuuaagucuguuuuuccucagaugcauggacucuagagucuaacaccaggcacucuaagccuacuagucacucucuaguccucuguggcacuauaugccauggucccuccaggaaucuucuuucaucugucacccgguccuggucuacccucagagcuagcuccacacuccgucaagugcucugagcaugcccagggagguuccccugcucuuaggccgcucaccauccuuuguuucauuucuccccucagaaagacuagaguccagguuucaucauuuaaucccuucuccuagauggggugcccacaagaccccgacucuaugauagcucugccucuuucccuaacucaaagugaaggguuuuaccaaucccuuucucucccuuaccgugaugccucucucaugugagaucccugggccuucccauucagguaaaaaauuuucugcagagccagggucccaggggugaccucuucauggaccuguucccagccuuucccuggggucugcagggugucuuuuccuuggggacuucccuuuugcaccuauagcuguuuuugggguuuggcauggguucaucucagaggugucacacggaggguggggguagagccuccuguacuuggcgccugggcuuguuuauggguccagccccugccucgccucgccucgcacugcuccccauggcccggcuacccaccugcugucuugccagguguggggugauggagcugggcucccugaggacaaggagcacagugucugcuuuauuugcaggcucgcguugacaaggaacagaauacccagugacugcuuccaggaaacggcugcgggcgggugggagccugagggagagcaggccccuucccagcaagccuuugcaggugggcuuccaggaagggcccccgccggcuccccucagcccuggaaaggggccaacaaugucaccaggagaggggggaggaggagaaaagagaggagaggagaggugagggauggaaaggaaaggaaagaggguggguagcucugcugagccagcauggcuacaacagcaugagggaaggccagagcugaccacaacuccuuccagaaccuucucuuccccuuucuggagauucacacauucuuagagaaggcccuaguuccucaugggacacauacucaugcacucaugugugugugcgcacacacacgcacacacgcacaaacaugcacacacaugcaugugcaugcauacacaugugcacauacacacacuugugcacccaugcaaacaauaaguauuccguggagaggcugggaucaugcuggaaggggacagacagucuuugagcccagucucugguucuggucagaugcuggugugcacagcugaagaggacaacacucccagcuuucuaguuccuuuggaaaggagacccuccucuugcaguguagauagugggaggccaaccucugcagucucaugcuacguuguuugagauucugcaggguguacuacagucaagccugcagcccccggggccucagaggccuccuucccugcacaguauuggaauguucucuacucagugggauagcaaauaucuugacugcugucccucccccauguccacgauuccugccuaaaacgugcucuuggguuacucaguucaaccugagacaugaaaccacagacgcccaacgcagucagcucaaggguacacuuuccuggaggccaugaccacauacacccccgcagaaaaauccugaaaaaggacagaccccugccucagccucagcuucagccucagcaccagccacuggccaacuggucagcacacagauccuaccacagauagaccaggguauauaggugaggccauguggcccucacacacacagacauacucgcccacagcauaugcguccucagggacaagcccugaguuauuacuguggccacaccaccacgugugauaagggcucucuaaugggcuacuccagucuuuguccaaccuuaacuugucacugaaacauagcuggggagggguuugggugugugaggacccccguaguucugugccugcaggguggggguugugcuggggacccugggccccaugaagauuugaaacaucucccaggcugugcagcguggagcagccagccccuccccacccuccccacaacccacccuggcugggguuuggggaugaaauucaagccccuguuagcuucuccgcacaaggaggggggagguugaaagugccuuuggguggcaggcuuggagccugucuagcagcccucucuaagccccuuuucuaaaaagcaggaaaucggguugggcuaaagguaaacacauuccaaacugggcugauggaggggcugugcuggcuggaggguggggggcugggccaccucuguuuucccagccccuacccgugggcgaggcucuugaggcccaagacccacaggcacaccuguuugcagagcuuuggugauuugggggcaucuagcccccaccagccugcaccuugagguccugccccacacauccauccaguuuuucugggagagcucagaacuuucugccuuaaauaaaggagguguggauaaacucaagguaggccuuguccugugacacccucacuaucugugacauucacaggaguggcuugaggaggcauccaccaugagccggugggagaggacgggaaggagcaauuucucccuuuccacacuggcacccucaucuccccagauuugucuuagcgucuucuggguagaaccccaggguaagaaugugugacuccagcccccuacaccucaaagccuguguaaaacucacauuuagcaugcuaggaccaggaaagcagggcccaaaggagguagcucaugucaccccugaacccccuuuccacucugugacucuauuucugugucucuuagauagagggccuuuuuggguacccuuaccccaaucuccaacauccauccccugugacuaccuccagugccuacuagcugucccugccaacgugucuuguaaggcagcagcuuuugucuucugagccuggcuuuugcaggguuggguggucagauguuuggaauaaaggcuguuuguagacaccccacccccaccccacgacaagcugcuuugucacuggggcaaguaaccucuaguagggucaggaagaugggcauguucugacuggaagcuuuugaaaaccucuauggaggugaucagagaaacacccacaugcccagugggugccuaaccacccuguccaggaagaccacagaggucucccucccagaaaauuagagggcaaaaugauggcgagagaaaggguuguggaggguccagaagagagaccaggcaugugguggggguggggagaagcuggcccacugcccagagaggguaugggguggagaggguggguguuccugacagucaguccugucuggucuuugucagcuggaggagauuuucuugacugcuauaagcacuggggcuuggggcuggggaugagagccaaggaccccagccucuuuuuuuuuuuuuuaaucugcucuucaagucccuucccaguaucuguacagcuaagagucuaggagcuaggaggcugguaggaugcucagagacgugggggucagcucaaccaguugcugucucuaugaggacacuaauagcaaaccuaugggguacuacgcuuccacccuaggaagcaagaccucagugacaguccuucauguaccugucauucaugcugaccucccuguccucccuggauauucaccgugcccuguguucugaguuauauucagacuugugcaugucccuaucucucugcuguggcccuucagcuccuauccacagcagacagcaaggggaggguaccacugcaggcaucgacgugggcuccaguccagagcuuagcaugcuuggagcaggagagggaagcccagaggccaccaugggccucuuuauguggcuguggucuacgcagccucauguguagcugccuacccauuacgagccuuacugcaaggagucagauuuacugugcagucuacauuaugccucgggaguugggauuagugugaggacucagagucauccaggcaggaccuugggagcaguguagaauccagguuucuggcugggcccaccaucucucauugcuaaggauguccuucaccuccccagccucucugucuugagggacccugcucacagcccugccucugucuccguauggcacucuggcauuuuuuaauugugaugucgacugcuuugcccguucuucaggcaccauuucauauucauaggccccuuccauaccauagcuucuuggcaucccaugaggccuuucgcugugugccaucccaugagccuccuaucccagugccacccaccuuuucauaagccaucuccuauuccccauuccauccuagaggcccuccccauuucauuauccccuucaucauggaugguguacccuaucccuuuuauuccccuucccucauuucuuuccccugcccccccaaccuccccccaugagucgcauuauauugaaguccacgagaccaaugacuguaacuguauuuauugauggacccaggaccucuggugaggcccuggugaggaggggcaaaggaugaaguagggcauguugaacacuuuaugauggaacugcuuccagacuaggcgaggggaaggcgaggccucaagcacacggccacacccaguugcccucagacggagauggacgacagguggguacuggggcagcauugccaaagagguuuacacacucgcuguauacauucauacggagagacucaaagcuaucuccgggacuccaaaccagugcaaucgacuuagugcaaauucaaaaggggguaaauggggaaacagagucacgggugcuuugagucucucaagcaaggaaggaacaaaaggaaagaaacagaauuacaggaaaggaggaagaagaaaaagacaggagggagaugaugaagucaucccgggguagaggcuuggcuccaggaugaugugggugguggucucccgggucaggcagaguuggccaugaagauggauucucaggggugggugggugcuaugagucugcucuuucaaaauguugacaccaucuguucuuucagcuucaccugcaaagagaauaaagacaaaugagguggggcggggggugggguggggagugggcuuggcaagcuuccaaagggugccccagcucaccuuggagcagauuccugaggcagguaguguagugguucugauugcagcaucuucuugauucagaacgagacggacuuaaagaaguccccggauucaaaggcccagacaugagcuggguagcaccauuucuaugggugggagagaaugagaccccuguccuuggcaucccacccucucccacccacauggggcagaagagaacucaccuuucaucuugaggguucaagguagggggaggaggauccagagagcagcagagaaguguuagcucuuugggaaaagugaaagaacagacggcuucuacgacaaggcgccagcccaugguguucugcaaaggacagaauccugagugaguggguggacaauuaggugguugagcggacuagcccuguggcagggaguaugcucaccaagaaggcuggaugacugcccuucuguccucuccaucacaccggaccaugucaugucuuucugucacauugaccacaccugucauccucgccuucagugacuggcaggcacauccaccucugcuggagaccuggcuauagggagaaaugaagacaugaguuaauugaacuugcgugggaggagacugggugaccacgagcgggacagacacuuacccuagucuccaguccgagcucuucgagacaccgaucacugcuccgucgccgcccgcaaggcccuccuuggccacggacucuggaggccagugccucccuggcucaccaccccagcuacucgcucuaccugcacccaaccucccucccuagaaacucauucauucugccccgccugccucgccucgucuggcuucauccugugcccuugacuccccuggaaauguucugucugucaugccagacccagggacugagcgguuagggcauacaguguaccaaguccacugugggcccuuuccgcaccagucccugggccgcagugccucaugggaauggugugucugcaggcuggacccacugcagccuccuugcuguaaaaucccucuggaguccgauaccugcagcccccacuccccuucuggugacacccugcacugcccuucuuuuccauucuccaguuauugaggcucuggcaaacuugggacuuugccagagccacucuugaaccuucuucuaagugaauuacggugggugggauguuguggcggcuggggacccaucugugucuugugaccccaucuugcccuguuugaccccagccuagaaugcuucuguucuugcuggaucccauggucucugccacugucuccaaggacuccuaucaccucccuggaggcagcggccucagucuuuacuggcaacccugcaccucuucuuucuucucucuaagagcucuuuccaccuggggucgccaauggucccccagccuccuucugucucggcuccccccgagacgaugucuccuuugcuaacuauccugccuuucuaugugccauucugcugcgaggccagccgcuucuucucaccaggcccccucucuaaaccuucguuuagaaggucaguggagcgaggccaagagagaagaaggagacucaccugcccagcagacggcgguccucaccugcccacugcugccagcuauaccuucacugcccaggucuggggucgaacccuucccagcagcuccccuuuauccgaccagccgccacguccuguaaccaaaaguaaccgggaugaaugucuggcuccccauuccucuccaacccuagcucaggcccuucagcuucacuccgauguuuuccagccuuugcgaugccuuugcucugccugagcuagccccucaguccuucaacauuccugccagacuccagaugccgaggugcuccucggaccccacgacucuccuccagcucucccaucuuccccaguuuccccgauaccccccacccccaccccccaccccccucccacacccggugcuucgggcccucuagcccgggcuuuuucuaacuggaguggcuccgcccagaauucccgccccuacucugucaaccaaucaguacauggccccgccggggcccccgcagggcccaccuccacccuguaucguuccagcgcacguucgccucaccccacacccgcacccguccugaaauucuccaaagacagccucaccacaacucccacuuuggaaucccuuagacagggccuggcauuguccccagauaucucccuugaugucgagaacauauagccccguagccugcugaagcccuucauagaacgguggugccccaggcacccugccacacugaagcugcccuuuacucaguuuguauaaugaccacaaugggaauuugagggcaugggucucauacuaucccacggaguaugaacagccuacgaguggcuaacccccagccuuuguccuagucugcuugacugaccuuaucuggccgcagugguuucaacaagguaguagcuaauuugggcacuccucaccgucccuuuucugggugagucgucacguuugucaggacucucuugcgaugaguuuuauuaguuaucuuacagucuggucuuggucaccccagucaaccggaggcacaguauggucucccuauccuacugaaguacuacuaucagugauagaauggggacaggagagaugcccugucccuccagccacgugcgugcguauaccauugcucuuagcuucuguugaaaguuaugcagcugaaauccacagagucagcauccacaaaucagggcaccagagaguagagcagcucuagauggaagugaccggagcuccagaugggaggaggacucaagggcugaccagucaugaccacucagcagugguucucaccuaugugaggugcaauagcaccuuggcagauccucagccuaguggcugcaugucagcugaguacucauuucuggcuccuagugauccuucauuuuuacucugugaaaagcccuggucauugcuguggguggacccuaaguuaugauacugacggacaccuccaauuuggucauaaauagaccccagccucuauuaucuuggcgcuguaaugugugucugugcugucaccuuguggugguuguggcuaucucugcgcucuuaaacaaaugauccuuuucagagaucgguauauaagauggaaaagaaugaccccaucuucuaaugagccucaagaacccuggcagcaucagcagacuaaaggccgaggguuggccaucacauguaagcuauucacuggugugguggcaguuggucucugucucccaucaccccccacaucacccuugcuauacuccccuauacuucccacuauauccuccccacuacaccccugcuauauccccccugucauccuccccaccauaccccuugccauaccccccaccauacuuccccuauggcccccauacucucugcuauacccccacuauacccucccugcuauacccccacuauacccccgcuaugucccccacuauacccacacuauaccgccccacuacacccccauuauacccccacuaugccccuccugccaugccccccacuaugucccccauuaugcccccgcuaugcccccgcuauacccccacuauaacucccucuauaucccccgcuauaccccuacuauaccucccacuauacuuccacuauaccuccccauuauacccccucgcuauaacccacgcuauacaaccccaccaugccacacccgcuaugcucccucuugcuacccacccuccugcuucacuucaaacuaagcggaucccugacuucuccuagucucuaaucucagcuuugcaacuucuugcuacaguuccuagguuaccugggacauugcaaugguugaaccccagccucugcuuuuauggcuaugggguuucgguggacgcacgcacgcggcaguuucuaugucucccgccuauaaccgauucuguauugaguuuggauugaacagaucuggcuagcuugaggagucccaaggcagaaggggaccauuccguaagugcacaaaugccugaucccuuuguugaaccugggguacucaaagcuuugucacagcggaccccaaccuaugccgcgucugccgagcaauauguaguauuguacugccaccacgcggcaucgucuguccauuuagcuauagccaaaucugcacagcguggagagugaaccgaucgaucgugaagggcgcaagacugaaggagcuacccaagaaauguguguuguaccaccccaugacccuuaugaaucauugaaugcuaugccugagugacccaugaguuugccauaggugaaccgcaauuuuggucaccucuaugauaaaguaugugggacugcacuggucgcugcucggcaacuucggucuuaccagccacugacgaucucgggcuguguagggaaugagucaaguucucugguucaguguguaagggaaccauuccagaggugcacacaucuuaccaccccuaugaaucccuauuugggugacccugggauauugcugggaaugaaucgcuccccccaaguuggcagcauuugggccacgauauauaggaguaugcugccaccgcgcgguagcauccguucccuuguugcacauaacagcuucuaugccuuccuauagugagccacacuggcugguuuugggguucagugaccaaagggacccccuccagaaacacaaguguuccaaccucuuauaaaccauaucgaccacugaggcauagcggcuucggacauugcugugggcgaacccgaacuuuggcccuuggacauugucaugggcaaaccuuaacuuuggcugucucuggaacauaauguuuaagaugacagucaccagcgcagcaauuuggucuuuccacucacaacggcuuuugugcuuucuggcaucgaaccacaugcacugguuuauggggucugagaccaaaggagaccauuccggaagggcauagguguccugccuucugcuuuuaacaaggcucuccgggacagugcaaaacaggugaaccccaacuuugccauaaguacgauuaucugccacaaaccagccagggguccuaccaccucuucaauugauuuugggcugacacccaaggcuugauguaggauuccucagcugccaagcuggcagcugagccccauugagagagaaugcaguuucagaauuguuugcagcccugagccggagaucauuagcaucugaacgccccaauuagaauacgaaagcgcaaaucaccagacuuucuuguuggcgguuccuuaagugauucuuuggguagggaggucagguguccucauagaugugcagaauuugaggaccaugcuuaguggggucugcauuaugguacugcaauacauuccaugaucaccacacauaguagcuauacuucaauuuucacacaauagcgcugauggccccagaacccuauaagucagauaccugagauagcucuugagaacguuuuaucaaggacuagcaugaaccccuggccucaugaagcccaugacuaugggaucauagauggugauaggggagaaaacucaaucaguugcaauccguuuuaggacugcgauguacgagacuucacugccgccgugcggcaacccuggucuuuacacacaaaggauucuuugcagagaguaagccgaccuuguugauuugggaguccgaguccacgagguaccagccuagaaaaugcauguguccugccccccuaguggcauuugugaccccccugagguacugaacuugggugacccacagcauugccauuugugaauuccaauaccaggggugggggggcucuuuagguuuggcgcaaucgauuuugcugccaccacgcggcaacucccgcguauaaaccccacaacugauucagcagacguccaagaauagggcauggucuccuugcagaauucuuaugccuccuggaugcucgugugaauguagcauguuccuuugaguccuggguguaagugcccugcacgcucaucccccggacaugaaaauagaaucucuauuuucucaccaaccuuuuucuuuccuuguggugauucgggaacuguaggcaauggcuauuuucucgguuuuaacucaggcuccaggcagacucaguacugucuggucaucaguugcugcacagaacacacuuacauggcaccauggcccuuuagccucugcuauguuccuccuguauggucacagcacugcuauguuccuccuguauagucacagcacuuuugacugcauugaauggacagugagcaggaaagcuuccuuggucaggcuaaacuccuagugguucauuugcauuucgaugggauagagcuagaucucuucuuccagaaacaaguuaggcaugccuuugucaaucuggggacugccagggcagaaaguacaaugagggcaguaagcuuuggcggggaggggggcucuuggggucaagucuagucuguuuuggccauuguaauaguacgugacauugaggacuaggugauggcuagcagcuggugggcaaacagaaccuaacugaagcaugguacucuaaugggggcuaguauccagugagagccuagucugagcccuguuguuggcuguggaacuuagacaagugguggagaaagagcucugcuuucucagauuccuucuuaguaacguuccuaaagaaugagcauagagagaguggaagugaaacauccaggggagccucagucucuucugaguucauggccaagacuuauguccuaaacucacacuauggcccucucaguugggaaccagcucccguuguccccuucuggacaccauccccauauagaacuaaccacacaaugugucuuuuauaccacugugagcaugguggugccaccuaguaucuggacaaaagcuuguagaugaugcuaacaugacaauaugauauugacuuagauaaguugguacauaagagugacauagcuggucccagcacuugggaggcagaggcaggcagauuucugaguucgaggccagccuggucuauaaagugaguuccaggacagccaaggcuacacagagaaacccugucucaaaaaacaaaacaaaacaacaccacaaaagagugacauagcugggacauggacaugggagugucacauagaugggauaugcacccagaagugucacauagaugggacauggacacaggagugucacacauaggggauauggacacaggagugucacacagguggggcauggacacaggagugucacacagaugggauauggacacaggaguauuaccugaacaggacaugggcacugaugugccaccuggauauaacaugggcccaguggugucuguaaucuggagagaacauagguauaagaguguuacuuauauaggacauggacacagaauaucacuucaauaagaugcaggcucagagguauuacccaggaaggacauggguauagagaucuuucuauauacagaagagauaccuucuagaccuucuagacacauagaugggacacauagauaggacacauagaugggacauauagacacauagauggaacacagacacagaggaaucuuuuggacgggacauggguacaaaggugucauuuguauggggcaugggcauaggagucccaauggacguacacagagguguuuccugaaugaaacauaggcacauggauuccacaggacaacaaaacagaguugucaucuugaauggauaagggcacaggggugucuccuggauagaaugcaagaauagagauaacaccuggauaggaccuaagcauaaagguguuaccaagauaggacacaaacauagcugccuccuagaugggacaugggcguaggugucauauggaggggauaaugccacaaaggugucaccuggauaggacaugggcacagaggugucaccuaugugaaacaugggcacaaugguaucaucagcauguagauauagacacauuccuauccaaggauggggacaugaauaccaggguaugacuuggauagggacaggacauaaugugucauucaaagaagauuggagaugccaucuauaaaccauauacaaccuaaggagaaaucagcucuacaggcaugggcaccuugacuuuggccuugaaauugugggguacaagaaaacugauuuuuguguaggaagaugguuucuuguagcccaugcugaccucagacuagcuauguaauaaagaugaccuuuaaucucugaucuuccugccuucauccccugaguguuggaugauaagugcaccaccaugucuaauuuaugauucugcuuuucugaacacucacuucuuaauguuucuuacagcccuuggucaacuagccuaaauaagauuaaccuggagggaagaagaguguaguagcuugauggcacccauagguucauagauuugacuacuuggucaccaggaguggcacuauuugaaacaauaaggaggcauggccuuguucagaggaagugugccacugggcuuuggagguuucaagggcccaaaccaggcccaauggcuuucucuuccugcugccuauggaucuggauguagcagacuaaaccucuaaagcgguaagcaaacccaaaauaaaugcuuuuuuuuuaaaaaaaaauaagaguugccacaaucaugaugucucuccacagcaauagaacacugacuaaaacagaaagcaacagaaacugugugucagagguggguuccaaaugcuuucugcugcagcccagguuugugguguuagcccuuuguugcucuagcuagcccaccaucucaggcuugacccucagcugguaugaguacugagcugaaugcuuugcagcuuccucuugaaaggugccagcuugccuuggcaaccccuuacuguuguuugggaguauguguggguauuuggggguugcuuccaaaagcaggaauuuauucuagcacagcucugaagaccauaaauccaagaucaaguguuucuuagaaggcuccaggagggguccuaccugcuucucccaagcucaggagauccuagggguccuuaacuugugacuacauuccccaaacccgggcuucuuguuuacagaagcuuccccuguguguuuaugucugagucuaaauguucucuucuaauggaugcagacaccaccaucaauuccagggcacccuuauccugaguagaugaggaaggaucauugagucaucugcaucaacccaauguucaggugaggacaggccugaacugggggggacauuuugaugcaauccaaaguggcaagggacagacauaaguuugacuguccacuuggguucccacaugcccauguaauguccacauggccugggacuuguccugcaucuugcacaucuuuuuucugacuuggucucagaaccugagcagcagucugcaauggaacaccguggcuugcuuauuucugguuugacccaugagcacugugcuuuggucugcaggcaucauggguauccauugaugagcccuggcaggcauacugggucuccuacaauauacuagguagacacaaagcaugacagcuuagucccaaaagaggauucuggagaugggcauagagagaaaagagggagccaagcgugucugagggacugucgagugcugagucugguuuuucagucaccacuuugaggccaucuauacauggugucuccacuguuucagcaauccuggcugcuuucugccucugcccuguagccuucccaagaguucugcuugcugcugcagcccagguguguguuagcccucugcugcucuagcuagcccaccaucucaggcuugacccgcagcugguaugaguacugagauggaugcuuuacagcuuccucaugaaaggugccagcuugccuuggcaaacccaucuguuuucuuccucauccuucugcaucuauuacagugcacccuaacagccucaucacuguuucugcucuggcugcaaaaggcauaugagcaucaucuuugaucugaguucuuauucggggacugagcaaacauacacagacccugaccucgaagacaaacuguguuuucaggaguccucccucacuccugcaggcuggucuuaccaggugggccaggccaccauccauguucccuugcaucauaggaccaccacuaucccuugagcuaucaugugaggugggugaaacccaggaaggugaagaagguucuuagggcagguaguaacucaucaacuugauuucuaggggcagagugggugcugaccuauaucuauguacggacaauaacaagagaaguggccccggugcauaaggggagaagcuggcagaucaggcugugaagggaggccaggccaaauccagucuugugacagugaccucuugaaggcuaccaccucacuaacuacuuagcaaaaaguggugcugaccaagguuaccacucacagagcaggugcuugcuggcugccucuccccaccauggaugccccagccacagcuuuaggaugcauuuacugaagggaccagugauugacccaguagaguaaucaaauggugccuagaggaagaaaaauaggucacccuggucugucuagguggaggauacuguuugcauucaaaagggaacaagggccuccuuccuccagccuuguggauuguuccuggcccuucuggaaucaucuggaaguuaauccuuuggaaaacaaauauuucagacaucucaacaacacaagcccuccaagugagagcugagcagaugggccaaaaggucuggaaacucuccccuacacccagaugcuuaagccccccaaaccucagcaguguccauaggggacacagacugcggccaggaaagugucagagcugccggccaccugccugggccucacuccuggguccuguccauucucuuuggcagcucuggccaucgacaggacauuccugaaggcugaggcugugcacugggggcugcuguuagaaaagcuagaggaagguccacugucacccuggggcccuugcuguucccuggcucuuccacuuucccacacucuccucagggcuuggggacucaccaggaagugggacauuucccuuguuucuuuucccaaaguccauguuuaggggcccauuugguccuuauuuucugugaccauccacuguacacuggcgucuacuucggcuagcugcacccaugcccacacgcuccuuuguagguagagcccuucuuucccauuccuuuacaugggucugggcuauacuugaaucaucuaguugaaagcccagacugucuccucucaacagaagcacaguggcccagcuacagaguccugcugcuauagggcaaggguacauacuauccugagcaggucagccccaucugcaaagccuacgaggccaucauugugagcauaacagaagagaccuuaggauagaagagagaaaagacuuagaaguggaaggccaggccaugguggggagagacggcuaggaagcacccacucugugguuauguucccuggccucacaaguggcaacacagucacuucuaaucuggcucauaaagguuuccagaaggaucucccccuuucucuccucugccccuagaaggaagggcauauuguccaaggguccuagaggugcagagccacaagauggcaggagcccgggauuucuuuacacacuuaauacucuuuagugauggccuacagagacauguguucauggugcuaaaucccacugucucaucggggaauagggagcccaagaggacagagggguggugggcugcucuacaaacagggaaguguaaaccauaagcaagggucaucuauggcaugugagcacugaggugucuuuaaauaauaacuggggaauccuuguuggugugaacaggcaaggcuugggcaagguuggagguggggcaggggacucaguuggaaggccaccau

SEQ ID NO: 19 - RNA, 22615 nt, Mus musculus
augguggccuuccaacugaguccccugccccaccuccaaccuugcccaagccuugccuguucacaccaacaaggauuccccaguuauuauuuaaagacaccucagugcucacaugccauagaugacccuugcuuaugguuuacacuucccuguuuguagagcagcccaccaccccucuguccucuugggcucccuauuccccgaugagacagugggauuuagcaccaugaacacaugucucuguaggccaucacuaaagaguauuaaguguguaaagaaaucccgggcuccugccaucuuguggcucugcaccucuaggacccuuggacaauaugcccuuccuucuaggggcagaggagagaaagggggagauccuucuggaaaccuuuaugagccagauuagaagugacuguguugccacuugugaggccagggaacauaaccacagagugggugcuuccuagccgucucuccccaccauggccuggccuuccacuucuaagucuuuucucucuucuauccuaaggucucuucuguuaugcucacaaugauggccucguaggcuuugcagauggggcugaccugcucaggauaguauguacccuugcccuauagcagcaggacucuguagcugggccacugugcuucuguugagaggagacagucugggcuuucaacuagaugauucaaguauagcccagacccauguaaaggaaugggaaagaagggcucuaccuacaaaggagcgugugggcaugggugcagcuagccgaaguagacgccaguguacaguggauggucacagaaaauaaggaccaaaugggccccuaaacauggacuuugggaaaagaaacaagggaaaugucccacuuccuggugaguccccaagcccugaggagagugugggaaaguggaagagccagggaacagcaagggccccagggugacaguggaccuuccucuagcuuuucuaacagcagcccccagugcacagccucagccuucaggaauguccugucgauggccagagcugccaaagagaauggacaggacccaggagugaggcccaggcagguggccggcagcucugacacuuuccuggccgcagucuguguccccuauggacacugcugagguuuggggggcuuaagcaucuggguguaggggagaguuuccagaccuuuuggcccaucugcucagcucucacuuggagggcuuguguuguugagaugucugaaauauuuguuuuccaaaggauuaacuuccagaugauuccagaagggccaggaacaauccacaaggcuggaggaaggaggcccuuguucccuuuugaaugcaaacaguauccuccaccuagacagaccagggugaccuauuuuucuuccucuaggcaccauuugauuacucuacugggucaaucacuggucccuucaguaaaugcauccuaaagcuguggcuggggcauccaugguggggagaggcagccagcaagcaccugcucugugagugguaaccuuggucagcaccacuuuuugcuaaguaguuagugaggugguagccuucaagaggucacugucacaagacuggauuuggccuggccucccuucacagccugaucugccagcuucuccccuuaugcaccggggccacuucucuuguuauuguccguacauagauauaggucagcacccacucugccccuagaaaucaaguugaugaguuacuaccugcccuaagaaccuucuucaccuuccuggguuucacccaccucacaugauagcucaagggauaguggugguccuaugaugcaagggaacauggaugguggccuggcccaccugguaagaccagccugcaggagugagggaggacuccugaaaacacaguuugucuucgaggucagggucuguguauguuugcucaguccccgaauaagaacucagaucaaagaugaugcucauaugccuuuugcagccagagcagaaacagugaugaggcuguuagggugcacuguaauagaugcagaaggaugaggaagaaaacagauggguuugccaaggcaagcuggcaccuuucaugaggaagcuguaaagcauccaucucaguacucauaccagcugcgggucaagccugagauggugggcuagcuagagcagcagagggcuaacacacaccugggcugcagcagcaagcagaacucuugggaaggcuacagggcagaggcagaaagcagccaggauugcugaaacaguggagacaccauguauagauggccucaaaguggugacugaaaaaccagacucagcacucgacagucccucagacacgcuuggcucccucuuuucucucuaugcccaucuccagaauccucuuuugggacuaagcugucaugcuuugugucuaccuaguauauuguaggagacccaguaugccugccagggcucaucaauggauacccaugaugccugcagaccaaagcacagugcucaugggucaaaccagaaauaagcaagccacgguguuccauugcagacugcugcucagguucugagaccaagucagaaaaaagaugugcaagaugcaggacaagucccaggccauguggacauuacaugggcaugugggaacccaaguggacagucaaacuuaugucugucccuugccacuuuggauugcaucaaaaugucccccccaguucaggccuguccucaccugaacauuggguugaugcagaugacucaaugauccuuccucaucuacucaggauaagggugcccuggaauugaugguggugucugcauccauuagaagagaacauuuagacucagacauaaacacacaggggaagcuucuguaaacaagaagcccggguuuggggaauguagucacaaguuaaggaccccuaggaucuccugagcuugggagaagcagguaggaccccuccuggagccuucuaagaaacacuugaucuuggauuuauggucuucagagcugugcuagaauaaauuccugcuuuuggaagcaacccccaaauacccacacauacucccaaacaacaguaagggguugccaaggcaagcuggcaccuuucaagaggaagcugcaaagcauucagcucaguacucauaccagcugagggucaagccugagauggugggcuagcuagagcaacaaagggcuaacaccacaaaccugggcugcagcagaaagcauuuggaacccaccucugacacacaguuucuguugcuuucuguuuuagucaguguucuauugcuguggagagacaucaugauuguggcaacucuuauuuuuuuuuaaaaaaaaagcauuuauuuuggguuugcuuaccgcuuuagagguuuagucugcuacauccagauccauaggcagcaggaagagaaagccauugggccugguuugggcccuugaaaccuccaaagcccaguggcacacuuccucugaacaaggccaugccuccuuauuguuucaaauagugccacuccuggugaccaaguagucaaaucuaugaaccuaugggugccaucaagcuacuacacucuucuucccuccagguuaaucuuauuuaggcuaguugaccaagggcuguaagaaacauuaagaagugaguguucagaaaagcagaaucauaaauuagacaugguggugcacuuaucauccaacacucaggggaugaaggcaggaagaucagagauuaaaggucaucuuuauuacauagcuagucugaggucagcaugggcuacaagaaaccaucuuccuacacaaaaaucaguuuucuuguaccccacaauuucaaggccaaagucaaggugcccaugccuguagagcugauuucuccuuagguuguauaugguuuauagauggcaucuccaaucuucuuugaaugacacauuauguccugucccuauccaagucauacccugguauucauguccccauccuuggauaggaaugugucuauaucuacaugcugaugauaccauugugcccauguuucacauaggugacaccucugugcccauguccuauccaggugacaccuuuguggcauuauccccuccauaugacaccuacgcccaugucccaucuaggaggcagcuauguuuguguccuaucuugguaacaccuuuaugcuuagguccuauccagguguuaucucuauucuugcauucuauccaggagacaccccugugcccuuauccauucaagaugacaacucuguuuuguuguccuguggaauccaugugccuauguuucauucaggaaacaccucuguguacguccauugggacuccuaugcccaugccccauacaaaugacaccuuuguacccaugucccguccaaaagauuccucugugucuguguuccaucuaugugucuauaugucccaucuauguguccuaucuaugugucccaucuaugugucuagaaggucuagaagguaucucuucuguauauagaaagaucucuauacccauguccuuccuggguaauaccucugagccugcaucuuauugaagugauauucuguguccauguccuauauaaguaacacucuuauaccuauguucucuccagauuacagacaccacugggcccauguuauauccagguggcacaucagugcccauguccuguucagguaauacuccuguguccauaucccaucugugugacacuccuguguccaugccccaccugugugacacuccuguguccauauccccuaugugugacacuccuguguccaugucccaucuaugugacacuucugggugcauaucccaucuaugugacacucccauguccaugucccagcuaugucacucuuuugugguguuguuuuguuuuguuuuuugagacaggguuucucuguguagccuuggcuguccuggaacucacuuuauagaccaggcuggccucgaacucagaaaucugccugccucugccucccaagugcugggaccagcuaugucacucuuauguaccaacuuaucuaagucaauaucauauugucauguuagcaucaucuacaagcuuuuguccagauacuagguggcaccaccaugcucacagugguauaaaagacacauugugugguuaguucuauauggggaugguguccagaaggggacaacgggagcugguucccaacugagagggccauagugugaguuuaggacauaagucuuggccaugaacucagaagagacugaggcuccccuggauguuucacuuccacucucucuaugcucauucuuuaggaacguuacuaagaaggaaucugagaaagcagagcucuuucuccaccacuugucuaaguuccacagccaacaacagggcucagacuaggcucucacuggauacuagcccccauuagaguaccaugcuucaguuagguucuguuugcccaccagcugcuagccaucaccuaguccucaaugucacguacuauuacaauggccaaaacagacuagacuugaccccaagagccccccuccccgccaaagcuuacugcccucauuguacuuucugcccuggcaguccccagauugacaaaggcaugccuaacuuguuucuggaagaagagaucuagcucuaucccaucgaaaugcaaaugaaccacuaggaguuuagccugaccaaggaagcuuuccugcucacuguccauucaaugcagucaaaagugcugugacuauacaggaggaacauagcagugcugugaccauacaggaggaacauagcagaggcuaaagggccauggugccauguaaguguguucugugcagcaacugaugaccagacaguacugagucugccuggagccugaguuaaaaccgagaaaauagccauugccuacaguucccgaaucaccacaaggaaagaaaaagguuggugagaaaauagagauucuauuuucauguccgggggaugagcgugcagggcacuuacacccaggacucaaaggaacaugcuacauucacacgagcauccaggaggcauaagaauucugcaaggagaccaugcccuauucuuggacgucugcugaaucaguugugggguuuauacgcgggaguugccgcgugguggcagcaaaaucgauugcgccaaaccuaaagagcccccccaccccugguauuggaauucacaaauggcaaugcugugggucacccaaguucaguaccucaggggggucacaaaugccacuaggggggcaggacacaugcauuuucuaggcugguaccucguggacucggacucccaaaucaacaaggucggcuuacucucugcaaagaauccuuuguguguaaagaccaggguugccgcacggcggcagugaagucucguacaucgcaguccuaaaacggauugcaacugauugaguuuucuccccuaucaccaucuaugaucccauagucaugggcuucaugaggccagggguucaugcuaguccuugauaaaacguucucaagagcuaucucagguaucugacuuauaggguucuggggccaucagcgcuauugugugaaaauugaaguauagcuacuauguguggugaucauggaauguauugcaguaccauaaugcagaccccacuaagcaugguccucaaauucugcacaucuaugaggacaccugaccucccuacccaaagaaucacuuaaggaaccgccaacaagaaagucuggugauuugcgcuuucguauucuaauuggggcguucagaugcuaaugaucuccggcucagggcugcaaacaauucugaaacugcauucucucucaauggggcucagcugccagcuuggcagcugaggaauccuacaucaagccuugggugucagcccaaaaucaauugaagaggugguaggaccccuggcugguuuguggcagauaaucguacuuauggcaaaguugggguucaccuguuuugcacugucccggagagccuuguuaaaagcagaaggcaggacaccuaugcccuuccggaauggucuccuuuggucucagaccccauaaaccagugcaugugguucgaugccagaaagcacaaaagccguugugaguggaaagaccaaauugcugcgcuggugacugucaucuuaaacauuauguuccagagacagccaaaguuaagguuugcccaugacaauguccaagggccaaaguucggguucgcccacagcaauguccgaagccgcuaugccucaguggucgauaugguuuauaagagguuggaacacuuguguuucuggagggggucccuuuggucacugaaccccaaaaccagccaguguggcucacuauaggaaggcauagaagcuguuaugugcaacaagggaacggaugcuaccgcgcgguggcagcauacuccuauauaucguggcccaaaugcugccaacuuggggggagcgauucauucccagcaauaucccagggucacccaaauagggauucauaggggugguaagaugugugcaccucuggaaugguucccuuacacacugaaccagagaacuugacucauucccuacacagcccgagaucgucaguggcugguaagaccgaaguugccgagcagcgaccagugcagucccacauacuuuaucauagaggugaccaaaauugcgguucaccuauggcaaacucaugggucacucaggcauagcauucaaugauucauaagggucauggggugguacaacacacauuucuuggguagcuccuucagucuugcgcccuucacgaucgaucgguucacucuccacgcugugcagauuuggcuauagcuaaauggacagacgaugccgcgugguggcaguacaauacuacauauugcucggcagacgcggcauagguugggguccgcugugacaaagcuuugaguaccccagguucaacaaagggaucaggcauuugugcacuuacggaaugguccccuucugccuugggacuccucaagcuagccagaucuguucaauccaaacucaauacagaaucgguuauaggcgggagacauagaaacugccgcgugcgugcguccaccgaaaccccauagccauaaaagcagaggcugggguucaaccauugcaaugucccagguaaccuaggaacuguagcaagaaguugcaaagcugagauuagagacuaggagaagucagggauccgcuuaguuugaagugaagcaggaggguggguagcaagagggagcauagcggguguggcauggugggguuguauagcguggguuauagcgaggggguauaauggggagguauaguggaaguauagugggagguauaguagggguauagcgggggauauagagggaguuauaguggggguauagcgggggcauagcgggggcauaaugggggacauaguggggggcauggcaggaggggcauaguggggguauaauggggguguaguggggcgguauaguguggguauagugggggacauagcggggguauaguggggguauagcagggaggguauaguggggguauagcagagaguaugggggccauaggggaaguauggugggggguauggcaagggguaugguggggaggaugacaggggggauauagcagggguguaguggggaggauauagugggaaguauaggggaguauagcaagggugauguggggggugaugggagacagagaccaacugccaccacaccagugaauagcuuacaugugauggccaacccucggccuuuagucugcugaugcugccaggguucuugaggcucauuagaagauggggucauucuuuuccaucuuauauaccgaucucugaaaaggaucauuuguuuaagagcgcagagauagccacaaccaccacaaggugacagcacagacacacauuacagcgccaagauaauagaggcuggggucuauuuaugaccaaauuggagguguccgucaguaucauaacuuaggguccacccacagcaaugaccagggcuuuucacagaguaaaaaugaaggaucacuaggagccagaaaugaguacucagcugacaugcagccacuaggcugaggaucugccaaggugcuauugcaccucacauaggugagaaccacugcugaguggucaugacuggucagcccuugaguccuccucccaucuggagcuccggucacuuccaucuagagcugcucuacucucuggugcccugauuuguggaugcugacucuguggauuucagcugcauaacuuucaacagaagcuaagagcaaugguauacgcacgcacguggcuggagggacagggcaucucuccuguccccauucuaucacugauaguaguacuucaguaggauagggagaccauacugugccuccgguugacuggggugaccaagaccagacuguaagauaacuaauaaaacucaucgcaagagaguccugacaaacgugacgacucacccagaaaagggacggugaggagugcccaaauuagcuacuaccuuguugaaaccacugcggccagauaaggucagucaagcagacuaggacaaaggcuggggguuagccacucguaggcuguucauacuccgugggauaguaugagacccaugcccucaaauucccauuguggucauuauacaaacugaguaaagggcagcuucaguguggcagggugccuggggcaccaccguucuaugaagggcuucagcaggcuacggggcuauauguucucgacaucaagggagauaucuggggacaaugccaggcccugucuaagggauuccaaagugggaguuguggugaggcugucuuuggagaauuucaggacgggugcggguguggggugaggcgaacgugcgcuggaacgauacaggguggaggugggcccugcgggggccccggcggggccauguacugauugguugacagaguaggggcgggaauucugggcggagccacuccaguuagaaaaagcccgggcuagagggcccgaagcaccgggugugggagggggguggggggugggggugggggguaucggggaaacuggggaagaugggagagcuggaggagagucgugggguccgaggagcaccucggcaucuggagucuggcaggaauguugaaggacugaggggcuagcucaggcagagcaaaggcaucgcaaaggcuggaaaacaucggagugaagcugaagggccugagcuaggguuggagaggaauggggagccagacauucaucccgguuacuuuugguuacaggacguggcggcuggucggauaaaggggagcugcugggaaggguucgaccccagaccugggcagugaagguauagcuggcagcagugggcaggugaggaccgccgucugcugggcaggugagucuccuucuucucucuuggccucgcuccacugaccuucuaaacgaagguuuagagagggggccuggugagaagaagcggcuggccucgcagcagaauggcacauagaaaggcaggauaguuagcaaaggagacaucgucucggggggagccgagacagaaggaggcugggggaccauuggcgaccccagguggaaagagcucuuagagagaagaaagaagaggugcaggguugccaguaaagacugaggccgcugccuccagggaggugauaggaguccuuggagacaguggcagagaccaugggauccagcaagaacagaagcauucuaggcuggggucaaacagggcaagauggggucacaagacacagauggguccccagccgccacaacaucccacccaccguaauucacuuagaagaagguucaagaguggcucuggcaaagucccaaguuugccagagccucaauaacuggagaauggaaaagaagggcagugcagggugucaccagaaggggagugggggcugcagguaucggacuccagagggauuuuacagcaaggaggcugcaguggguccagccugcagacacaccauucccaugaggcacugcggcccagggacuggugcggaaagggcccacaguggacuugguacacuguaugcccuaaccgcucagucccugggucuggcaugacagacagaacauuuccaggggagucaagggcacaggaugaagccagacgaggcgaggcaggcggggcagaaugaaugaguuucuagggagggagguugggugcagguagagcgaguagcugggguggugagccagggaggcacuggccuccagaguccguggccaaggagggccuugcgggcggcgacggagcagugaucggugucucgaagagcucggacuggagacuaggguaagugucugucccgcucguggucacccagucuccucccacgcaaguucaauuaacucaugucuucauuucucccuauagccaggucuccagcagagguggaugugccugccagucacugaaggcgaggaugacagguguggucaaugugacagaaagacaugacaugguccggugugauggagaggacagaagggcagucauccagccuucuuggugagcauacucccugccacagggcuaguccgcucaaccaccuaauuguccacccacucacucaggauucuguccuuugcagaacaccaugggcuggcgccuugucguagaagccgucuguucuuucacuuuucccaaagagcuaacacuucucugcugcucucuggauccuccucccccuaccuugaacccucaagaugaaaggugaguucucuucugccccaugugggugggagagggugggaugccaaggacaggggucucauucucucccacccauagaaauggugcuacccagcucaugucugggccuuugaauccggggacuucuuuaaguccgucucguucugaaucaagaagaugcugcaaucagaaccacuacacuaccugccucaggaaucugcuccaaggugagcuggggcacccuuuggaagcuugccaagcccacuccccaccccaccccccgccccaccucauuugucuuuauucucuuugcaggugaagcugaaagaacagauggugucaacauuuugaaagagcagacucauagcacccacccaccccugagaauccaucuucauggccaacucugccugacccgggagaccaccacccacaucauccuggagccaagccucuaccccgggaugacuucaucaucucccuccugucuuuuucuucuuccuccuuuccuguaauucuguuucuuuccuuuuguuccuuccuugcuugagagacucaaagcacccgugacucuguuuccccauuuacccccuuuugaauuugcacuaagucgauugcacugguuuggagucccggagauagcuuugagucucuccguaugaauguauacagcgaguguguaaaccucuuuggcaaugcugccccaguacccaccugucguccaucuccgucugagggcaacuggguguggccgugugcuugaggccucgccuuccccucgccuagucuggaagcaguuccaucauaaaguguucaacaugcccuacuucauccuuugccccuccucaccagggccucaccagagguccuggguccaucaauaaauacaguuacagucauuggucucguggacuucaauauaaugcgacucauggggggagguugggggggcaggggaaagaaaugagggaaggggaauaaaagggauaggguacaccauccaugaugaaggggauaaugaaauggggagggccucuaggauggaauggggaauaggagauggcuuaugaaaagguggguggcacugggauaggaggcucaugggauggcacacagcgaaaggccucaugggaugccaagaagcuaugguauggaaggggccuaugaauaugaaauggugccugaagaacgggcaaagcagucgacaucacaauuaaaaaaugccagagugccauacggagacagaggcagggcugugagcagggucccucaagacagagaggcuggggaggugaaggacauccuuagcaaugagagauggugggcccagccagaaaccuggauucuacacugcucccaagguccugccuggaugacucugaguccucacacuaaucccaacucccgaggcauaauguagacugcacaguaaaucugacuccuugcaguaaggcucguaauggguaggcagcuacacaugaggcugcguagaccacagccacauaaagaggcccaugguggccucugggcuucccucuccugcuccaagcaugcuaagcucuggacuggagcccacgucgaugccugcagugguacccuccccuugcugucugcuguggauaggagcugaagggccacagcagagagauagggacaugcacaagucugaauauaacucagaacacagggcacggugaauauccagggaggacagggaggucagcaugaaugacagguacaugaaggacugucacugaggucuugcuuccuaggguggaagcguaguaccccauagguuugcuauuaguguccucauagagacagcaacugguugagcugacccccacgucucugagcauccuaccagccuccuagcuccuagacucuuagcuguacagauacugggaagggacuugaagagcagauuaaaaaaaaaaaaaagaggcugggguccuuggcucucauccccagccccaagccccagugcuuauagcagucaagaaaaucuccuccagcugacaaagaccagacaggacugacugucaggaacacccacccucuccaccccauacccucucugggcagugggccagcuucuccccacccccaccacaugccuggucucucuucuggacccuccacaacccuuucucucgccaucauuuugcccucuaauuuucugggagggagaccucuguggucuuccuggacagggugguuaggcacccacugggcauguggguguuucucugaucaccuccauagagguuuucaaaagcuuccagucagaacaugcccaucuuccugacccuacuagagguuacuugccccagugacaaagcagcuugucgugggguggggguggggugucuacaaacagccuuuauuccaaacaucugaccacccaacccugcaaaagccaggcucagaagacaaaagcugcugccuuacaagacacguuggcagggacagcuaguaggcacuggagguagucacaggggauggauguuggagauugggguaaggguacccaaaaaggcccucuaucuaagagacacagaaauagagucacagaguggaaaggggguucaggggugacaugagcuaccuccuuugggcccugcuuuccugguccuagcaugcuaaaugugaguuuuacacaggcuuugagguguagggggcuggagucacacauucuuacccugggguucuacccagaagacgcuaagacaaaucuggggagaugagggugccaguguggaaagggagaaauugcuccuucccguccucucccaccggcucaugguggaugccuccucaagccacuccugugaaugucacagauagugagggugucacaggacaaggccuaccuugaguuuauccacaccuccuuuauuuaaggcagaaaguucugagcucucccagaaaaacuggauggauguguggggcaggaccucaaggugcaggcuggugggggcuagaugcccccaaaucaccaaagcucugcaaacaggugugccugugggucuugggccucaagagccucgcccacggguaggggcugggaaaacagagguggcccagccccccacccuccagccagcacagccccuccaucagcccaguuuggaauguguuuaccuuuagcccaacccgauuuccugcuuuuuagaaaaggggcuuagagagggcugcuagacaggcuccaagccugccacccaaaggcacuuucaaccuccccccuccuugugcggagaagcuaacaggggcuugaauuucauccccaaaccccagccaggguggguuguggggaggguggggaggggcuggcugcuccacgcugcacagccugggagauguuucaaaucuucauggggcccaggguccccagcacaacccccacccugcaggcacagaacuacggggguccucacacacccaaaccccuccccagcuauguuucagugacaaguuaagguuggacaaagacuggaguagcccauuagagagcccuuaucacacguggugguguggccacaguaauaacucagggcuugucccugaggacgcauaugcugugggcgaguaugucugugugugugagggccacauggccucaccuauauacccuggucuaucugugguaggaucugugugcugaccaguuggccaguggcuggugcugaggcugaagcugaggcugaggcaggggucuguccuuuuucaggauuuuucugcggggguguauguggucauggccuccaggaaaguguacccuugagcugacugcguugggcgucugugguuucaugucucagguugaacugaguaacccaagagcacguuuuaggcaggaaucguggacaugggggagggacagcagucaagauauuugcuaucccacugaguagagaacauuccaauacugugcagggaaggaggccucugaggccccgggggcugcaggcuugacuguaguacacccugcagaaucucaaacaacguagcaugagacugcagagguuggccucccacuaucuacacugcaagaggagggucuccuuuccaaaggaacuagaaagcugggaguguuguccucuucagcugugcacaccagcaucugaccagaaccagagacugggcucaaagacugucuguccccuuccagcaugaucccagccucuccacggaauacuuauuguuugcaugggugcacaaguguguguaugugcacauguguaugcaugcacaugcaugugugugcauguuugugcgugugugcgugugugugcgcacacacacaugagugcaugaguaugugucccaugaggaacuagggccuucucuaagaaugugugaaucuccagaaaggggaagagaagguucuggaaggaguuguggucagcucuggccuucccucaugcuguuguagccaugcuggcucagcagagcuacccacccucuuuccuuuccuuuccaucccucaccucuccucuccucucuuuucuccuccuccccccucuccuggugacauuguuggccccuuuccagggcugaggggagccggcgggggcccuuccuggaagcccaccugcaaaggcuugcugggaaggggccugcucucccucaggcucccacccgcccgcagccguuuccuggaagcagucacuggguauucuguuccuugucaacgcgagccugcaaauaaagcagacacugugcuccuuguccucagggagcccagcuccaucaccccacaccuggcaagacagcagguggguagccgggccauggggagcagugcgaggcgaggcgaggcaggggcuggacccauaaacaagcccaggcgccaaguacaggaggcucuacccccacccuccgugugacaccucugagaugaacccaugccaaaccccaaaaacagcuauaggugcaaaagggaaguccccaaggaaaagacacccugcagaccccagggaaaggcugggaacagguccaugaagaggucaccccugggacccuggcucugcagaaaauuuuuuaccugaaugggaaggcccagggaucucacaugagagaggcaucacgguaagggagagaaagggauugguaaaacccuucacuuugaguuagggaaagaggcagagcuaucauagagucggggucuugugggcaccccaucuaggagaagggauuaaaugaugaaaccuggacucuagucuuucugaggggagaaaugaaacaaaggauggugagcggccuaagagcaggggaaccucccugggcaugcucagagcacuugacggaguguggagcuagcucugaggguagaccaggaccgggugacagaugaaagaagauuccuggagggaccauggcauauagugccacagaggacuagagagugacuaguaggcuuagagugccugguguuagacucuagaguccaugcaucugaggaaaaacagacuuaaaacaucaauccgagccugaccucucaggguagugcugugagggacggggccugggggaacaguggggccccaugaaaggcugggaaagacugguuuauucagguggcauucagguugugcgcaugcgugccagagcccaugggacuaagggagguguacacaaagcccucaauaaguuccccauuggcuacuggugacuucacuccugugucaacaccaccaugucugcagcuuccuggcuggccaggguuuauggagcgggaccgcgaccccgccugggcccccaccucacucguuccacacacuggcccacuguuagggucuugggggugguggcuguaucauuacauccuggugccuccugcucuuucacccaccucagagguccugggacaguucuuucccuccaggcaucccuggccagaggguaugcaggcccuaccucccucucccucuggaaaggagcuugaggcccuggggucacagaggccugcagucugugcaugugguuauggagccaaaaguacagcacagaacagaggcugggcgagaacccuaaagggacucuggggucucucucacaggggccagccauguagacuugccuucucugacccuaaguucuuguagaggggccacuugucagaaaaaucaucccaagagccauugugacaaccaucccugcccaccuggccuugucauuccccucagaguagggcaugcucuuugggaaaggguuauggugccuggugucagacucuggaguccauguaugaccagaacccugcuuaucccuccuacagauuaauaggcccaccgaaccccagcuacagagaggaguugaaguuuucgauucccaguguccacuuggauaauggugacgggggagggggggcucuccuccucuagagagcuacaguucccaaagugguggcuaacaccaggaguagguacguuuucugcagagccagcagcccaggacagcugaucaggcuagcuucgccuuuguuagcuaugccacucccacugccaccaccauugugggagcuccccguugggguucugcuuugcugcuccuuucccaggaaucuucugggaccagaaugggaugaguccacuugggccaagaauccuggcuuaccugaagcuaggauacuuucauaaggagguaaauauagacugggcuucccugaagcagugggaucuuuaggccagaacagcccuacuggcuaagggguaagagagaugggaaggagaagauccagguauccucuguccugccuccuccauagucccauguccaguggacuucaucaccagugagccaauacccacgagcccuuaaagggucacagcacaucugagugagagcagaaaggcaaaauggaggggagcaaugaggcccaaaggcacagagggagacugagcugacaaacugggagggagagcccucuggggcuaguaggaaggaaccuaccaauggucacuaaaucccaacucccauuggcugccuuucuguuccaacagcccuuccccaggagcgggccuuggauacaacuguccuuucacucccccucccuuuccccgcccuguggaguggucucuguuugugagagcuguuaaccuggcucugcccugcaugaaccccuccccucaccagagucagcaguguccccugcuagagggugaauggccucccucucccucgggucguggggcagaguacaugugugccaagagggggccccaugggccacguggcuguuugcaguucaugagaagcagcugagauaaaaagcuguuuucccagugggcaaggggccagagggggcugaggggggcgugggagucaaggccaggcuguagggcuuugugcaacccuggccucccccuccuacguguuuguaccugcaggagcgggggguugugcagcuacagagcaguccccacacgaggcugucagcucuccuagcuuucuauauuuucccuugaugccugaaagucccaaguaucguccuucaccauuaugaggugccaucauccaacugccuaacuaugacagaauguggucugagauuuggguaggcaaagcccuagccaagggacugccaaccuauacaagaucagggcaggggggcagugcuagagauaugugggccaaaacuugacaggcauagaaagagccaagauaauuagauuaagcguuuacaugaugcucaagucaaggguacaugcucaugaagggguccggggaacuggugaacucuccuggaaaagggacuucagaccuuaugccccccaccuaccuagauauggccucaggguaccuuuguuguguaaccaaaaggguguggggcuggaagaagacccccccaucucuauccaccugaccucacuaggcauggaaggguaguccuccaagagagaaguccuccaagaucucuuacccagcugguagugcucccaacucaucucacugaggcuccuuguggaagccuaggugggcccuagaaagagacuagcaagcagggauuuagguaccccuaugaaacagggagucugugugccccuuucauacaggccugugagucccauaacacaugccuuaucuauaucugaugccucaacucuauggccagugacuuucuggugucuuaagaagggugcaugugugcauguucacaugugccugaugggaucugugacagcuuccaaacccuaaucuggguacaccaaugaauagcucagaaauggacugccuugaauaugcagcaugcugguggcucguguuguuaacaaguagguguuccuuaugaugaaacuugagguccccacuuccagagagaaaaaaccauccuccuuuuacuaggguggcacuuucaaaauggcagcagagucuacagaacccagacucccauagcacucagugggugcaggcaaggcucuuauucauggaggugggaaugggugugaggacucuuagccuccccuggagccagggaaggaggcuaaacaguggcaggaggucaccauuguucuuuaagggcaguguccccauuccaugcaggaaaguugcagaaaauaggaaagggguaaacagggugccucugggaaaaguuccagaaaaagagacugugucagaaaggucgcaugcuucccaccagcccuaaccuucaguugaugagcccugacagucaccaguccauagaacaugagccauguuuccugguuuuauuuuucuuuagcuccagaagcccucaccuuccuacuccacuagcacagauguguucuuauuugcuuauuuugauuuugugagacaaucucauguagccuucaaaacucacuagguagcugaagauaaccuugaacuccuauucguccugcuucuaccucccaagugcuaggcauguccuccauaucuuguuugcguagaaccaaggauugaauucaagacuuggugccugcuaggcaagcauucuaucaacugagucauauccugauccuauuuuuaaacuuuaaaacuuaguguccaggcaagaucaggcagcucccauaguacaacaugaccuaguuaacaacuguuguuacguauguagcccaugcaggcaaagccacuugguguggccuggcugcucuguaccucuuggcuuugagacuuccauuccagauggggcaucuccauucacaaagauuuccauaaguuuaccuggggugccaugggagagugcacuagcuagggacaccacagaaacucuguagaugagaacuuaggguauggcagccuucugugccaguaagaggguguucuggauguuggauucccaccaccagaacauagaggcaaggcaaauuggaauacuggacacaguggauaggccucuaauaaaagggacuuaagagauaagucuggcauaccagcuccaccauguaccucacugaguuuucccucuccucuacagaagaggaaacugucuauagguccaaccauccucugacaucugacacugguacagguaaccaguggucccuaagcuucauagggcaaccaaaagauaguuccuaggaccagcuauggagcauuagaaaaaaagaggaggaacuuucuagaagguaaaauggucccacugcucggaucagcagaaacccagcccacagucccucccuagucaggaaauguaaacaggaauguaaaggguaaaguucuagggcacugaccgcagaacucaaacaggacaaagacccgaccccuggacaaacagugggucacggugcaaacuuaggcagggcaggagugccccucagcaucgugaguguagcccuacauugcuguccuugacuccguggccucugugggagaggcgaccgggagcuucugagaccagggagaacaugccaagucuacuaaccuuacuguggagaggagucccgcuuucccuaguacaugaaaccuuccuggggaaccaugguuucaaggugcucucuuccagccagcuucucacguucuaacgccaagcccccaauuccagaccucucuuuccagcuucaggaaacacgcaugguccuacuucuacuucuggggcccugugauaaugaggggacaguagaaaagagaguuuccuccauuccuguccuguugaacccaggacaggaacaggcaaaggaacuguuccauuacuacacucugcugucagucaaggaaguccccagaaaggagauacagauuugccucagagacacugaaacuggagaagacaagggaauauagagcggcggguguaaugcuaguccggcuuccagaucuuucuaacaacuaccuucaaagcucccaggccucaggccucaggggcacucuccucgaauauacuuccaaacucuuguucacacacuuucacaaguaccucuggcacauucugggugcucuauacugggaagagaaaaaacccaaccaaacaaacaaacaaacaaaaaaccagccguguuguaagauggcugugaccaucaugguccagacccacaaugggaugagaaggaugggcuagcuucugcuuaagagaagacaaucacagugcccuggaagaaaacucagauggcuggaaggacccauagucuagguauugccauaccuagaaagccucaggguucagguaggccuuaaauggggguuguaaagcucugcacacucaaguucagaagaaaagggauauuugcaggucucagagccucagcgaugcaggaagggacugccguauccaggagugaguagggaggggguuugggcuccuuugucacuccgagaaacucuacacagugcuucuuuuggaaucaagacccucuggaccuugagcugucucuaugaaugacuuaggagcaaaaguccaccuccaggaacccuggccaggcaaaagcaggccuuucuucuggu

SEQ ID NO: 20 - RNA, 28722 nt, Mus musculus
caaaaaggagagcuucggcauguguaaggcccgagggucacucuuucuuccauccugcuuaggccacaggcuccucaguggucccuugccuuucuuauaauguagaagaacacaggucucugggcccuuuccuccuagauagccuucuccccucuuugcuaggucuuccaagccccaggcaguaccuccugccuguucuugaauucagaggugcuugcuagauagggugaugcauauccaacaacaaguauccaggcaucccccagcaccgcuucugaucucucugauucuugacccauccagaugugagaaagcuuccauggaggccgcuguaaacugcucuugcuaccaugguugccccacugugacugacuacacucccuuaaaucuaagcccaaacaagcuucccuuccccaaguugcuucuugucaagcauuuggugacagcaacaucaaaaguaacuaguauauuuuauuugaccacuuuuuaggauucuuuucucacucuuuaaugaauuuuuaucacgguaggaguguucuccaauuagaaacacggcugacuugcuauuccaaauuuaacaaccauuuugcaccuuaacucuucuuucagaauccaccuguuuuggcucaucaucuggagaacccaggucuuuguuuguuuguuuguuuucugcagcucaggauuaauaguuucucucuacaagagugcugcuguuaggacuuugauaguuaaugcuggauguagaacccugcuaacuucagaaucaaaugggacuuuagcagccauggugcaacugagcugcuaagucugguacagaaacaaccauuacauuuagcugugagaaauuuggggaucuggguggauagguggcucagagcuuaagaacacugcugcuuuuuuagagggcucugauuugauucccauaacccccaugacagcucauagcugucuguaacuccaguuacaggggauuugaugcccuauucuggccucccugggcaccaggcacgcggguguuaugcagacauacaugcaggccaacacucagacacauaaauuauuaaaauucauuuaaaaaagacguuugagagugaccuugacgagcaugguagggggugagaugggagaccagguagcucaugugacgaugugauguaaaguaaggagacauggaugauggugugaauggaauacgacaaagucagguuguaaugguucaagugagaacuguccuccauagucauuugccccauaggcauuugaauacuuaguccacagccgguggcacuguuugaggagguuuaggcgggauagucuuacugaugaaaaauugagacaaaagccugguacuacuuccagucugcugucugugcuucaugcucauggcugaggaugugagcucucagcuuucccucuguggucaucaugucugcugguugcugccaugccucuacucugugauggacucguacccucuggagccauaagccaaaauaaacuuucuucugucaguugcuuuugaucaugguguuuuaucacagugacagaagagugacagagacacggguggugggugaugggcugccaggagacucaggaacaaagaucuucucuuagauucagggaaguuauuuugagcccuagccucuuuuggguuugcuuguuguugauguuuuuugagaaaggguuucucugugugguccuggcuugccuggaacucacucuguagacaaagcuggccuagaacucagagaucuuccugccucugcuuccugagugcuggaacugaaguuguguaccaccagagugaggugagcccuagccauuuaugcauguauuauuaacugggaauacuggaaauacauuuuggauuuuauuaaauauauuucugggacaucucuauuuuauacauuuugucuucccuuggccuauuuacaugaugauauuaaguggauuuuucacuaaugagucacccuugccuuccuggaagcugaugauccuuggccauaucauguuauuacuuuaacucaaccuacugccagacucaguuugcuaauuccuugauggguaacuuuuguaucuuucuucacaugugacuugaaacuguggguuuuccuuuuuugugcuaccaugauuggguuuggugucaggguuuuaugauaaacaucuucugugcuuuauaagucauagugauaauuuuagaguuuagaaaccugcccauaaaacuaugacacuuucucugagagaguuuauaacuuucagguagaagucuaguuguugacauuuuuagauuuuucuaggcccuccagaaaaagcuagauacuaaccuuauguuuuaauuaauaauuagauauaagauauaauaaacaaauaacaagguauaaacaauaauaaauuauuauauuauauauuguauuuaugauuaauauguuauauaaugauuauguauguuauauuauuguauauuauauuauucuaagauauaugaucuauuauauaucaugcauuauauauuauaugugacauacaucauauaauauauaguauacaguauuauaauaaauaaaaaauaauaagacauaaguaauaaacauaucacaacuccuacucuuggacagacuauagaaggaggauauaguacaaccagaaugagcacacacacuauggaaacggguacuuccauaaauuacagugucuuuacucuugucauucauucuacaccaagaccaucucagaugagaacucagguagaugcuuauggguguacagcugacacacccaugaaccuucccagucauuuuucucuccagcuauccuuucauacgcucauauacucacacaucuauccauuugccuuucuaaaccugucaaaacauucacacauucaugaguuuaucuaccauccauccaaccuuucacaauucgcauaucuauccaucuucaaccuaucuucuauccauccaucuaaccacuuacacaucauguaugugucuaucuauucacccacucacccaucaaaccaucagucuagucacacauucaugcaucuauccaucugccagucacccauauauugaugcauauauccauccauccauuuaucuauccuuucaucuauuuauaagccuauccaucaguuaauccaucuacucaccuauacauauauccacucacccaacucuauucacuccauccuugcaucuuuucauccaucaaucuaucugcaugaucaugccuguguccacccaucuauccuucuauuuacucaccacccacacauucuuguaucuauucauccauacauucauacaucccuauaucccaccccaccccauuuaugcaacccacauugaguucaugcucuucagcauguaccagucuagacauugaaagaucaguucuggaagauauaagccaagggcuggaagaucaauuugagauucaaaacugcccuagcaagauaaugucauugacagaauagaaacaauaugcuuuuguggaaugcagggacccaaagugcagaucugagggcccaauuccagaaugaguggcccuccagauccaacaggagggccauagguccucuuugaaccugggaaagguccaaagaggaccuugggagaggacaggacaaggcuuuguaaagugugagccuggcuaucuucucagccuggcuguccaucagguuuauaaagauguauuguguucuguuuccuaugaucaucuugaggaccagaaugaaauucugacaagaauggaauucuauccauccucaugguucuagggugcucuucugaguucugauaggaauuuuaacuaacaaggaaaggggaggggaggggaggggagggaaaaugaaaggaaaaggaaggggaaaagaaagggaaaaaggaaaggaaggggaaaaggaaaggaaaaaauggaaaggaaaggaaaaaaggaaaggaaaaagaggaaaggaaaaaaggaaaggagaaagggaaaggaaaaaggaaaggaaaaaaggaaaggaaaaaaggaaaggaaaggaaaggaaaggaaaggaaaggaaaggaaaggaaaggaaaggaaaggaaaggaaaggaaaggaaaggaaaaggaggaagguaggugguucucacaaaugggaagcaaugagaucccagauguaccggggagccugacuguucuuuguuagaucugggguugcaaaaccauuaaaggacuaguucaaccauggcaucagcuaccaacagcaccacugcagggacucugcucugcauuucuuugccucuuaccaggcuuuguagggaggcuccacgaguuuagcccacuuucaucuccugggcacuagcauaccuuuuaucacccuaguaugugucagaaagaagcuucuggaguugggccaggaaccucucuggggcgucacuggcacaggaagaugagagggugggcauauuguucucucuccuccuucuccuacucuuccacgcccaacucuguagagaaccaauuugccuuaucagaaaguccagcaagcggcuggcuaacaaaauaacuagaauuccugcuccaaggcacaucugguccugaucgaggggaggccagggauggcaggcaagggagggggggaaguagagguacugcucagacuuucccaaaagcaauccucuaggccagcaagaggagccugccaggcaggccaagggcagcccccaauggccuacagggcaggaggcaguacucuuugcuuacccuucaaccccaccagcagaugagcccaggccugcucuuuaugaggcugggaagggugggaagaacaccccacccuaguuagugcaaugguguuggugcuccucauauugugcuccucccaacuggagcaccgccccugcuccccacccaauccugccccuucugcuccaacuaucauuaccccacaaaccuuccccagcuccaaugcauccuuuauguacaccaucuuuccuaaacuuuaucugggugccuuggucucucccuaaaaacuaccuguugccacccagagccuuggcagguugaacuaagguucagagccaggacucaacccuggggcccuuugucuuccugauuguccuuucaaaaagacacucuuccagacuuccauauacagguccuccugcuccacccucuucagaugcaagggcagaaaauuucucaugguagagggaggucuuuuucaggcccagaugccauccuucugucuccucuguuggaacuuaucuuagggcccccuugacucagaggagccccuucuaugacccagacugguacagacacaggagaaugaaaacgaguguagacuagaauuuccuaggaggagugagagagugucugcuuuggggcugugauacgguucaacgaaaaggcuugccuaggcuuccugucucccaagaaagcaagagcaagugggaacccuguccuucuuucuuuauggccagagcccugaccacaggacuuccacaguucaagcaaccaaucccagccagcuccucagggguaguucauacuuucacaauggccaccagaaaauaccuggcuguucaucuguugacccccugaccgaggacauggugacagaagacauuccuguucuguaggcuucagggcaccauggaccuugagggaugaggagaugcaggaaggaggcuaguggacagguggucugagggccuauuggccuaggcaccagucucaugaaauggagguaagcuuuggcaccucagggcagaccuggggaucaacugcaccaugcuuucccuaccuucuuccucuguccaggauggauccagucugacugagcccuguacucuagacuccagauguauccuuccauugccccaggggagacagagccuccucugccuccuucacuuuccuugccacuucaccaggccuacaaacuccuuucugggggcgcccaguacucaggaugagggcaaggccagagccuaggccagugggggugcauagcagccaguguaaacagaucaguucugucugccuggggggagggugggggcagggagggaguugucuugggcuuuguuauguucugaaaaaaaaaaggcaaaaaauuugggucacaaaccacaaacuguuuugcuuucggcauaacuggcauaaacaggcauuuucucuuugguuucuggccggcagaggccuggguuggcuggggcugggagcgggagaggcugcaggcugcgcuaaugaggccucaggccucggcccagcagccagaagggggcugggcaggggcagggcucagcagagcagguagagagaccaggcuuggaggauacugucagcauggcacugccucuaaccccaaccugucuaugccuaggcaagagcuccugggagccaggccucagggacuggggagaccugaggacccugggugucaguacaccaaggcagguggaaacaaguguuuaaagaugagucugauccuacuccagggacuuaguccaagaguaagaggccagggaagacuaguacccaccccugaagaagauggacauggauaagccugggucucccaagagguuguccuggggugcccagaaggaccauuucuguggccagcucugcaagugaaagcuacagagaaauccaggcaaauucugggagaaccugaaagcagacgucuugcauaucucugcaucucuagggaacagggaaagggccccaacugcuaucuaaagaagaucagacauuuggggguucaguaaagaacugcccaggauagcagaaggcaugccaaggcaaucagggugaugccagauaccaaagggucugggagagaggacagccaccuuucaggacuggguguggggacacugagugagggaaccuaagagaugaaagaauugguaugugacaacugagauaugggccaauguuauaugcugaagaacccaaagcauagccagucucugaguuucacccaacaguccaugugagccacagauucuaaguggagaaagacaagaucuggacucaucacucugcucucaugaagaauaugacugggggugugugugguagagucugucuuauagguugugggcauggagauaagggguggaaagguuuuuaggauguccugggagaacaaaugggcaugaguggugccaauugaagccuauucucuuuauuccuagaggcuuuguggaauccauacaugugaaaugccauuguguacaggguacucaggauagacuuugugaaggaagggugcucggagcaggucucucacgggaagugguccagacagugcagcccuugcagggggucaaagguccccagauaucaggcguuugugacugggacaauuguuagggauaguagugguuggcuggguauaucaggguggcuucuggucaccacgaguugguuggcuuaucaagaagcaucuagcauguuccaagcagaagugggauggugucugguguuucacguaccaccacuugggagcugcugcaggaagguaaguggaacagguagggcaauggagauguggccuggcaggguuagaccacuaacuagaagcucuugcugugggaccuuccauacccagaccugugcuguacuauaacagaaugagggcacucuaguguaaucccuuuccuaaacaaccacaaacugggagcuucuacaaucguaacacauuucauuaaagaccgggagccuaauaucaaggugugccaaggccaugcuccuuuccaagacuccagauugugguccuuccuaacucuuccagcuuccaaggaccaccaggcauccucuggcuugugacuucauaacuccagucccugcuucugucuuugucuauaaauuuauuccauauguaaccuucucaggucucuugaggacaacuuucauuugaguuaggccuacccuaaauucaaaauaaugucauugcaaaguccuucuuuaauuuugaaggcccuucuuuucuuuaaauaaggucacauucauaggucccaguguccagagauaaauauguauuucuggaggacaucauucaacccagugaagagaugucuauaaguguuugcugaguggauagcaaugguuuuagauggcccauguguccugaccuuguuccagcucugacaucaucacuuacauuugucccuccugcugcugaaacccuaccccauuccaagugaugaugcucuaaugcucuaggucuaggcauguguaucccaccccuuacauguucuucucuauacuuucuacagucugugugucaucuucuuggugaggcccauucagcacuuccaucacacucacccagccccugaugaggcauccugaacauuauagaugcccacccacaugugugaauggggaagugauaggugaauggauaguggguggguaauggauagauagacagaugguggguggguggguggaugggugagcagguaggcagauggacaaauaggugacuuaaugagucaguggguagauaaaugaacaagucaugguggauggguggaugaauagaugguugagugguggguagauggauagauggguggguggaugaauaaaugaauggguguagaugaauugguagauugguagguagaugaaugagugaauagguggaugaauggguuggugagugaauuagaguauggguggguagaaugauggguagguggguaaacauauggcuagguagaugagagguuagguggaugaauagguugauaugggauguguggcugaauggacagguagaggaguugguggauagaugggagguggguugaggacaaauuggcagauagguaaguggcuugauggaugguuauauagcagacauauagaugcuauggauggguagguagauagauugauagguagaugaaugugugcauuaguggaugggggauagaugagagggugagugggugcauggguggcgaauggguaaaugggcaaggauagguggguggauguaggacauaggguggguagggcaauggauggguguacccugaguuuaaaagcagcccuuggauuuguaggcuguccugaagucccccuuuagcagaccagcagagacucuagagugcaaacaaaacuaaaagcuaaugcuaaccaguggcuugcaccuguauuuucagcacccagguaucuggggcaggauugagacugccaugaguuccaggccagcauggacauccauccaugugcaguuccaagcuugccugggguagagugugagacucuuuaucaaaaaacuagccaaacacaguaaaaagaaaugcuaguguguagcaauaacuggggaaaaggagcagggugccaggcacaagaucucagcgcugccccagccugggcuccucccacaggggaagggcaugugcccacuugcacuaggaaaagugggggacuaaggacuuguaaaggugcagaaagaagauacccaggccagguuucaagcaucuagggguuggccucacuuuacucccagugucagggaugccaaagaccacuaccauugggcaggugggucuaauaacuacuggggacagacucuagcauagccuuuauagagggaacaguagggaugacugcaugugcagggaaaccaucuuagguguuuucacccugaguccccauguccaucaccaaccacaaguccucacccaucuugcuccccaacucccaaggcuaagggcaauguucccugggguagguauucauggcucauccgaaaacaucaugggaccccuuuagcaccacagcaccccaucuuugaggacuuagggcaaauguccucuacccucuggguuccucagaguggcuuauugagcccuacuucuucucauacuucaaaggcuuuuccucuucaucugcugccccccaugucccccucccccacgcaucagguacccuuuacuccuccccucccucccuuugcccccucccccaaauaaaagagcaaagaacucaauaaauaguauuuuaaaugcuuuauuagguuugcgagcguuaacagguuaaaaacaaaacccaagcuuuggauuuugccagaaaaugcauguuagagggacugaguugaggcaaacaccuggggccacugcuggaugacauggacaguggcacaggugacauauggcguucgacgcgugggaagucuucacaugaugacaaagggagggacccaagaggggaucccacugaagacaguagggaagagacaagauggagggccacacuaggcauaggaggccagggaggugccugcaucaaggugaccuaugauggggagaacugcaaauguggggacacagaggguggucagcaaaugccccugaaagcacccaucccacgaggcauauuaacacuggguggguguccagccaaaugggcagguaauuuagggugccucgagauguuuuggauaccaggccaauucauagucuccaauuauaacaauuuacucuuugaguuucuguccaauguuccaaauggcccauucuuuaggcacuugcugagggacccucugugccaugcuuggcugacacacaccgcccccaggguggugccaguccugucaccugggcccagaagccucaggccucuagauugcuaguuggacuguugggcagggggacugcacuggaagcagaagugggggugagguaaaccuccagccgcccuguuccccgccgcaguccuaggcaccguggaguggcugcuacggcucgccagacccucaggccccagggcccagaugaccccguguauacaguucuccuggcucuguaggcuuuaagccuccuagcuuccccaacuccgggccucaccccaccuugcccccaggaggucuguagagcuccagaccuccugggggcaagguggggugcugaggagugggcaagaugacacugagggacgggagagguucucccccaaaugcucagaaggcagccacuugcucccgccugauguaaccugucuacucucacaucucuauccccuucccccccaacuggcaguggccagcugggagccccaucuuuuguggccuccgagcaccuuccuaacaccugaggggacacugccccacgcccccuccacuccucagaacuucuggggaccagccacuguccccagaagucaggccagguagcgaccuucucaauuccuuuuauuucucugugggugcguggccagcaccccacagagacuccacucccaacucaggccaagcgauagagagagauaaaaaaaaaaaucaagguuguggagagcaggacauugugguagccgguguugauggcucuagcugguguugauggcucgaugcauucauuaccugaucacugcucccguuauguagggaauggguacaauugauuaugagcgcauaaaaagcuaaggagggauuaaaaaaaaaaggaaaaaaccggccccagaaauaaaaagaggggaauagaucaauuggcauaaaauuugggguccuaauucuucaguaauucugcaaguugaccugugacuccuccugauucuuccaccuaaaaccucucugggaccacuuccuacccauagcuccccccacccagcccccacugccccccacccaccccuccaaccgccagacuucccacacuccccacaucagugugagucuccuggggagccccuaaaaagcgggggcuccccaggagacugacaaagauggcccauaggugugcucaggguagggguugucccccagaucuuuccucccaggagcacaacuaggggucagguuacuugggcagcauguaucacuuggcagugccaucuccuuaucuggccaaacuuauucuacacuggcuagucauugguccucauggcgggggugguuggggagcaccgggcucaccauguggacaggugcuuagauggaauugagccuugcuagaacaccucccucacugagaaagacagaacuagcagccuggucacacauagagccaauaagcagcagcagaaacuagauggauugggaggagagcucaaaccaugcaaacugcucaggaaauuugggaugggccuuguuuuggggaaugugguucaaaucgaaguuguucagccauuucaauguuuucauccaauuaugugggugugcauaccucugugugugugugugugugugugugugugugugugugcauauguguuauguguauguguguguuaaugccugugggugugaguauaaucaugugcuuuuuaggguagguagggaaaagugagauuuugggacugggggcuugugccaauuaaguucuauuuccaguuuucauguucuguucuucuccuuggguucuuucacccagcccccuuggugacaugggggacauuugugauggaaugaccagugaagaaagaguuugggcggcuauuguuguucucagccagcuuuacacuaaaggugcuugggauaaggagagggcacugaagcaaugacaugccaccugcaaaauuuuggguccccuuccuuucuucuuggguucugggauccaagucuuagccaauuugacuaaagauccaaauggaaagaagaugaaggggggggggcgccgaauuauuugauuuugccaauuguuuuuaagccaauuaauuuuuaguauguuuuuagccaauuaauuucuuuaguuauuuaauuuuuagauuaucaguuauggaauuucuuaaaagccaauuuguuuuuaaagggacuguaguuuuuaaaguuuuuuuuaaugugaauauauaauuuggggggugucaauuggguuguuuagagccaaucaaauuugguuuuuuagaacugcugagauccccuugcccgaugguguggggcaaggggaacagccugauguggggaggcggggcauggggguggguaaggagaaaccuggggagggaguggagcagagagaucuuagugugggacgugauggaacugucccugcucaagaggaggucacagauugaugguacuacauugcagaauuaccacauaauuugauucacugaugguugcuggacaucuccgaagaggcucccccgugggcggggucuuugggugguaacacgaucaggggacgaugacguuuggccucucugaacucuuugagcucuuuggcaagcaugcgaccccggcgggcacgcaggagggcaggcaggccucugcgcaggcgucccgcggacugucuccaggugucauauuggaagaacuugcccacgggguaucuggggaagucguccuggagaggaggugcuagucagcagguuucaggguaucauguuagccugagcucccaucuaggugucgcauauccccagccccacuagagucaccccaccucagggcaacuucccugaaauaucuauguuaaugagcagaggcugacaguaaaaugugugaggggggcuucgugguaccccaaaucaagaagugaguggucucuuugucucaccccauaauuccuucaaccccaccucgcuaccuaccggaaguacggccugagagguagacacgucccucucggacuuggcggggguggcacaguaugucuccaggagggccaggucgcagcugcggaagcagcacucuuccacgaugccacggcugcgacgguuggcacggcuugaaggccugccuggaaguuccacaggacagacaacuucaguuagugucuacuggggucagcacccauugggguggccaccccagccccgccccccaggaggggaaggcugaagaaggaacuaccccugcccuuccacuagacccuggccggauacuaggucacccugcagggaugugguagaagugugagccagacaggccaagaugcccagaaaggaaaaauaaaggugcaugcugcaggaccagccccuggcaucuggugccuccugucugguaacuaacacagcacagcuucacugucccacagacuccauggagaccagaggccacacuggagugguuuggaaaacagggaggaggagggggugagccccucgagggggccaugguggacacagguguggucccuguacuuggggcccguccugaggggcccacccccaacccccaucgcugaacugugacaggaagggaagauagggcaggagagaacaagacgggaggggaggagugaggcacccaaaaaccacucccuucucuucucccgucuucccccucucccccacgguccgagguugggcuuggggcccuccuaucugugaagccccuccgugcaggaguggcucucgaccaaggacugguccugcaguacccaugagcaguaguuguuuccagagcaguucacaggcagguaggcagaagugaagaagaagaggcugcguguccaggaccaggcgaggaagauagaguggcccaugccagcaaggauagucauccauucuggugccccugccccucccaggcaugccccacccauguguccccaucacugccuucugugagcagugagcccaugcccagccccuuccccaacugggaaaucaagagaagcaugaacauugaaagcaggcaagcaccccauguuguaguccugggaaccccucaaguuggauggccaagguccagcucuccccuuguacccccaaacuacacgugcacucucaaccuggcugagacuugacauccacauuugguuuugcuuuuaucaacuuuaaaaacuuuuaaaacuaucagacuugugacuuugagauuacgaccuugcccgggggggggggggaagggguagcuuaagagcaaggccagaccaguguacuaauugucaccccauccagggaggcuugcuucccccgcccccaccucucuggaguuacauacugaaguagaagccgcgguccgaacagacaaacugaagcgugucaacaagcuccccuccgcacagagucucuccggggccguaagcagcgaugcagcacaaggcgaaggccaaagagaugagaagcaccaacaucgacuuccccacugggauccccauugguaccuggagaaagaaacgcaggcuuugagcuagaggcccccaagccacaccccuaaucccaggagaauggcucacccccacccaggccccaccaaagacaccuaucaucucuuaauuaaaaaugcaauuggaaucugaaagacagccaugucacuauuuauuuaaccugugaaaacagggggacuugaauugcugaggucaaaaacuacuuugaguguggagaaauucaauggaccccaggaaggcaccccgugguggcuuugaacuguaagaaacccuugaggaccacccauccaugggcgcaauugcagcuuaaccacacccacagcagcaggggccagugcuggacacuggaccugguuuccaugcuaugacaucauggggguggggccagcccaagggcacaucacuacugccacuccuacucuggccuccaagcauuggccaagauggcagauagcuccaccccacccaccauggagcaugugcauccaaagggaccauucccaaccuacccgccccccagcuggccaccccucccuaagcagcagagccagccccacccauccaccccaccucccaggccauggugagcagggcccaugucagaauccaaugguuagcgcaaugggauagccagcacuccugugagccuugcucuccagggucacccaguccuccaaguauagacuuuccugggcaccucagagcuugccauccauggucagggacccuagagggucccuuuauggcccauagaaucaucuuucugauaagagcuaaauuuacccagggcagcaguuuggguccuugggaggcuaaacaccccauuuuggagggacacacccccuccacaggcuauguggcuacaggcggggacaaugguuagcuagcuuuuuuaguggugggaggccacgaugacccacaguaagccacccuugacccuucaguuaaguagagcccuccaggccgcagccucaaucucugcuccauaggcccaggggauuucuugcugcaaagaaacaugugagagaccagugcggaauaaucaagaaacaaauuuguucgagcucccuuggguaacuaaaagucaucuuugcccacuucaucaagacccagaccgauccucccaauacccucugugccaccaaccacuugcgaucagcaggcuauagcuacagcaguuaguucugggggcggggggcaggcagacggagcugaccucgaagucccuucccaaagccaagaccacacuggcugguucagcccagguguccaggagaagcaagcaggagauugaccaggaggcaagggacaggugagggcccagggaaggcccgaauuuguuggaguggggaggcagagaggaaggaaaaguagaggacugggcagguaaggaagccuggaucuaguggggggcauaggacagaggcugagggagaacgaaggcuugggagagguagcaggcccggcugcaagggcagaggccucaggcuacccggugcccugaccaccccacugggcaagccggaguggggauggcagcaggguccuggcuccacagcccugguuaccugaaguuggguaaggaggccgcuggggcuggaagaggaugaagacaggaaaaggcuggaagguucucacaggagaagcuaauguccaguuugcgaacuggucagugccuccgcuuuuuaugucugaguggcuccucccagucccggcuccacccuaccccccacccccucccugcugaccacuccccccgcccccuuugcacccgcccccucccuccuuccagccagucccuuuucuccugcacccccaagagcuagccuuggaccauuccuuagcaaagcaccaccagugggaggggggccucaucgugcgcccccagcccuuucugcacagaccaauggggggagggagggggcuccuucccacauccuccuauggaaaguuacacccaguaaaaggcaggggcaguuauuucucuuugaacuguaacauuucugcccuucugagcccgaaaccguccccucuccccccaacauuccagguugggaauguuggggacagaguugggguguguggguggggggaaaagcuaacuguggggucuggcuugacucuuuuaccaauuuuggggggcucuuggccccgcccacccacuuuuccuuccugucucauuggcacaaagucaacauaccagggugggcuucggagacucugccccccuccucaucacucagcacccuuggggggggguguacagggccugcacagcacgaaucguacauuuuaugcagcucauccaucccccccuuccccaacacacaguaaagcaccaggaagucuccugugaguucaacuuacacacccccuccccaacagcccccauacccccgccccuucccccacuccauggcgcaagggggaacaaaaguuugcuuagggaacgagcccccagccccccacccaccgcaccagucccgccaugcccaagccgggcucugcgcaccccccacucccagggccccugagagcccuuaccuggaagccggcgacgcugccgcccaucucccugcugcggguaugcaaaccgaacagcgggcgaaggcccuucugccgggcacuccucugccagcgccgcucugcccgagucgcagaggccgaaugugcgacgggacagaacggggagauggcuuuuuugguggggaggggggcgucucuucugcuucuuuaggguaucuuagggcuggggcgggccagauauuguacuuucgggggggaaaagguaucgggaaaugaggucagcuguuguaucaaggauaguuggggggcagagauagugagagagacagagugaacgugaaagggggggaccacagagagggagagagggagagaggacagcgagaggcggguaggcucacagcgggagaggacagcacggagagaaacagaaagcguauaauuaauccacuuggguaggcgaaggcagagggcggacgugagggggagggagucugaggcgaggaggaacggggagggggcaggaggggagcuuaggaaagguggcggguaagcgggugcgcgagggggggcgcacccuaagcagaggagaggaugcaacuucgaaggaccgaggacgguguugaggggggaggaauggaggcgucaccccggccacgggcacccagcucgguuagggucgacggagcccucagccgucguaagcccgggcuucuugugggggggacaggcguggcggcgccucagcugcucgggacugcagcgaaaagaggggagcagccgggcugcgcaccggggagggcugggaggggaagcgcgggggaugacaacgccggcgaccugcaagccggacugccugcgguggggaccgccuccucuggcgaagcaggaaugggguguugagguagauagaggaggaggcgguggggagauccgcaggcccgacggagcgcggccccgccgacggcgcccugcacaggaguuagcagcagcgagguggcggacggcgucgacgcggggccgccagcccggauggaggcgcuggcgggccgagcgcgggcgggcgugggccaggaggcgggggcggccggaagggggggccgggggccggccuggccucacgcagcuccgccggagagcaggcgaacuccgggcgccaacgcccgguucuuauagccgcgccaccccgcggcucggcgcccgcucgggccccgcuggccuuacgcccgcgccaaugggcguccgcagggcccucgccccgccccgggaccgcccccgcaacucgagccacgcggggaaugcgggucgggggcccugggcacggggguugccgguggggggggggaguggagugccugguggcaaagaugggggggggcugugcgccccaacaggcccacuaaauccugggugucuaucccuaaaaaucgaggucccaugucauguuuccggggugcccugugcuugugcaacaugggcgcguggugcgaaccaacgugcguggcacccuaggccucagugguaguggcaggaccugugcucaguuagaggguuacaagguaggcgcaucccggccgacugaguuaaggcgcagguagcuggguagaggguucucacagggaccuacuugcuaagcaggggacaguccccuggaucggcugggggggggggggggagcgcgcagccuccaccugccugagcaggcagggcgggcugugaggcaccucgaauagcagccagauagaucuuacuaagcgccccuaaccucugcuuugccugggaucuccuagcagccuuuggggggccaccaggugcaccaugaagggaaggcuggcuuggccacgccaaaucugggccccgcguggagcccccgcacaaugucugcgcccuucagcagaaaaagaagcagggcgggaaacguagcucaaaccagaccuguaaaccagagcucacugaagugcuucuaagcggcgcgccuuugggaccccacccaguaugagcagauaacaguucccuguccucagcacuuugaauuugcuuaguugcagguucggccccaggggccaaugcgauaauuccgggcuauuaagaaacucuccccgggugguuucagauauaagaagccauugugauuuuuaccaagucaaaaucacuucuaaaccggugcaccuuguuucccucucccgaccuccgcaccucuaggccucuaaagggccacuacuggcggaaaccagugcacccggggcuaaccucccggcccgaccaucaaucaccgcgcccgcgcucuacacucgcuuccccaagcccucgaccuguaggguuggaggcuccaagccgcccgagcgcucugcccuucccgcuuccuggccgcccaggcgcuuucccuaccaccgcguuguuugcagagugcacacaaaguggcgcgcguuucggagcgcccagcccaaaggagcgcugccgccgagggagaagccagcagcccgcucccgcgcuacuccgcagcagcccugaggacaaacugcgagguagccggugccccgcaguggaagagcuggggcacgagggagcgcgccacggggagcucaccacaaggccgaaggucggguccgcuggcgcaggaggaucggaggagaagggcgggagagcggaugaagugggagcugcugaaguggacgcugcugaaggugagcgagaccccaagggcaguccccagugaaccggggcaacgcccaguccguuggaagacccggggacaaugcccaaauuugggggaaacugggggcaaugcccagucguuuuccuggacacgggagcaacacugcccacguccuggccgccgcgcaguguccagugcguguuuggggcacacacacuuuuccaaaaucugugcugccgcugggacaccguaggagaagugacgaggccgauaccacuguuaugcgcaggacgggaagcugccgaaaguggccagcggaaacaaugaucaaauuucggggaucccaagucagacccuugucugauuugcgguccugggaaugagcggcccaaaguagggggacucgaaggcgacuccauaaaugggaaaacuguggcgaaugacuaaauuugagauuccagaaaaauuagaauccaaguuggggaaugaggaaaauuauucuaugcaaaaauggggggcaucuugauccaggccuaacgaggggaacccaauaucuugguuagaaagcuuggggaacccacaaaauccuagacuaauuuguagaaguuaggugguuuguuguugcuguuggguuuaagaaaauucccaacaugaaauuuaggggagcuuaauuuuaauugcuuaaaaaugggagaugaaaaacaacagauggauuuuagggaauucaggucaguucuuuugaggggugggaguggagacuaggguucacccugaagccagugggcccuacaacacccgggaaaaaucaccucuaauuucuguggcuucagagaaguccucuagagaaugaggaaaugcugucuaaaugugguggaauuagaaaugcaagaaguccauuugagaaagccagaaaaaaucaaugucuuuuaauauuuuaauuuccuaaacagauuccuauugaucuuuuuguugaacaagggggaguuuguauguuuucuuggacaauguuuguucuuggagaaacauacucccuguuuuguggaucaauaaaaauuacccaauggaugaugaaaucuaaauugcagggaauagaauuaguagcuaggaaauuuguaagacacagaccuuuaaaaccuaggaauugggggaucugggacuuuuuuuuucagugugcuuuggggaccauaaaacauuauccaaauauagggagacuccaguagaagucauaaauucaacaaaguucauuaaaguuuaauaaaaaccgaacucuuuggaagaaaaaaaucucaauuuguuuuggaguaccugaauuugggggggcccaggaagauaauuucugaaucuaaaguuuccugguccuucagggccagucucuacauuacaaggaauagagauuauggguuccuaaauuauggggccugagaaccaaucccccaaauuugcaaucugcagagauugugcaagauagugugugugugugugugggggggguguguuugaaauguaggggggcugaguggguguauagcugguauugcagugggagaaaucagaaccuuuuugugacccaaggcuaacacuaaguguguuuuggggggccuggaaaauauugccuaauguuugaggacaccaggcaugagccaacacgggggaugaaaaggauacaggaugguacuggauuuugcaauuggugucugaguuaaaaaaaauuuuuuuuuccaaauuguuaaguuaaagggacccagauuugaugcagaaaaaaaugaucaguguucaaggauuggagacauucaacauucuaauauaaagaaaaaggacuuggccaagaguuaauuuugugccaucugugacccagaaagacauggaacagucauauaagacuugggauagcauggaaagcccucugccacauagaaguucaugccuuacaucauugcucagccugcuuugggggcuuuagugagagaguuuauauuuuauauuuuaaagaacccuaaccauggccagaaugcuugcaggagcucuagggagccccaaagccuugugaccaguguguauucguggaauuuuuugggggggggucuuguuaagugaauuuuagaugugauuggugaauguacucuuuccauuuucuggaauccgagaaaugagagugagggcuauuugaggugucuacauuuaggggaggacauagaaaaaaagguugggacuuugaaggugccaggaaaauuguuaaagcugucugggugggauucaacuuguaaaauuuggaguuagggcaauagacuacagaaucuaguguuccacguuaauaaaaccagaggacggguggcgggggaagagagucagcaggaacauuacugcagauauaaaaugauaggaacauggggaaaacaccccgcuaccucauccccuggagacagugccuaaaugcugucaaaauguccgcucucccaaguaaggaaauuuugucaaaaggacuaaggacccaggcuuacuuuaaauuuuagggaacugagaauggugguuuuauaucuauauauaggagcuugcauuuaaaaugguuaggagccagaagcaaacuugggggcccaagccaaaauauucuaauugugaggagucagcagaggcagaauucccacccuuuaaaauauuuggaaagcaaguaucaaaaacaaaacaaaacaaaacaaaauaaaaaccaaacaacaacaacaacaaaaccuuuucccugugaacagaacaaaugcugaccgauuuuggagcccccacccccaccccccaaagcaaugcuuaaauuucaaggaucucagucaaacuaaguccugagguucagagaagccgguaaguuccucggguuguagggggaccacagagaacuagagcugaauuugagaaagugagcucccgggccgggaaggacagggcgccaggauccgcggugccaaggaacucacacggagcaggggcgcccucacgggggaacccagacgcgggaaaggggcacaggcgacgcagauugggagcacggacgccacagagcgcgcgcccgagccagcuucauuuuucguucuuucgccuucuagccaacgagaggguuuggguagcagaggccgagcgggacgggcgucggagagggaggcggaacgucggggagcagcgcgcugcuccccgaggcuccuuagguuccggcgccccgcucggcuccccgccgccccugcgccccacgcgcucagacgccgcgagccuaggcgaagucggggccaggcagccgccgggggcagacucgucccuagcucaguuuuggggcccggggcacccccaguggcuacccuugaccgccccugugcuaacacacgccuauccggccguguccgcucccuaacgaugaacaauguaggaaauaguuuuguuugggcacuguggaaaguggguaaaaaaugggggagcagaggagaaaguggggggaaagagcauagcagaaugauacaguggugaccguugccggaugcuagaacccucauuucguuuucucagaaaauuucugccacuagccucccaauccuagcuggggaaaguccagcuccuuaaaggcaaauauuaaacccacacaccauacacaggcucaccguacuguugcugggaacaaggccacccccucaaaguugagcaaugcuggaggugaagggccaugauucuagcaggaccuggggggugggggugggguguuagauaggggagcagcuggagagcaggagaaugaggaaaacccuggggccaugacuguaagcauggcuugccucuauaaccacccguagaggaugguaugcagggaggacucucaaagccuaacgcucuggggaggcaggaguuaaagucaguggacagguguggggaccuagacagggcgaggcaucuccauauuaucuuggcaggacugagagagcccccaccccacccauuuuccacccggagcaugaagcacguggggaauguuccccuuucaaauuccagucugcaucaaucacccccgugucccauuccaagaacaucuggccugucuccccccacccacacccaugcugccccccuccccccauccaccagccucuaucccuggcuuuucuggccucuccgaguuugugccuauagauuugaggaagcuuccagcuaggaagaccgguauggugauguuccucauuccagggagacuuguaaauuuguugggaguaaggagcauuaaaaagguguuugagaacaccucuaguccuugugaggccagauuaggcugcaagcccucugcuaagggucuccuuuagagaaaaaaaaaauggcaagggccggcagagggguucucuaccuuuccccaagaaggggcacaggccagagaugagcaagguucugggaacagagucccgauucuggaguccugccuuccuuuuccuaaggggcaucugagagggcagcaaucacaaccuguggccuguuucagagccuaaucucugcuuucugcccuccagaggucucuggagaagccgcugacucacaccccggagaugaacuccuggacuuugccagguaggaaaacgcugaggucaccuuaagguguccauugaagagccaccagggcaugcaggcgggauagggugggggccaggguaugcauguguucuucuuccucuauguggcugcccacagagccuucaccugaccuuauuuagucaaaguguggcucaaggggcagggaagagccugguacaguuccgggucaaccuagggcucaaaagcacacagccuacccccagcuaggaucagcgacagauucuuucucuaaggcccucuccuuuuccuuauuuuugccuacccucuccccccuacaagguagaaaggggccuaccuugcaugcauggggucuauuguuucuucuagauagggccuggcccacuagacuuuagcccugugcugaucccaauccuugcccuccccugcucugccccaccaccgaggcagccuaggucuccuuucugggcuuaaaagcucaaauucugaagaaacuaaauauccuuuaagauucagacuuacccacuaagccuggcuggcacccucagccagggccucugcuugucuccccucucucccuccaggcaguggggcuuccuuauccccccgugugacuuuuccuagcuuguuguagucuccgggcuaacugcucaggaauaagccaagacuuuuacacacccuacuucucuccgaggguccccagcaugcucuuccucaugccugugcuggaugccugccacagaggacacacucaacugggcugcggucuuggacaccacauagggacuccacaccaggaagacccaagcaaugcucuaugccaaucugcaagccugggaagaagucacuaccugaaccaccaacaugaggauugcaccaaacugaucaacacaacccacaccaaaaguaaguaaggguugcugugggggcacuggagaggggucagcagggaaggccaguguccugggucuggauagacugaagccauaccacuauguaauuguuuuagugucugaaccaacauuugaaagaagauucuuggcuucuuucuggcaugagcaugauauccuggaagagggguggaauucaccugcugggaagccugugccauuugaggcuuaggcacaaggacacagaccuacaugcugccccccagucuccaguauuccaccagacacagccucuaccucccuggucccuacccaguaccugaccagugaacugcagggccaccaaacagcagagcuuccucggcagaguccacagugcuucuggccccgugcccucucuagcugcuucccaccccauucacacacaggaaacccauggccuucagaacacaauagaauuaggacacacacucuccuaaggcccuucacagcucucagaaugucucuuugguuguuaugucauuugcuguucacaguucagccaggaagccugagacugucacacacuuugacaaauggggauagacacagagaggucaagccacuggugcaggagcaccacagcuguaaaugcauagucaggggaagggggaacaggaacccucacacacagcuuuccuuggccuccagauucuuuuuagcuaacaguuuguuuuucuuuuuucuuuccuuagauucuuuccucaucuggaacccugccuuucccucuggagcugucugaccuccccccuuccccagcauuugcuaccuuugccccuggacuccuggaagcauuacagagacugcugccucgugucugcuuggcuuacaccccuuguucccaagaagugacaccuggagcgcaccugaaucccagauacugugacugacuagacuuccuagccuuggcugguuccuuggcugagucuugcauuugcaggagcucugaugcuccugugcuagagauaccucuguucugcuguauaccugaaggacacucaccucugaggaaagacuggggcuggugggagguuucugagguuucauucaguucugggagcguggggaucuccugggccacaggccacagcacuugggcacggggcuggagucucgggaugcucuagccuguuucuucucagguuccggcucaggcuucagcucgggcucaggcucaggcucaggcuucagcucaggccucgguggcagaggccucggcucgggccuugguggcagaggccucgacucgggccuugguggcagaggccucagcucgggccuugguggcagaggccucagcucgggccucgguggcacgggccucggcucaggccucaguagcagaggucucagcucaggccuugguggcacgggccucggcucagaccucaguagcagaggucucagcucaggccucgguggcagaggccucggcucaggccuaggugguacaggccucggcucaggccuaggugguacaggccuuggcucaggccuagguggcacaggccucggcucaggcuuugguggcucaggccucggcucaggcuuugguggcucaggccucggcucaggcuuugguggcucaggccucggcucaggcuuagguggcucaggccugggcucaggcuuagguggcucaggccucggcucaggccuugguggcacaggccuggacuuaggcuucugcagcucuggcuggacgagaaguuuagccuuaggagacucagaacccuggguuaggggccugcagucgucguagucguucuccucuuccuccuccuccucuugcacagugagcucuguuuuaauuacucguccccugaggaggagaagcaaaaauccuugagauuaucucaaaaacaaaucuucuccagcugagucuggcccccuccccccaccuugcugcuggauggggaagcccaagggucaccuugucaugguuggagcacuccccccuacccugucccuucagcugccuacucuccccacccccuucucaguagaagggaggaagcaguuggugagaagucacuuugccaaguuugacaacuguucagggagaggcaggagacccuccuuugggaaggacaaucuggcuccugccuggcugggggcgggggugguggugguguaaaacugcugcugcacacaaaaggcuuucuuugaggggucacagcuaaaaaugugaaugucucccauuccucuccucacacuucuaccuuggaugggaacaaaaaacaaagggcacauggaucugccuuaggaaggcaacuucuggaagggguggcagggcuucuccccauaaacauuauaccgguggauuaaggagucugggaucccaguugcagggaaaaaaagcuuugugcacaaaugaaugugcaacugggagugcuguggcugcugcuccaaauuccugccugugcacagggaacacggaggggggggggggagggggaguuaaagacagacacagccaggagaaaagcaguuuuuguacuuaaacccugcuagggaauagcaaggcacaucauccuaucuaucuacccuccaguauccuggugguaguuaggagguacaggauauaaaaacagggaaacuuugcuuuuaaaauuuuauauauauauauauauauauauacauacaucuacauaauauauauguauaauaauaauacacacccccacacugcucuagaaucucuggccccucugcacaguuuagccgggaguggggugggggugggggggaggagcggggggagcauacaccagggggaaaauguucacacagaaaaauuucacauuugcaaaaacagcuguguacuccugcugggaagagaaagagcgcugccucuccccuuugcaugguagauuagagaacgaaaccauacuuuccuuguagcuuugugcagcccuuuaagucccagucccaguuguccuuuuguccccucagaaguugaagucacucuuaagaccguccgguuuagcggcaaccu

SEQ ID NO: 21 - RNA, 28722 nt, Mus musculus
agguugccgcuaaaccggacggucuuaagagugacuucaacuucugaggggacaaaaggacaacugggacugggacuuaaagggcugcacaaagcuacaaggaaaguaugguuucguucucuaaucuaccaugcaaaggggagaggcagcgcucuuucucuucccagcaggaguacacagcuguuuuugcaaaugugaaauuuuucugugugaacauuuucccccugguguaugcuccccccgcuccucccccccacccccaccccacucccggcuaaacugugcagaggggccagagauucuagagcaguguggggguguguauuauuauuauacauauauauuauguagauguauguauauauauauauauauauauauaaaauuuuaaaagcaaaguuucccuguuuuuauauccuguaccuccuaacuaccaccaggauacuggaggguagauagauaggaugaugugccuugcuauucccuagcaggguuuaaguacaaaaacugcuuuucuccuggcugugucugucuuuaacucccccuccccccccccccuccguguucccugugcacaggcaggaauuuggagcagcagccacagcacucccaguugcacauucauuugugcacaaagcuuuuuuucccugcaacugggaucccagacuccuuaauccaccgguauaauguuuauggggagaagcccugccaccccuuccagaaguugccuuccuaaggcagauccaugugcccuuuguuuuuuguucccauccaagguagaagugugaggagaggaaugggagacauucacauuuuuagcugugaccccucaaagaaagccuuuugugugcagcagcaguuuuacaccaccaccacccccgcccccagccaggcaggagccagauuguccuucccaaaggagggucuccugccucucccugaacaguugucaaacuuggcaaagugacuucucaccaacugcuuccucccuucuacugagaaggggguggggagaguaggcagcugaagggacaggguaggggggagugcuccaaccaugacaaggugacccuugggcuuccccauccagcagcaagguggggggagggggccagacucagcuggagaagauuuguuuuugagauaaucucaaggauuuuugcuucuccuccucaggggacgaguaauuaaaacagagcucacugugcaagaggaggaggaggaagaggagaacgacuacgacgacugcaggccccuaacccaggguucugagucuccuaaggcuaaacuucucguccagccagagcugcagaagccuaaguccaggccugugccaccaaggccugagccgaggccugagccaccuaagccugagcccaggccugagccaccuaagccugagccgaggccugagccaccaaagccugagccgaggccugagccaccaaagccugagccgaggccugagccaccaaagccugagccgaggccugugccaccuaggccugagccaaggccuguaccaccuaggccugagccgaggccuguaccaccuaggccugagccgaggccucugccaccgaggccugagcugagaccucugcuacugaggucugagccgaggcccgugccaccaaggccugagcugagaccucugcuacugaggccugagccgaggcccgugccaccgaggcccgagcugaggccucugccaccaaggcccgagcugaggccucugccaccaaggcccgagucgaggccucugccaccaaggcccgagccgaggccucugccaccgaggccugagcugaagccugagccugagccugagcccgagcugaagccugagccggaaccugagaagaaacaggcuagagcaucccgagacuccagccccgugcccaagugcuguggccuguggcccaggagauccccacgcucccagaacugaaugaaaccucagaaaccucccaccagccccagucuuuccucagaggugaguguccuucagguauacagcagaacagagguaucucuagcacaggagcaucagagcuccugcaaaugcaagacucagccaaggaaccagccaaggcuaggaagucuagucagucacaguaucugggauucaggugcgcuccaggugucacuucuugggaacaagggguguaagccaagcagacacgaggcagcagucucuguaaugcuuccaggaguccaggggcaaagguagcaaaugcuggggaaggggggaggucagacagcuccagagggaaaggcaggguuccagaugaggaaagaaucuaaggaaagaaaaaagaaaaacaaacuguuagcuaaaaagaaucuggaggccaaggaaagcugugugugaggguuccuguucccccuuccccugacuaugcauuuacagcuguggugcuccugcaccaguggcuugaccucucugugucuauccccauuugucaaagugugugacagucucaggcuuccuggcugaacugugaacagcaaaugacauaacaaccaaagagacauucugagagcugugaagggccuuaggagaguguguguccuaauucuauuguguucugaaggccauggguuuccugugugugaauggggugggaagcagcuagagagggcacggggccagaagcacuguggacucugccgaggaagcucugcuguuugguggcccugcaguucacuggucagguacuggguagggaccagggagguagaggcugugucugguggaauacuggagacuggggggcagcauguaggucuguguccuugugccuaagccucaaauggcacaggcuucccagcaggugaauuccaccccucuuccaggauaucaugcucaugccagaaagaagccaagaaucuucuuucaaauguugguucagacacuaaaacaauuacauagugguauggcuucagucuauccagacccaggacacuggccuucccugcugaccccucuccagugcccccacagcaacccuuacuuacuuuugguguggguuguguugaucaguuuggugcaauccucauguuggugguucagguagugacuucuucccaggcuugcagauuggcauagagcauugcuugggucuuccugguguggagucccuaugugguguccaagaccgcagcccaguugaguguguccucuguggcaggcauccagcacaggcaugaggaagagcaugcuggggacccucggagagaaguaggguguguaaaagucuuggcuuauuccugagcaguuagcccggagacuacaacaagcuaggaaaagucacacggggggauaaggaagccccacugccuggagggagagaggggagacaagcagaggcccuggcugagggugccagccaggcuuaguggguaagucugaaucuuaaaggauauuuaguuucuucagaauuugagcuuuuaagcccagaaaggagaccuaggcugccucggugguggggcagagcaggggagggcaaggauugggaucagcacagggcuaaagucuagugggccaggcccuaucuagaagaaacaauagaccccaugcaugcaagguaggccccuuucuaccuuguaggggggagaggguaggcaaaaauaaggaaaaggagagggccuuagagaaagaaucugucgcugauccuagcuggggguaggcugugugcuuuugagcccuagguugacccggaacuguaccaggcucuucccugccccuugagccacacuuugacuaaauaaggucaggugaaggcucugugggcagccacauagaggaagaagaacacaugcauacccuggcccccacccuaucccgccugcaugcccugguggcucuucaauggacaccuuaaggugaccucagcguuuuccuaccuggcaaaguccaggaguucaucuccggggugugagucagcggcuucuccagagaccucuggagggcagaaagcagagauuaggcucugaaacaggccacagguugugauugcugcccucucagaugccccuuaggaaaaggaaggcaggacuccagaaucgggacucuguucccagaaccuugcucaucucuggccugugccccuucuuggggaaagguagagaaccccucugccggcccuugccauuuuuuuuuucucuaaaggagacccuuagcagagggcuugcagccuaaucuggccucacaaggacuagagguguucucaaacaccuuuuuaaugcuccuuacucccaacaaauuuacaagucucccuggaaugaggaacaucaccauaccggucuuccuagcuggaagcuuccucaaaucuauaggcacaaacucggagaggccagaaaagccagggauagaggcugguggauggggggaggggggcagcauggguguggguggggggagacaggccagauguucuuggaaugggacacgggggugauugaugcagacuggaauuugaaaggggaacauuccccacgugcuucaugcuccggguggaaaauggguggggugggggcucucucaguccugccaagauaauauggagaugccucgcccugucuagguccccacaccuguccacugacuuuaacuccugccuccccagagcguuaggcuuugagaguccucccugcauaccauccucuacgggugguuauagaggcaagccaugcuuacagucauggccccaggguuuuccucauucuccugcucuccagcugcuccccuaucuaacaccccacccccaccccccagguccugcuagaaucauggcccuucaccuccagcauugcucaacuuugaggggguggccuuguucccagcaacaguacggugagccuguguaugguguguggguuuaauauuugccuuuaaggagcuggacuuuccccagcuaggauugggaggcuaguggcagaaauuuucugagaaaacgaaaugaggguucuagcauccggcaacggucaccacuguaucauucugcuaugcucuuuccccccacuuucuccucugcucccccauuuuuuacccacuuuccacagugcccaaacaaaacuauuuccuacauuguucaucguuagggagcggacacggccggauaggcguguguuagcacaggggcggucaaggguagccacugggggugccccgggccccaaaacugagcuagggacgagucugcccccggcggcugccuggccccgacuucgccuaggcucgcggcgucugagcgcguggggcgcaggggcggcggggagccgagcggggcgccggaaccuaaggagccucggggagcagcgcgcugcuccccgacguuccgccucccucuccgacgcccgucccgcucggccucugcuacccaaacccucucguuggcuagaaggcgaaagaacgaaaaaugaagcuggcucgggcgcgcgcucuguggcguccgugcucccaaucugcgucgccugugccccuuucccgcgucuggguucccccgugagggcgccccugcuccgugugaguuccuuggcaccgcggauccuggcgcccuguccuucccggcccgggagcucacuuucucaaauucagcucuaguucucuguggucccccuacaacccgaggaacuuaccggcuucucugaaccucaggacuuaguuugacugagauccuugaaauuuaagcauugcuuuggggggugggggugggggcuccaaaaucggucagcauuuguucuguucacagggaaaagguuuuguuguuguuguuguuugguuuuuauuuuguuuuguuuuguuuuguuuuugauacuugcuuuccaaauauuuuaaagggugggaauucugccucugcugacuccucacaauuagaauauuuuggcuugggcccccaaguuugcuucuggcuccuaaccauuuuaaaugcaagcuccuauauauagauauaaaaccaccauucucaguucccuaaaauuuaaaguaagccuggguccuuaguccuuuugacaaaauuuccuuacuugggagagcggacauuuugacagcauuuaggcacugucuccaggggaugagguagcgggguguuuuccccauguuccuaucauuuuauaucugcaguaauguuccugcugacucucuucccccgccacccguccucugguuuuauuaacguggaacacuagauucuguagucuauugcccuaacuccaaauuuuacaaguugaaucccacccagacagcuuuaacaauuuuccuggcaccuucaaagucccaaccuuuuuuucuauguccuccccuaaauguagacaccucaaauagcccucacucucauuucucggauuccagaaaauggaaagaguacauucaccaaucacaucuaaaauucacuuaacaagacccccccccaaaaaauuccacgaauacacacuggucacaaggcuuuggggcucccuagagcuccugcaagcauucuggccaugguuaggguucuuuaaaauauaaaauauaaacucucucacuaaagcccccaaagcaggcugagcaaugauguaaggcaugaacuucuauguggcagagggcuuuccaugcuaucccaagucuuauaugacuguuccaugucuuucugggucacagauggcacaaaauuaacucuuggccaaguccuuuuucuuuauauuagaauguugaaugucuccaauccuugaacacugaucauuuuuuucugcaucaaaucugggucccuuuaacuuaacaauuuggaaaaaaaaauuuuuuuuaacucagacaccaauugcaaaauccaguaccauccuguauccuuuucaucccccguguuggcucaugccugguguccucaaacauuaggcaauauuuuccaggccccccaaaacacacuuaguguuagccuugggucacaaaaagguucugauuucucccacugcaauaccagcuauacacccacucagccccccuacauuucaaacacaccccccccacacacacacacacacuaucuugcacaaucucugcagauugcaaauuugggggauugguucucaggccccauaauuuaggaacccauaaucucuauuccuuguaauguagagacuggcccugaaggaccaggaaacuuuagauucagaaauuaucuuccugggcccccccaaauucagguacuccaaaacaaauugagauuuuuuucuuccaaagaguucgguuuuuauuaaacuuuaaugaacuuuguugaauuuaugacuucuacuggagucucccuauauuuggauaauguuuuaugguccccaaagcacacugaaaaaaaaagucccagaucccccaauuccuagguuuuaaaggucugugucuuacaaauuuccuagcuacuaauucuauucccugcaauuuagauuucaucauccauuggguaauuuuuauugauccacaaaacagggaguauguuucuccaagaacaaacauuguccaagaaaacauacaaacucccccuuguucaacaaaaagaucaauaggaaucuguuuaggaaauuaaaauauuaaaagacauugauuuuuucuggcuuucucaaauggacuucuugcauuucuaauuccaccacauuuagacagcauuuccucauucucuagaggacuucucugaagccacagaaauuagaggugauuuuucccggguguuguagggcccacuggcuucagggugaacccuagucuccacucccaccccucaaaagaacugaccugaauucccuaaaauccaucuguuguuuuucaucucccauuuuuaagcaauuaaaauuaagcuccccuaaauuucauguugggaauuuucuuaaacccaacagcaacaacaaaccaccuaacuucuacaaauuagucuaggauuuuguggguuccccaagcuuucuaaccaagauauuggguuccccucguuaggccuggaucaagaugccccccauuuuugcauagaauaauuuuccucauuccccaacuuggauucuaauuuuucuggaaucucaaauuuagucauucgccacaguuuucccauuuauggagucgccuucgagucccccuacuuugggccgcucauucccaggaccgcaaaucagacaagggucugacuugggauccccgaaauuugaucauuguuuccgcuggccacuuucggcagcuucccguccugcgcauaacagugguaucggccucgucacuucuccuacggugucccagcggcagcacagauuuuggaaaagugugugugccccaaacacgcacuggacacugcgcggcggccaggacgugggcaguguugcucccguguccaggaaaacgacugggcauugcccccaguuucccccaaauuugggcauuguccccgggucuuccaacggacugggcguugccccgguucacuggggacugcccuuggggucucgcucaccuucagcagcguccacuucagcagcucccacuucauccgcucucccgcccuucuccuccgauccuccugcgccagcggacccgaccuucggccuuguggugagcuccccguggcgcgcucccucgugccccagcucuuccacugcggggcaccggcuaccucgcaguuuguccucagggcugcugcggaguagcgcgggagcgggcugcuggcuucucccucggcggcagcgcuccuuugggcugggcgcuccgaaacgcgcgccacuuugugugcacucugcaaacaacgcggugguagggaaagcgccugggcggccaggaagcgggaagggcagagcgcucgggcggcuuggagccuccaacccuacaggucgagggcuuggggaagcgaguguagagcgcgggcgcggugauugauggucgggccgggagguuagccccgggugcacugguuuccgccaguaguggcccuuuagaggccuagaggugcggaggucgggagagggaaacaaggugcaccgguuuagaagugauuuugacuugguaaaaaucacaauggcuucuuauaucugaaaccacccggggagaguuucuuaauagcccggaauuaucgcauuggccccuggggccgaaccugcaacuaagcaaauucaaagugcugaggacagggaacuguuaucugcucauacuggguggggucccaaaggcgcgccgcuuagaagcacuucagugagcucugguuuacaggucugguuugagcuacguuucccgcccugcuucuuuuucugcugaagggcgcagacauugugcgggggcuccacgcggggcccagauuuggcguggccaagccagccuucccuucauggugcaccugguggccccccaaaggcugcuaggagaucccaggcaaagcagagguuaggggcgcuuaguaagaucuaucuggcugcuauucgaggugccucacagcccgcccugccugcucaggcagguggaggcugcgcgcucccccccccccccccagccgauccaggggacuguccccugcuuagcaaguaggucccugugagaacccucuacccagcuaccugcgccuuaacucagucggccgggaugcgccuaccuuguaacccucuaacugagcacagguccugccacuaccacugaggccuagggugccacgcacguugguucgcaccacgcgcccauguugcacaagcacagggcaccccggaaacaugacaugggaccucgauuuuuagggauagacacccaggauuuagugggccuguuggggcgcacagcccccccccaucuuugccaccaggcacuccacuccccccccccaccggcaacccccgugcccagggcccccgacccgcauuccccgcguggcucgaguugcgggggcggucccggggcggggcgagggcccugcggacgcccauuggcgcgggcguaaggccagcggggcccgagcgggcgccgagccgcgggguggcgcggcuauaagaaccgggcguuggcgcccggaguucgccugcucuccggcggagcugcgugaggccaggccggcccccggcccccccuuccggccgcccccgccuccuggcccacgcccgcccgcgcucggcccgccagcgccuccauccgggcuggcggccccgcgucgacgccguccgccaccucgcugcugcuaacuccugugcagggcgccgucggcggggccgcgcuccgucgggccugcggaucuccccaccgccuccuccucuaucuaccucaacaccccauuccugcuucgccagaggaggcgguccccaccgcaggcaguccggcuugcaggucgccggcguugucaucccccgcgcuuccccucccagcccuccccggugcgcagcccggcugcuccccucuuuucgcugcagucccgagcagcugaggcgccgccacgccugucccccccacaagaagcccgggcuuacgacggcugagggcuccgucgacccuaaccgagcugggugcccguggccggggugacgccuccauuccuccccccucaacaccguccucgguccuucgaaguugcauccucuccucugcuuagggugcgcccccccucgcgcacccgcuuacccgccaccuuuccuaagcuccccuccugcccccuccccguuccuccucgccucagacucccucccccucacguccgcccucugccuucgccuacccaaguggauuaauuauacgcuuucuguuucucuccgugcuguccucucccgcugugagccuacccgccucucgcuguccucucucccucucucccucucuguggucccccccuuucacguucacucugucucucucacuaucucugccccccaacuauccuugauacaacagcugaccucauuucccgauaccuuuucccccccgaaaguacaauaucuggcccgccccagcccuaagauacccuaaagaagcagaagagacgccccccuccccaccaaaaaagccaucuccccguucugucccgucgcacauucggccucugcgacucgggcagagcggcgcuggcagaggagugcccggcagaagggccuucgcccgcuguucgguuugcauacccgcagcagggagaugggcggcagcgucgccggcuuccagguaagggcucucaggggcccugggaguggggggugcgcagagcccggcuugggcauggcgggacuggugcgguggguggggggcugggggcucguucccuaagcaaacuuuuguucccccuugcgccauggagugggggaaggggcggggguaugggggcuguuggggaggggguguguaaguugaacucacaggagacuuccuggugcuuuacuguguguuggggaagggggggauggaugagcugcauaaaauguacgauucgugcugugcaggcccuguacacccccccccaagggugcugagugaugaggaggggggcagagucuccgaagcccacccugguauguugacuuugugccaaugagacaggaaggaaaagugggugggcggggccaagagccccccaaaauugguaaaagagucaagccagaccccacaguuagcuuuuccccccacccacacaccccaacucuguccccaacauucccaaccuggaauguuggggggagaggggacgguuucgggcucagaagggcagaaauguuacaguucaaagagaaauaacugccccugccuuuuacuggguguaacuuuccauaggaggaugugggaaggagcccccucccuccccccauuggucugugcagaaagggcugggggcgcacgaugaggccccccucccacugguggugcuuugcuaaggaaugguccaaggcuagcucuugggggugcaggagaaaagggacuggcuggaaggagggagggggcgggugcaaagggggcggggggaguggucagcagggagggggugggggguaggguggagccgggacugggaggagccacucagacauaaaaagcggaggcacugaccaguucgcaaacuggacauuagcuucuccugugagaaccuuccagccuuuuccugucuucauccucuuccagccccagcggccuccuuacccaacuucagguaaccagggcuguggagccaggacccugcugccauccccacuccggcuugcccagugggguggucagggcaccggguagccugaggccucugcccuugcagccgggccugcuaccucucccaagccuucguucucccucagccucuguccuaugccccccacuagauccaggcuuccuuaccugcccaguccucuacuuuuccuuccucucugccuccccacuccaacaaauucgggccuucccugggcccucaccugucccuugccuccuggucaaucuccugcuugcuucuccuggacaccugggcugaaccagccaguguggucuuggcuuugggaagggacuucgaggucagcuccgucugccugccccccgcccccagaacuaacugcuguagcuauagccugcugaucgcaagugguugguggcacagaggguauugggaggaucggucugggucuugaugaagugggcaaagaugacuuuuaguuacccaagggagcucgaacaaauuuguuucuugauuauuccgcacuggucucucacauguuucuuugcagcaagaaauccccugggccuauggagcagagauugaggcugcggccuggagggcucuacuuaacugaagggucaaggguggcuuacugugggucaucguggccucccaccacuaaaaaagcuagcuaaccauuguccccgccuguagccacauagccuguggagggggugugucccuccaaaaugggguguuuagccucccaaggacccaaacugcugcccuggguaaauuuagcucuuaucagaaagaugauucuaugggccauaaagggacccucuagggucccugaccauggauggcaagcucugaggugcccaggaaagucuauacuuggaggacugggugacccuggagagcaaggcucacaggagugcuggcuaucccauugcgcuaaccauuggauucugacaugggcccugcucaccauggccugggaggugggguggauggguggggcuggcucugcugcuuagggagggguggccagcuggggggcggguagguugggaauggucccuuuggaugcacaugcuccauggugggugggguggagcuaucugccaucuuggccaaugcuuggaggccagaguaggaguggcaguagugaugugcccuugggcuggccccacccccaugaugucauagcauggaaaccagguccaguguccagcacuggccccugcugcugugggugugguuaagcugcaauugcgcccauggaugggugguccucaaggguuucuuacaguucaaagccaccacggggugccuuccugggguccauugaauuucuccacacucaaaguaguuuuugaccucagcaauucaagucccccuguuuucacagguuaaauaaauagugacauggcugucuuucagauuccaauugcauuuuuaauuaagagaugauaggugucuuugguggggccugggugggggugagccauucuccugggauuagggguguggcuugggggccucuagcucaaagccugcguuucuuucuccagguaccaauggggaucccaguggggaagucgauguuggugcuucucaucucuuuggccuucgccuugugcugcaucgcugcuuacggccccggagagacucugugcggaggggagcuuguugacacgcuucaguuugucuguucggaccgcggcuucuacuucaguauguaacuccagagaggugggggcgggggaagcaagccucccuggauggggugacaauuaguacacuggucuggccuugcucuuaagcuaccccuucccccccccccccgggcaaggucguaaucucaaagucacaagucugauaguuuuaaaaguuuuuaaaguugauaaaagcaaaaccaaauguggaugucaagucucagccagguugagagugcacguguaguuuggggguacaaggggagagcuggaccuuggccauccaacuugagggguucccaggacuacaacauggggugcuugccugcuuucaauguucaugcuucucuugauuucccaguuggggaaggggcugggcaugggcucacugcucacagaaggcagugauggggacacauggguggggcaugccugggaggggcaggggcaccagaauggaugacuauccuugcuggcaugggccacucuaucuuccucgccugguccuggacacgcagccucuucuucuucacuucugccuaccugccugugaacugcucuggaaacaacuacugcucauggguacugcaggaccaguccuuggucgagagccacuccugcacggaggggcuucacagauaggagggccccaagcccaaccucggaccgugggggagagggggaagacgggagaagagaagggagugguuuuugggugccucacuccuccccucccgucuuguucucuccugcccuaucuucccuuccugucacaguucagcgauggggguugggggugggccccucaggacgggccccaaguacagggaccacaccuguguccaccauggcccccucgaggggcucacccccuccuccucccuguuuuccaaaccacuccaguguggccucuggucuccauggagucugugggacagugaagcugugcuguguuaguuaccagacaggaggcaccagaugccaggggcugguccugcagcaugcaccuuuauuuuuccuuucugggcaucuuggccugucuggcucacacuucuaccacaucccugcagggugaccuaguauccggccagggucuaguggaagggcagggguaguuccuucuucagccuuccccuccuggggggcggggcugggguggccaccccaaugggugcugaccccaguagacacuaacugaaguugucuguccuguggaacuuccaggcaggccuucaagccgugccaaccgucgcagccguggcaucguggaagagugcugcuuccgcagcugcgaccuggcccuccuggagacauacugugccacccccgccaaguccgagagggacgugucuaccucucaggccguacuuccgguagguagcgaggugggguugaaggaauuauggggugagacaaagagaccacucacuucuugauuugggguaccacgaagccccccucacacauuuuacugucagccucugcucauuaacauagauauuucagggaaguugcccugagguggggugacucuaguggggcuggggauaugcgacaccuagaugggagcucaggcuaacaugauacccugaaaccugcugacuagcaccuccucuccaggacgacuuccccagauaccccgugggcaaguucuuccaauaugacaccuggagacaguccgcgggacgccugcgcagaggccugccugcccuccugcgugcccgccggggucgcaugcuugccaaagagcucaaagaguucagagaggccaaacgucaucguccccugaucguguuaccacccaaagaccccgcccacgggggagccucuucggagauguccagcaaccaucagugaaucaaauuaugugguaauucugcaauguaguaccaucaaucugugaccuccucuugagcagggacaguuccaucacgucccacacuaagaucucucugcuccacucccuccccagguuucuccuuacccacccccaugccccgccuccccacaucaggcuguuccccuugccccacaccaucgggcaaggggaucucagcaguucuaaaaaaccaaauuugauuggcucuaaacaacccaauugacaccccccaaauuauauauucacauuaaaaaaaacuuuaaaaacuacagucccuuuaaaaacaaauuggcuuuuaagaaauuccauaacugauaaucuaaaaauuaaauaacuaaagaaauuaauuggcuaaaaacauacuaaaaauuaauuggcuuaaaaacaauuggcaaaaucaaauaauucggcgccccccccccuucaucuucuuuccauuuggaucuuuagucaaauuggcuaagacuuggaucccagaacccaagaagaaaggaaggggacccaaaauuuugcagguggcaugucauugcuucagugcccucuccuuaucccaagcaccuuuaguguaaagcuggcugagaacaacaauagccgcccaaacucuuucuucacuggucauuccaucacaaaugucccccaugucaccaagggggcugggugaaagaacccaaggagaagaacagaacaugaaaacuggaaauagaacuuaauuggcacaagcccccagucccaaaaucucacuuuucccuaccuacccuaaaaagcacaugauuauacucacacccacaggcauuaacacacacauacacauaacacauaugcacacacacacacacacacacacacacacacacacagagguaugcacacccacauaauuggaugaaaacauugaaauggcugaacaacuucgauuugaaccacauuccccaaaacaaggcccaucccaaauuuccugagcaguuugcaugguuugagcucuccucccaauccaucuaguuucugcugcugcuuauuggcucuaugugugaccaggcugcuaguucugucuuucucagugagggagguguucuagcaaggcucaauuccaucuaagcaccuguccacauggugagcccggugcuccccaaccacccccgccaugaggaccaaugacuagccaguguagaauaaguuuggccagauaaggagauggcacugccaagugauacaugcugcccaaguaaccugaccccuaguugugcuccugggaggaaagaucugggggacaaccccuacccugagcacaccuaugggccaucuuugucagucuccuggggagcccccgcuuuuuaggggcuccccaggagacucacacugauguggggagugugggaagucuggcgguuggagggguggguggggggcagugggggcuggguggggggagcuauggguaggaaguggucccagagagguuuuagguggaagaaucaggaggagucacaggucaacuugcagaauuacugaagaauuaggaccccaaauuuuaugccaauugaucuauuccccucuuuuuauuucuggggccgguuuuuuccuuuuuuuuuuaaucccuccuuagcuuuuuaugcgcucauaaucaauuguacccauucccuacauaacgggagcagugaucagguaaugaaugcaucgagccaucaacaccagcuagagccaucaacaccggcuaccacaauguccugcucuccacaaccuugauuuuuuuuuuuaucucucucuaucgcuuggccugaguugggaguggagucucuguggggugcuggccacgcacccacagagaaauaaaaggaauugagaaggucgcuaccuggccugacuucuggggacaguggcugguccccagaaguucugaggaguggagggggcguggggcaguguccccucagguguuaggaaggugcucggaggccacaaaagauggggcucccagcuggccacugccaguugggggggaaggggauagagaugugagaguagacagguuacaucaggcgggagcaaguggcugccuucugagcauuugggggagaaccucucccgucccucagugucaucuugcccacuccucagcaccccaccuugcccccaggaggucuggagcucuacagaccuccugggggcaagguggggugaggcccggaguuggggaagcuaggaggcuuaaagccuacagagccaggagaacuguauacacggggucaucugggcccuggggccugagggucuggcgagccguagcagccacuccacggugccuaggacugcggcggggaacagggcggcuggagguuuaccucacccccacuucugcuuccagugcagucccccugcccaacaguccaacuagcaaucuagaggccugaggcuucugggcccaggugacaggacuggcaccacccugggggcggugugugucagccaagcauggcacagagggucccucagcaagugccuaaagaaugggccauuuggaacauuggacagaaacucaaagaguaaauuguuauaauuggagacuaugaauuggccugguauccaaaacaucucgaggcacccuaaauuaccugcccauuuggcuggacacccacccaguguuaauaugccucgugggaugggugcuuucaggggcauuugcugaccacccucuguguccccacauuugcaguucuccccaucauaggucaccuugaugcaggcaccucccuggccuccuaugccuaguguggcccuccaucuugucucuucccuacugucuucagugggauccccucuugggucccucccuuugucaucaugugaagacuucccacgcgucgaacgccauaugucaccugugccacuguccaugucauccagcaguggccccagguguuugccucaacucagucccucuaacaugcauuuucuggcaaaauccaaagcuuggguuuuguuuuuaaccuguuaacgcucgcaaaccuaauaaagcauuuaaaauacuauuuauugaguucuuugcucuuuuauuugggggagggggcaaagggagggaggggaggaguaaaggguaccugaugcgugggggagggggacauggggggcagcagaugaagaggaaaagccuuugaaguaugagaagaaguagggcucaauaagccacucugaggaacccagaggguagaggacauuugcccuaaguccucaaagauggggugcuguggugcuaaaggggucccaugauguuuucggaugagccaugaauaccuaccccagggaacauugcccuuagccuugggaguuggggagcaagaugggugaggacuugugguuggugauggacauggggacucagggugaaaacaccuaagaugguuucccugcacaugcagucaucccuacuguucccucuauaaaggcuaugcuagagucuguccccaguaguuauuagacccaccugcccaaugguaguggucuuuggcaucccugacacugggaguaaagugaggccaaccccuagaugcuugaaaccuggccuggguaucuucuuucugcaccuuuacaaguccuuagucccccacuuuuccuagugcaagugggcacaugcccuuccccugugggaggagcccaggcuggggcagcgcugagaucuugugccuggcacccugcuccuuuuccccaguuauugcuacacacuagcauuucuuuuuacuguguuuggcuaguuuuuugauaaagagucucacacucuaccccaggcaagcuuggaacugcacauggauggauguccaugcuggccuggaacucauggcagucucaauccugccccagauaccugggugcugaaaauacaggugcaagccacugguuagcauuagcuuuuaguuuuguuugcacucuagagucucugcuggucugcuaaagggggacuucaggacagccuacaaauccaagggcugcuuuuaaacucaggguacacccauccauugcccuacccacccuauguccuacauccacccaccuauccuugcccauuuacccauucgccacccaugcacccacucacccucucaucuaucccccauccacuaaugcacacauucaucuaccuaucaaucuaucuaccuacccauccauagcaucuauaugucugcuauauaaccauccaucaagccacuuaccuaucugccaauuuguccucaacccaccucccaucuauccaccaacuccucuaccuguccauucagccacacaucccauaucaaccuauucauccaccuaaccucucaucuaccuagccauauguuuacccaccuacccaucauucuacccacccauacucuaauucacucaccaacccauucauccaccuauucacucauucaucuaccuaccaaucuaccaauucaucuacacccauucauuuauucauccacccacccaucuauccaucuacccaccacucaaccaucuauucauccacccauccaccaugacuuguucauuuaucuacccacugacucauuaagucaccuauuuguccaucugccuaccugcucacccauccacccacccacccaccaucugucuaucuauccauuacccacccacuauccauucaccuaucacuuccccauucacacaugugggugggcaucuauaauguucaggaugccucaucaggggcugggugagugugauggaagugcugaaugggccucaccaagaagaugacacacagacuguagaaaguauagagaagaacauguaaggggugggauacacaugccuagaccuagagcauuagagcaucaucacuuggaaugggguaggguuucagcagcaggagggacaaauguaagugaugaugucagagcuggaacaaggucaggacacaugggccaucuaaaaccauugcuauccacucagcaaacacuuauagacaucucuucacuggguugaaugauguccuccagaaauacauauuuaucucuggacacugggaccuaugaaugugaccuuauuuaaagaaaagaagggccuucaaaauuaaagaaggacuuugcaaugacauuauuuugaauuuaggguaggccuaacucaaaugaaaguuguccucaagagaccugagaagguuacauauggaauaaauuuauagacaaagacagaagcagggacuggaguuaugaagucacaagccagaggaugccuggugguccuuggaagcuggaagaguuaggaaggaccacaaucuggagucuuggaaaggagcauggccuuggcacaccuugauauuaggcucccggucuuuaaugaaauguguuacgauuguagaagcucccaguuugugguuguuuaggaaagggauuacacuagagugcccucauucuguuauaguacagcacaggucuggguauggaaggucccacagcaagagcuucuaguuaguggucuaacccugccaggccacaucuccauugcccuaccuguuccacuuaccuuccugcagcagcucccaaguggugguacgugaaacaccagacaccaucccacuucugcuuggaacaugcuagaugcuucuugauaagccaaccaacucguggugaccagaagccacccugauauacccagccaaccacuacuaucccuaacaauugucccagucacaaacgccugauaucuggggaccuuugacccccugcaagggcugcacugucuggaccacuucccgugagagaccugcuccgagcacccuuccuucacaaagucuauccugaguacccuguacacaauggcauuucacauguauggauuccacaaagccucuaggaauaaagagaauaggcuucaauuggcaccacucaugcccauuuguucucccaggacauccuaaaaaccuuuccaccccuuaucuccaugcccacaaccuauaagacagacucuaccacacacacccccagucauauucuucaugagagcagagugaugaguccagaucuugucuuucuccacuuagaaucuguggcucacauggacuguugggugaaacucagagacuggcuaugcuuuggguucuucagcauauaacauuggcccauaucucaguugucacauaccaauucuuucaucucuuagguucccucacucaguguccccacacccaguccugaaagguggcuguccucucucccagacccuuugguaucuggcaucacccugauugccuuggcaugccuucugcuauccugggcaguucuuuacugaacccccaaaugucugaucuucuuuagauagcaguuggggcccuuucccuguucccuagagaugcagagauaugcaagacgucugcuuucagguucucccagaauuugccuggauuucucuguagcuuucacuugcagagcuggccacagaaaugguccuucugggcaccccaggacaaccucuugggagacccaggcuuauccauguccaucuucuucagggguggguacuagucuucccuggccucuuacucuuggacuaagucccuggaguaggaucagacucaucuuuaaacacuuguuuccaccugccuugguguacugacacccaggguccucaggucuccccagucccugaggccuggcucccaggagcucuugccuaggcauagacagguugggguuagaggcagugccaugcugacaguauccuccaagccuggucucucuaccugcucugcugagcccugccccugcccagcccccuucuggcugcugggccgaggccugaggccucauuagcgcagccugcagccucucccgcucccagccccagccaacccaggccucugccggccagaaaccaaagagaaaaugccuguuuaugccaguuaugccgaaagcaaaacaguuugugguuugugacccaaauuuuuugccuuuuuuuuuucagaacauaacaaagcccaagacaacucccucccugcccccacccuccccccaggcagacagaacugaucuguuuacacuggcugcuaugcacccccacuggccuaggcucuggccuugcccucauccugaguacugggcgcccccagaaaggaguuuguaggccuggugaaguggcaaggaaagugaaggaggcagaggaggcucugucuccccuggggcaauggaaggauacaucuggagucuagaguacagggcucagucagacuggauccauccuggacagaggaagaagguagggaaagcauggugcaguugauccccaggucugcccugaggugccaaagcuuaccuccauuucaugagacuggugccuaggccaauaggcccucagaccaccuguccacuagccuccuuccugcaucuccucaucccucaagguccauggugcccugaagccuacagaacaggaaugucuucugucaccauguccucggucagggggucaacagaugaacagccagguauuuucugguggccauugugaaaguaugaacuaccccugaggagcuggcugggauugguugcuugaacuguggaaguccuguggucagggcucuggccauaaagaaagaaggacaggguucccacuugcucuugcuuucuugggagacaggaagccuaggcaagccuuuucguugaaccguaucacagccccaaagcagacacucucucacuccuccuaggaaauucuagucuacacucguuuucauucuccugugucuguaccagucugggucauagaaggggcuccucugagucaagggggcccuaagauaaguuccaacagaggagacagaaggauggcaucugggccugaaaaagaccucccucuaccaugagaaauuuucugcccuugcaucugaagaggguggagcaggaggaccuguauauggaagucuggaagagugucuuuuugaaaggacaaucaggaagacaaagggccccaggguugaguccuggcucugaaccuuaguucaaccugccaaggcucuggguggcaacagguaguuuuuagggagagaccaaggcacccagauaaaguuuaggaaagaugguguacauaaaggaugcauuggagcuggggaagguuugugggguaaugauaguuggagcagaaggggcaggauuggguggggagcaggggcggugcuccaguugggaggagcacaauaugaggagcaccaacaccauugcacuaacuagggugggguguucuucccacccuucccagccucauaaagagcaggccugggcucaucugcuggugggguugaaggguaagcaaagaguacugccuccugcccuguaggccauugggggcugcccuuggccugccuggcaggcuccucuugcuggccuagaggauugcuuuugggaaagucugagcaguaccucuacuucccccccucccuugccugccaucccuggccuccccucgaucaggaccagaugugccuuggagcaggaauucuaguuauuuuguuagccagccgcuugcuggacuuucugauaaggcaaauugguucucuacagaguugggcguggaagaguaggagaaggaggagagagaacaauaugcccacccucucaucuuccugugccagugacgccccagagagguuccuggcccaacuccagaagcuucuuucugacacauacuagggugauaaaagguaugcuagugcccaggagaugaaagugggcuaaacucguggagccucccuacaaagccugguaagaggcaaagaaaugcagagcagagucccugcaguggugcuguugguagcugaugccaugguugaacuaguccuuuaaugguuuugcaaccccagaucuaacaaagaacagucaggcuccccgguacaucugggaucucauugcuucccauuugugagaaccaccuaccuuccuccuuuuccuuuccuuuccuuuccuuuccuuuccuuuccuuuccuuuccuuuccuuuccuuuccuuuccuuuccuuuccuuuccuuuuuuccuuuccuuuuuuccuuuccuuuuuccuuucccuuucuccuuuccuuuuuuccuuuccucuuuuuccuuuccuuuuuuccuuuccuuuccauuuuuuccuuuccuuuuccccuuccuuuccuuuuucccuuucuuuuccccuuccuuuuccuuucauuuucccuccccuccccuccccuccccuuuccuuguuaguuaaaauuccuaucagaacucagaagagcacccuagaaccaugaggauggauagaauuccauucuugucagaauuucauucugguccucaagaugaucauaggaaacagaacacaauacaucuuuauaaaccugauggacagccaggcugagaagauagccaggcucacacuuuacaaagccuuguccuguccucucccaagguccucuuuggaccuuucccagguucaaagaggaccuauggcccuccuguuggaucuggagggccacucauucuggaauugggcccucagaucugcacuuugggucccugcauuccacaaaagcauauuguuucuauucugucaaugacauuaucuugcuagggcaguuuugaaucucaaauugaucuuccagcccuuggcuuauaucuuccagaacugaucuuucaaugucuagacugguacaugcugaagagcaugaacucaauguggguugcauaaaugggguggggugggauauagggauguaugaauguauggaugaauagauacaagaauguguggguggugaguaaauagaaggauagauggguggacacaggcaugaucaugcagauagauugauggaugaaaagaugcaaggauggagugaauagaguugggugaguggauauauguauaggugaguagauggauuaacugauggauaggcuuauaaauagaugaaaggauagauaaauggauggauggauauaugcaucaauauaugggugacuggcagauggauagaugcaugaaugugugacuagacugaugguuugaugggugagugggugaauagauagacacauacaugauguguaagugguuagauggauggauagaagauagguugaagauggauagauaugcgaauugugaaagguuggauggaugguagauaaacucaugaaugugugaauguuuugacagguuuagaaaggcaaauggauagaugugugaguauaugagcguaugaaaggauagcuggagagaaaaaugacugggaagguucaugggugugucagcuguacacccauaagcaucuaccugaguucucaucugagauggucuugguguagaaugaaugacaagaguaaagacacuguaauuuauggaaguacccguuuccauagugugugugcucauucugguuguacuauauccuccuucuauagucuguccaagaguaggaguugugauauguuuauuacuuaugucuuauuauuuuuuauuuauuauaauacuguauacuauauauuauaugauguaugucacauauaauauauaaugcaugauauauaauagaucauauaucuuagaauaauauaauauacaauaauauaacauacauaaucauuauauaacauauuaaucauaaauacaauauauaauauaauaauuuauuauuguuuauaccuuguuauuuguuuauuauaucuuauaucuaauuauuaauuaaaacauaagguuaguaucuagcuuuuucuggagggccuagaaaaaucuaaaaaugucaacaacuagacuucuaccugaaaguuauaaacucucucagagaaagugucauaguuuuaugggcagguuucuaaacucuaaaauuaucacuaugacuuauaaagcacagaagauguuuaucauaaaacccugacaccaaacccaaucaugguagcacaaaaaaggaaaacccacaguuucaagucacaugugaagaaagauacaaaaguuacccaucaaggaauuagcaaacugagucuggcaguagguugaguuaaaguaauaacaugauauggccaaggaucaucagcuuccaggaaggcaagggugacucauuagugaaaaauccacuuaauaucaucauguaaauaggccaagggaagacaaaauguauaaaauagagaugucccagaaauauauuuaauaaaauccaaaauguauuuccaguauucccaguuaauaauacaugcauaaauggcuagggcucaccucacucuggugguacacaacuucaguuccagcacucaggaagcagaggcaggaagaucucugaguucuaggccagcuuugucuacagagugaguuccaggcaagccaggaccacacagagaaacccuuucucaaaaaacaucaacaacaagcaaacccaaaagaggcuagggcucaaaauaacuucccugaaucuaagagaagaucuuuguuccugagucuccuggcagcccaucacccaccacccgugucucugucacucuucugucacugugauaaaacaccaugaucaaaagcaacugacagaagaaaguuuauuuuggcuuauggcuccagaggguacgaguccaucacagaguagaggcauggcagcaaccagcagacaugaugaccacagagggaaagcugagagcucacauccucagccaugagcaugaagcacagacagcagacuggaaguaguaccaggcuuuugucucaauuuuucaucaguaagacuaucccgccuaaaccuccucaaacagugccaccggcuguggacuaaguauucaaaugccuauggggcaaaugacuauggaggacaguucucacuugaaccauuacaaccugacuuugucguauuccauucacaccaucauccaugucuccuuacuuuacaucacaucgucacaugagcuaccuggucucccaucucacccccuaccaugcucgucaaggucacucucaaacgucuuuuuuaaaugaauuuuaauaauuuaugugucugaguguuggccugcauguaugucugcauaacacccgcgugccuggugcccagggaggccagaauagggcaucaaauccccuguaacuggaguuacagacagcuaugagcugucauggggguuaugggaaucaaaucagagcccucuaaaaaagcagcaguguucuuaagcucugagccaccuauccacccagauccccaaauuucucacagcuaaauguaaugguuguuucuguaccagacuuagcagcucaguugcaccauggcugcuaaagucccauuugauucugaaguuagcaggguucuacauccagcauuaacuaucaaaguccuaacagcagcacucuuguagagagaaacuauuaauccugagcugcagaaaacaaacaaacaaacaaagaccuggguucuccagaugaugagccaaaacagguggauucugaaagaagaguuaaggugcaaaaugguuguuaaauuuggaauagcaagucagccguguuucuaauuggagaacacuccuaccgugauaaaaauucauuaaagagugagaaaagaauccuaaaaaguggucaaauaaaauauacuaguuacuuuugauguugcugucaccaaaugcuugacaagaagcaacuuggggaagggaagcuuguuugggcuuagauuuaagggaguguagucagucacaguggggcaaccaugguagcaagagcaguuuacagcggccuccauggaagcuuucucacaucuggaugggucaagaaucagagagaucagaagcggugcugggggaugccuggauacuuguuguuggauaugcaucacccuaucuagcaagcaccucugaauucaagaacaggcaggagguacugccuggggcuuggaagaccuagcaaagaggggagaaggcuaucuaggaggaaagggcccagagaccuguguucuucuacauuauaagaaaggcaagggaccacugaggagccuguggccuaagcaggauggaagaaagagugacccucgggccuuacacaugccgaagcucuccuuuuug

SEQ ID NO: 22 - RNA, 22402 nt, Mus musculus
uggucggucgguugguugguugguugguugguugguugguugguugaaagaaggcuaguugguuucccaaacuagccuugaacuccccaucuuugugccacagccuccuaagcacuaguaccacuaugcaagugaaucugccucagagguuaaucaaccaggaaagaucucuuugaccauuaggaaugaggcaucucaaccagaugccuguucccaggcugcaaugagaagccaacagcauaggccaauucccaccacaggacuucccagcagccaaggaugggugauaagaaccaaaauggagcccauccauugaccagugucucucaacucauacuuucuggccaucaccccaaugcccuaauaucucagauggaagucaagcccaguaacuaccuacagcucugcucaugggcucucaguggccaucuuugauugaaacucaagauaucccucuagcuuuaucccuuuuggguaccaacauagaaaacgucaggaagacugggucgauuugcacuagcccaagaaaggccuguuuauagcaucgucuauaacaguugaaccaaggaccauugucagaagcaaagaagaggguagaacuuuaugaggucaccaguggucaucuuuagagaccacagcaguuaauggcuugaaggaacaugugugugcuuuguucaugugaaauucaagaacagccccuaggugugguaacagauaucagaacauggcaggauuggggccaagucucagggaagccuguggcucuggaaacauuugguguggugacugagggauuguccaaacauagaugaaugaagauuucaucagugugcacaucagacuccugcucagaaggauaccucaaaugaaccaugucagccauuuccugaccuccccgagacuuauagauccagaguaucuugggagagggguaaugguaauggcaggcuugugucccugagacaauugacugagggcacacucaugggguggggguggggguuguaacacuguccccaaagaggcccuugcuucagaguuugggagccccaaacggauugucaugugucuugggcgcccccuagauuaagcccaaggaucaugccucaguccagcccaaucuccaaucuucauaaccccuagggaauccucuaguguccccucuucuuuuacaccagagagacagucagaauguaauagcuuuagggaggccaacaggguuccaguaacccugaccucaacaacaggguggauacagauggcugggacaggacauuggcacaggucugaaacuugcaccucuccauuccacuugcucuccuucuacuacaccuuccuucauccacaggcccaagcugaccauggccucuaggguuccuccugcccagcugcgcaggugaccaaagcucaaucugcugcucccucagcaccugguauccccagauagaaggcaggguaagcacauuagagaaagaggaauagaaggauggguaggugaggagugagcagggcccuaccagacccugccuuuuggauggauggaaaggcgugcccacacccaaacuuagccucucuucuaaacugcucucuaagaguacaucugaggggcugggauggagagaaagggcaucucuuggaaggcugggaggaggagcccucagcaaagugaauguaaaguugcaucauuauaagauggcucugccagggugaaacuggggacacgcuggagauccagaaugaaggagagaugacugggaaugugcuggagauacagagugaaggagggaugacugggaaugugcuggagauacagagugaaggagggaugacugucaggaaaaugccaagacaaccccagcacucauccacuccuuaacccuagacuguaaggaaccuacagccuuuccuagccucuacagcagugguucucaaccugugguuugagaccccuuuggaagucauaugacccuuucaaagggcuugccuaagaccaucagaaaauagauauuuacauuaugauucauagcaguagcaaaauuauaguuaugaaguagcaauaaaaauaauuuugugguuggagaucaccacaacaugaggaacuguauuaaaguguugcagcauuaggaagguugagaaccacugcucuugcccaauccuaggaacucaguucuaccagcuacaggccagcuauagaaaucacauugguauucaagaggaagaaggugacaaccagagugguccgggggaagacaaccaaggcucagccuccacaccuguaaaaugggcacaggcaaagaguaagcaggaaacaccucaagccugguaccccagcaggguaaacugaggaagaagcucucugcucugaaaacuggccucuaagcacccuguuaguucuaagcauguuuagagaaauauugacuagagaaguaaccaggaucccaaccaagucccagggguggucaaggcugucacccccgaugggaaagucagacuagcuauacacagagugggcucaaaauaggaaaaaggacuggagagccaucagacacauguguugugcacccaggcguccaugucaguccugagaaaacugucugccugccuggcugccauaaucacguccuugaagucuuggcuucagacugggauaagaaccccagacacuaugcucaccugacccuccaacuacauuuuuacgcaaagcugucuacccucaggccucaguccuacugucugacaaguaggucucuacuuucugugcccaccaugcaggagggugugguuuauagaauagccagccuaugggcacaauuggauguaguuagggaggagcuaggccauagguguaguuggauauauaaaauccagcacagaucuccccaaaccuagcuuauaaaacagcuguugucugaguuaaaggccccacccuccagccuacaaaaugcauucaaauaagagacaaauauuugaugcuccaagauacgauccaguccagccucuaccacuccccggcuuucauuuggguauuaauugcauucauuuuggaaauuugcauguuuaucaaugcagccaaccucugggggacuggacuaagccuggggcucccaggcaagcaccaggugcaaggaagacagggucauuaagagccuagggcugcccccaccucccagauagcaucacagcacaaucagcacagugagccacaacacuuagaggaacgggcccaagggacaagcuacaaggaaaacugcaaucuaccgacaggugggggaggucaacaucccuguuugaaugguucccaacaccccauagcuggagccagggguacugucaccugucuggagccacugucacaugaugucacagcuagaaaggauccuucuuagcuaugcaacccccugggggaggagggaguccaaccuacucuccuaagcuccaucuugccaggcugggauauuagaaaguagcuuuuacucucuggucuggucauagacaaccuagucucaggggagauaucucucccauggcugcacagaaacgcagauaucucuguccucaguucuaguuaccauccaccagacuugaccaaagaaguaccugcuucuccaggguaggauagcagugaaggagagguguggccucagauacagcuauguagaaggacccgcccuuccugucugaugggggcuacacuguugccuauacacacacacuugucagcugaagccacaaccaccggaucauccagaguacuggucuuuuaaaaggaggucacuaggguggccuugcuccauaugacuuggguuccuuguaaaaaggaccagaacacaggcacacaggcaaugaucauaugaggacacaaaagaagacaccaucugccauguaacacuuuguaacaccucuaccuuggacuucuagacgcagagaaauaucccuuaggagaugcuaagguacugucccuggaccccggguccagcugacucaccucggccucugcagcugucaugcuccuagguccuucugcugcuccgcaaaugugcccccgcuccggcauuaguaaaugggccagcuuuuuccugguccuggugguaugggcaagcagcacccagcuggauguccacaacccucucugauaggcuacaacagaguguaggugcccgggaggggugggacaggggguagagaaacgggggcuggcaagcauacccugcccugcuuccuauagcugaguggccuugggcagagucacucugggggagugucagguggucccugcccuccgguagcugggacugcacaucugggagccaccuacgcaucuggcagcucagaacucuguggacuacuccaauauguaaacuggaaagggugggggaagggagcagaagcucauaaucucagcagggguccugcuaagcauuuggugguaggaggcaggauucucugccuucaggccucuggccaaucaccuccaacuuggagccagggagguauaaggccggaccaauaggggcaggaacccauagguucuggcgacccggaacaggaaucagcccugaguggaccauaccuacuuucaguccaucucuuuccucuucauccuuuccuugugcucaccaaggagaagaucugaggugaagcagggccugguggucaaggcagaguuaccucuuccagucggccuuuuagggaguccuuccugagccccgagcaccuggcucuggucuccaggcucagagcaugggccuuuuccucacaugcuuggaagggguuagaguguccuagaggucugagcuggguccuggcuccucucuaacuggcagaccagucccucuacguaagcagaaaacagcaaacauccagucccugccucaggcaggcauaagggguguguggccuguucacauggagucuuucucuggguaccuauggcuguuagauaggguaaaacccuucaaagaguccaggaggaugugccccccggggagguuggaacuuucugugucuuugugcugugucuucucccuggcagcauccuccacccuccccuagucaccugcccuuacagccuagaccccauacaaucagcuucuggauccuuucuuccucucucucaucuccucuaggcuccagaacagaaagccauuccccaggcccucagaacucagagccaagccaaaccaaccacucagacugaaucugagaagccacucaccgggccagaccccucuuucaggagagcagaggcggcaacaugcaccuacccaagggccuaccugugcugugaagccuccaaggcccucccuguccuacagccccuaccuucgcucuugacagcccuagaucagggcccuucagccucacuccacacuagguuugcccagccugucaucaggccaguuacuucuggacacagacgugcugcuuugguacccacgucucugaaggucaccaaucuuaugagaagggaggguguguaagaguaacagggccccauugacaaaagugauccaugucacaucccuucugcugcuggacaugccugggugucacugucuacaaggggcuguggucucaagaggggcaggaagcaagugauauguggggucucuucacacggcaguucugugggugauuugaggaccagcuucuuaggcaucagaccucugcagccccaugggccccacaguaucccuaucuugaaauuccugcuacucuuaccuuugaccccuagugggagggugaaggucaggagacucuggaguauacuuguucaauaaggagacauuguugcucuguuuguguccagucuugccacccacaccauaaagucuccuaguuaaacccagagcugagcaagcucaguguccaaggaccacauuucccauucaaaccagaacuuggcuucaaaggcaggaaagagaugaaguaagcaugaagaguuaagggacaagggacuacaucuaucucucggaaagagacuucccuacaucaaacggacaacuucuuaugcugaagauauugacaggagagcaaggucaucccaagucucucuuugucguggcuguuguuugagacacagucuuacugugacaccuugguugaccuggaacuuacuauguagaucaggaugaccuuaaaauucauagagcccugccccccccacuccacccucagugcuggguuuaaaagcaugugccaccaagccugucuuguccuucucuuucccaccaguaagcaaggauggacaguacuggcacacuaugaaaacuacuggacuuuggccaugagguaccucugggguacugggaacuauguccugucuuaguuucuguaugcuagcuaaauguucuggcauuugcacgucuaacuggcauuaugcaacaaaaaagacagauggcaacaacaugcaugccacuuauucugguuggucuuuuauacuugagggugaccgauuugggaaacuaccaccuuuuugagauaccaaaaaggacuucucaaaacucuucugucgaagucuguaguauguuacagagccuacauguacccuccugugcuuuaauccucccgcagggacugacccugcaccacgacaacagaacacuguaugugacaagggaaagguccccacauguuuacgaugaguaaaauuguuucucaaaacauuuuguuuuguuuuguuuuuuagaggucauuuuguuuucuuuguagcucugguuguccuggaacuagagcuauaaaccaggcugaucugaaaaucagagauucgccugccacugccuucugagugcugaaauuaaagguuugcaccaccauacccaaacaucucaaaauauuuucaaugggcuggaaagauagcucaaacauuuaaguacuacaaaaacaugaacacaugaguuugaccucugcacccauauaaaaacccaggcuuuccaggcagccaauauacccuauaaaugagcuucaggcccagugagacccugucucaaaagcuaaggugcagaauaauugaagacgcccaacgucagccucugcccuccacacauucacacaugcacauguacuauacuuauacaugcaugcaugcacacacaaacauuuucaaacuauggauggagagcccuuggauauagagaaccaacugccauuaaauggcuccuuuccugacaauggcauuaaauuagugagugcaggacagaaagcaccaaagaaagagaagcuuugcauuuuaaauccucucacgcuacuccuuugcccuuuuagaguaagacgugggccucagccggcuuccugucacuacaauauaaagacuugaaauaaucagucugugagcucugacguuucgggccacacagcaugauggggacacauggcaggagaaggcugcucaaaaccaaagaaagaugacggacaggaaccugcugaaacuccacuugcuuugcucugugccucagacauuucucaagcugcccuggacagccugcauauugcagcaggaggauuguuucuaugucccuguagagcucaggguucugggacucuaaaggcugauugauagcugggcucccaggacugccugggccccuuugggaagacaguaucuggggaguauugugucuucaauggugcugcccgggaaugaaagacaccuugaguaacauagccuugauugacagacuaaccuagaagcucagcugaacccugggguaucacaggacacgugacuaccccacgaggucagcacuauauagacagauggauacaguuccagacuucugcuguagccuggccagccccuagacugguauacaaaggacacauuaucugucuggaagcuggcauccacccgagauuggucucccagguguggugucuaugcuucguguggcacgugaucccugggacaaauugcuuccaagaggcuuaagagaccuugcaaguuugguguuuagacaugggauggacccugguucuauacaucagaaaagaaacggugccacuggcuggcaagcugcacuuucaucaccaugggugauaaaggguuuccuuaggcaaggaaauugugcagucuggagaugcuucaaaaccacguggaggaagacagcaggguggaguugcagaagccuccuuaagccacaacccggcuaugggcuuaagcaguuucuuucacuugauuacccaugagcugguacaugccucuugccaauaggcucaucuccagcagaaaguaaguucccuaagguuggaguuucugucagacacagcaguacacccucaguuccugaagcagaaggguuccuuugugccuggguuguguaugcaccuacucaugcaugaagaucggaggacaacaucaaguguuguuccucaccuuccaccuuguuugacauaggaggcucuuguuuuuccguugugugugccagccuagcuggcuugcauaccuccugagauuccccugucucugccucccuucuuuccauaggagcaccgggauuacagaugugcuuuauauccaauuucucuguggguuuugaagaguucaaugcgggcccuuauacucucacagcaagcacugucaccuacugagccaucugccuuuccuccuuccuagcccccauccucaucccuaccccuuugagcuuggacuguccuccuaucucagucuccuaaguguucagauuacagaugugagccaauaaaguuguuuaaugaagacuucagagauaucccauaauacaacaggggcacaccauugacaccacugggaauuuauggacacaagggagcucacgcuuccagcaaccccuccauuccccauaagccacuuuaagaaacaggaaagaaaucaggggacaauucagguccccuaguucagugaacacacuggcuggcaacgggcuccugggaagaggguggcccucccucaauggccuugccaugccccauuuuguccucuaaggcagguccacucaguuuuguggcuccaagcugugcuuggccugaccccaacugagccugaccuucaucagagaagcugacaagcuggggccaaaguuacagauucaacuuugacccuggcuuugggguucuggguccugcagggaaggagcccagcuaucauaauacagauugagcuucuuguauacugccuucuguauagccaccacagguaccuggaaggcaucugcuccauugcacagcacuuccugauucccauagcuccaacgguugugcccugaccacucccuucugaagggaugccugaagcacccuaaaaccaccuggggauccccucagccccucccaaaccccugcaauaaaagggagcuuuggacacacggagacuucaaagcuucggaggcucgggggucaaagguggagccagguaauaucuuagcaaucacagcuuggcucccuaggcuagggaacuuguguggggaguacugaggaagcuuccaggucuuccuugcucacuagagaaucuuaaaguaaagaucuaucugcagggccucacgauggccacugacccuagcagucagcacgggugccuagcacacacuggcugcaagcucaugggcagguuauccaaaaccugggagggagcuuuaagcucaauaccauuugcaaauaaggcaauuugccaagggccacccaagugguaaggaagagagaccugggccuagagaugcccacaauccagagcucugccuucagccuagcacccugcacuugccccucuuacacagauccuucccaggggagagccacccuggagggcagacacaggcucacagacagcuaccuugccuuccuaggugucugaauugcuuuuccaucucuggagagauggcuagaguaggcacccaauaccuuuguauccacccaugcaauacaggucucgagagaaaucugggcuaguacuauccaccccagcuuagaccgcaccuggggaacaagggugagacagaugcaagguugagaagguacaaggcacugcaaacaccaaugaaaaacaacuuuuauagaauaguacacuuugcaacagcaggguucccacacuggccaaacaucagcgucaguauaggcuucagaagaggaagaagggugcagccaggcaucuugcccucagggcccaaccgguccacacuuuggccagguuggaaaguucuagacagugggggugagggacagaggucaucuuuauugugcuccaagcuuaaggauccuuuguauaaaaauaauucuucauauuuucaguagaguccuacaacaguucaaguuaauugauaaaaaguagauugucauuguaaaaaucuuuauccugagaaauuuccaaguccugaugcugcaagguccggaagauggaagaugucauuccgcggcguggaggccgagcagaggucagucagcacuuggcauuuggucaggcugcacuagacagcauggguaaggcauaggcccagguuucuugggcuagaagcagguagguccaccaggagucacccagggaugcagcugugaagaagauaaaaggugucaauguguacggacaccgccccaccucccaaggcgcaguaggcaguuucguuugcuugauuaguuuuggagucucaacucaugggugccucgauccgcucagaggcgccgacgggggcggggcgcacgcucagaaccugcccgccgugacucaggggcccgcuccagccgacucacuccgcaccccggccuaggacgcgauuugcaaugcaaacucaccccgccuccagcacccgacucggccaggcucugacagcacugggaccucgccggcccggcccugaggccgcuccccuccccuggccuccccuucccccacccacagcagagcucugagaggaaguuuugcaaucccggacaaacaaacgccggucuugcucaggcuugaaaaagguugaggaaaaaugaagcgugcgcgaaauccaagugaucgccccagcugaguccuggcugcacaggguccccguggcgcuaagugucaggcccgcccaccacgugucucccuuacugcuucgccuccccgccguccuggaacuuaccuuaggggggugggaugcucaguagcccccuaaccaacuggaaaagucaagcagcuccugcuccaucgggcuuagcucucccucgcagcugcuuuccuccgacgaguaggcggagcgcggggagguaggcucagagcagcccaggcgguccggggacggagacguagaggcgcaggacagagacgcgcuggcaggggaggcagagggcugcgcgcacucaucggacggcggaguagcggguguuaacagccccccagcgagcgcggcacgcaccgcgucgugcucugcgagcagccgcugcagcgcacgaauguacucuaccgcggagcgcagcgucuccaccuuacucagcuucuuguuggcgccgccgugcggcacgugcugccgcagcgccuggaagcccaaguuuaccagcuuuacgcgguugcgcucgcgcucauugcggcgugccacggcagccgagcugcugcuggccucgguugcuccagaucgccgccgccggcugcagcgcagcaauuccggagacgcuugucuccgccgagcagcgcaggcuccagcgacuccagacgaggugggcaugagucugggcagcgcgccgccguccaucaagcuugcauucagccccugggccccugcuacgaguucuggugcggcacaggaaaagugcucgcgaggaaccgggugcggugggaaguggacguuugcaccuucacgggccucaggcagggcacugcugcaggacucccuagggcacgcgucgcuggccuccugcaguccugggaccccguaccagucaaggucugaaagaguagggaagcgugguacucucgugucccgcgcgugcugucaggcgcuccccaagucucccuuuacgcggcucaagcggcuccuuuuuuuuaaaaaguauagauaacucuccuccgcccgccaccgccuccuuucucacgcccuccuuccuucgccucgcccucccgccacgcuucacccuccccuuggcguacacauucugcaaagcugacaccgugcgcuuccacccccaccccucccgggugcaguucauggccuacugacgugcuuccaugcuccgggcagaugcuuagcuuauugcguccucgaaaaauccucgagugcagaucccgaacugcgcuccgcaggucccgcacacucaggggcugagagaggguccgagagaggguccgaauguacucuacaggcaccuccacccguccuggugcucagcccuuaagccccaagagcugccaggucuccgcacaccuagcgcuugcagccggaugaagaaccggaccaagcuuugcggugaccaagagguaggaggcagaagagcgcgacccccuaggguagcacgagccucaaacccgcacccacgucccucccccuggcggaggaggcgggagccggggucucagccaaucugggaucgcccguuuggccaaugacaauuggcgcgguccuaugccggggccagaaggaagcguacgccuggcgcguggcuccagagaugggggagugucucgcacaaggcuccacgcccacuccgccccacccugcuccuccaccaggacccgguguccacgcauugcaggagcacaccugugccccuugagugugagaagggcuugaggagugguucagaccaguaaugggaaauuucauguuccugggcaccuguacccauuuagccccucaugcacaccccaugccucuguguuuucaagaauccccaggaccgguugcccugaccugagagaauacaaucaaguccacuccuuucucacacugucacccaucugcaccuuacagccagcucuccaagucugggucucuuuuccuaauggugaaucuacccagacuaguuuuuguucgguuccuggacuuuuuguucaauaacacuucuucggauuccagcagaccucucagucccauccuuccccugaggccgguggagggaagguugaaggggaagggaaaugcacugaccuugucaaagucucaguuuugccccauugucccagaagugugcucucaaggccguagcaagcccaauuuuucccucaaaggacuagguaggugcuugggagccaagcaagaccuauaggguucaaguggucuauccuguggguaguaaccuggaguuacuuucuuuguaaauauccgacugggggagggcuaccaaaaccaggcuucucucugcuuucgcacugccuuggagcauguacugccaguguggggcugccugcagguuccaugacucuccaggauucgucaaggcuguaucauccuaauccagccuuuugauaaccuugcugugggaagugggcagugagucgaaauuucccgggugucugcuaagagcacuuggauaagucuagucacuucucugcuguuuggagcaauccaguuggucuggggagauuguuaaguaaagcacuugcugugcaagugugaggaccugaguucaaauccucagaacccauagaaacccaagaugccaagaagagaauuccuucaaacuuccaggccagcuagccccaggacugcaauaaugaacaacaacgucuaucuuaaacaggcuggaagggaaggaccaacauccaagauauccuccaaccuccauacacacugcugugcucauccuugcacacgcaagcaugcacacauauacagaagagauggaaacaguuuguauccuggugcccugaggagguuugaucugcaaacccucacuguacggagaccacugcugcccuguuuccucccugccuuucccuaaguuguuuuuuguacuuuuccuccauuuaggggugguggugggagagucuccugaagcuuagguuagcccuuaauucacuacauagcuaaggaugacugugaacuucagaacgucuaucuucuucuuauaucuccagauagauuauaggcaugcaccgucacacucauuguaugugaugcuggagauggaacccagggcuucauauaugauacaugcuagacaauguggugcauucuaggcaaucuagcaacuuagguacaucaccgugugucugugugugugucuguguguguguguguguguguguguguguguguguguguguguaaagacucacgacucuuucaggggucucaccauauuuccuuccucucaggcugguacauacccuacuucuauaaagccagcaucucauccuacucagcaccuuucccaccuuggccccucccccauccuggcccucguacuuucugcaagcccaaccuaccuuccucagcuuaaaggugacaguucccuagggauuggcgucucccuaggugugccccuucauuucuuaacuucacguacccacauccucuaaccauccugguggcaguucucuugcuccagaagcaguucuccccugaucauaagaguuucauacaucucuuuuggggggcuugggcucuggcucuauccuuagccaugugaucuucauuuaaauguuuugaaacagccagauguccaucaacagacaaauggauggauaaagcaugaacugacucagaaggaaauauuguucagccaagagaagaaauaaaacacugacuggcaucaugguguugguagacaugagugagugaaagaaggaaaaaccgaaagaccacauauuacaugaugucauuuacaagaacuguccagaacaggccaauccacagagacagaaauagacacggggacaagaaugagggggagguacuggcuacaggguaugaauuuccuuuuaaucacaauguucuaaggagcuuggggaaauggcucagcagauaaagugcuugccaugcaagcacaguggccugaaguugaauccccagaacccauguaaagccuggcaugggaacacauuccuguaaccucagcauugcuaugacacaaugggagacggagacgacacucacuguaagcucaagggucaguuagcuuagaauacacaacaacaacagagagaccuugucucagaaagguagcaggcaaggacugauauucuggagaaucugaucuccacacaaucuggacaauuggcuauggcacauacaugcacacaagcugacuaugcuacaguuuacauggcugugguuuaaugguucaaugaaguguguggugcaugauuaugucucaaaaaucagcuggaagauuuugacauggcuugugcccugccugcuccuuggcaccucuccuuugcaggggucauuuaucccuggcugugugacuccauccuugagcuuucaagcauggggcaaaacagcuuuuucugaggaccuguuagcaaaucugucaugcuuugcaggcuauacagucagugucacaugcuagggagcaaaugcugccacagacauuacaaaaacaccauaaauguuucccagcaaaagaaguauagacacugucuggaacuucugguccuguuuauguacuacaaaauguuauuuuaauguugauguguguguguguguguguguguguguauacauguuuguauggaugugggugcauauguauacugugugcauaagaguaugugugugaguguguguggugcauacgugaacuguguguagaagacugugugugaggguguguggaugcauauguauacugugugcauaagaguauguaugugagugugugugggugcauaugugcauuguguguagaacagugugugugaggguguguggaugcauauguauacugugugcauaagaguaugcauaugagguugugugagugcauauguacgcuguguguagaagagugugugugaggaugugugggugcauauguauacugugugcauaagaguaugugugugaggguguaucggugcauacaugcacuguguguagaauaugugccagaggacaaccuuggguguugugccauuuauccuuuuguuguuguuuggguuuuuuguuuguuuuguuuuguuuuguuuuaagacagggauuuuuuuuaauuuauuuuuauuuuuuauuacauauuuuccucaauuacauuuccaaugcuaucccaaaagucccccauacccucccccccacuucccuacccacucauucccauuuuuuuuuggcccuggcguuccccuguacuggggcauauacaguuugcaaguccaaugggccucucuuuccagugauggcugacuaggccaucuuuugauacauaugcagcuagagucaagagcuccgggguacugguuaguucauaauguuguuccaccuauaggguugcagaucccuuuagcuccuuggguacuuucucuagcuccuccauugggagcccuaugauccauccaauagcugacugugagcauccacuucuguguuugcuaggccccggcauagucucacaagagacagcuacaucuggguccuuucgauaaaauccugcuagugcaugcaauggugucagcguuuggaagcucauuaugggguggaucccuggauauggcagucucuacaugguccauccuuucgucucagcuccaaacuuuaagacagggauucuuacuggcuuguaucaggggcucacuagccagcuggugccagggauccuuugacucugucuucccagugaugggauuacaagcuagcaucccuggcuuuuagaaguagacucuggaguucaaagccagguucucaugcacagccagcacaugaccaacuuagcuaucucagccugaauuuuuaccuuuuuuaacugcuuuaaugguuuaaaauuuuaaaauccaauauuuauuuuauguuguagugugggugguuugcuugcauguauauaugugcaguauccacagaggcaagaagagagacucagguucucuggaacuggagugguugugagcuacuacaugggugcugggaacugaagcuguguauacuggaagagcaacaagugaaacuggguccucuggaagagccguuaagaacuaguguucuugccgggcggugguggcacaugccuuuaaucccagcacuugggaggcagaggcaggcggauuucugaguucaaagccagccuggucuacaaagugaguuccaggauagccagggcuauacagagaaacccugucacaaaaaaaaaaaaaaaaaaaaaaaaaaaaaauagaaccacugaaccaucuccccuaccccuuuagcuuugggacagaacuaacgcaggcaaagcuucugguacaagccacaguuuuuauccaugugacauguggacugaaccucaaugcuccacagcuucccaaacuuaauucauggcaggcugaucuuguccuccuuuucccucagcccaugucacucccauguuuccuucacagggaagucuccauacucaugacaucaguaccaucugucuucuuucccucuaguuguccaucuguggccagaccucuucuccagcuagauuuccacucugcccuuggaggaugccccacgucuacucuggauuccugagaauggaguuugccucccacucucugagcuccaucuccaaguagggacaaccuggacaaacccagucagaugagacccagcccuuggcauucagucucagcuuuccacaugcuguucugagagccaucugccuguguggcucccuuguccauuccauccccuugggaauggcgcagacccagccaucuuucaacaaccucuaucagguggcucugaggcacucaacaauggagucuacauucuauaacaugccugggucucauggaacaaaaggggacacuccccaaguuuacuggugaaugacaggcagaggaucagcuggcucagcauagauggccuaccauuaugacacccugaaacccucacugacaccuuggagagacagcuugguuccaagccaugcccuggaaguggacagugccacugggaagaagccacuuggccugcuaguagaagacaccuuuaccaaaucaucagacauuggaccaagcugccauauauacaacagcaaauauucuaggguguccuuaccgauggcaagacauccuggaaagcaagugucccaagcacaggcuagaugcaauaaaggcagaaaggaagauccaggugacauguagcucacucugaagucaaagagaaacaaggaagaaggacuugaaggagggcucagucaguaaagugcuugccaugcaggcaagaucuccagaacccucagugcuggggaaacagagacagguggaucccuggagcuugcaggcccuaggucccagagagacuaugcucaaaagccucacuuucagagaaauacaccugaguuugauuucuggucucugugcaugugcgugcgcacacgcacacacacacaaacaugugugcacauacaaauauauacacacauauaccuauaugcaaacauauacacauauaugcacaaacaugcacuugcuucugugugcacaugcuucuuuuaugugcacaugaacacacacaaacauacauaaauacacacauauacaugcuacaaacacacauaugugcauauacauacaaacaugcacacacauauauaaagaucuacauacauauacacacacacaaacauauacacacauagauacacgaacuuaaauguccaaacacaaauaugcgcacacacacacacacacagggggagggaaaauaagggaaauaaaaucaaaguuaaaaagaaaaaggagcuagagagauagcuuaguaguuaagaacaguuauuaguauugcaagaggaccagaggucaguuccccauaccuauguaaaguggcuuacaaauuccuaacacucuagcucuaggggauccaaugccuucuucugcacucugugggcauccauauguacauguguacacacacaaacacacacacacacacacacacacauccuauaaaucuuaaaauauauauauuuuuaagauuuacguugcagugucuaauacccaacugucucaguaacuuuuuucauuucugugacaaaagaaacuauguggggugaacaguaucaccagucauagacaaggucagcaaaaauauuacugugacuggguuucacaggcugaaggugaaguggcggcacaggagguauuuacaugagcgaagacaagcccuaaaguucuggagaugaacaagaacgccagcaucuggaauggaaaaugcaccaguggcaaauuggaugcugugaaaagaaagguuaaugaauuugaaggcauagaaguggguggcauccaaaggucagcacagacaggcacggugaggagaagcauggugccaaacacacuccugaaugagaacaagaaauuaggcagaaaauacaacuggagaggaaaagagcugaaaaauuuccaaacuagauaaaaaucauaagcucacagauccagagagcucagcaaaaucugagaacaaagaagauacaucgcaaucgcauuaugugaaaccaggaaaggaaaaaacauucuuagucagaggaaaaugauacauaugcauacaugcagaaacaaucauuuguaugcagagacacuaagaggagaugacacaauacucauacaucuguccacagcagcauuucuuaaaauaggcauaugcagagcaagccuacauccacuggugggugaauggauaagcagaauguaguuuggccuauucuucaaaaugaaggagagagugggacugaagagauggcuccgugacugcuacucuugcagaagaccugaguuagguuccuaaccuccacuugauagaucccaacuaucuguaauuccaguuacaggagacucuaugcucucucuggucucugugggcacuucaugggcauggggcacagacauacagaggcaaaccccccauacauauagaaagaaauaacucccuuuuaaaaugguguagggucauugagauggcucaguagguaaauggugcuugccaccaagccugacaaucugaguuagauaccagggacccauauaguggaagaagauaaucaauuaguuguccucugaccuugacauguguguugugguacacauauacacacauaccuaaccaaccaaucaguauaauuuuuaaaggugaagaaggucuggagaugugacucggugugacgcauguuuaccuagcaugcacuaagcccuggguucaguccuugacacuccauaaaccggcacaguacucaugccugucaucucagcacucagaagauggaagcagaaggucauccuuggcuacuuaaugaguucaaggccagccugagauauguuaguucuuuuuucaagaaaagacagauaggaaggaagggagggagagagggagagagggcaggcaucuagccacauguggugaugcauaccuaaaauccaacacauaggaggccagggcagaggaucacaaguuugagacuagccuagucuacauagugaggcagaagaaagaaagaagagagaggaaaaaugugggaaauugauaggcuuuuaggacacaauacucaaugcaaaaagcuaaucacaaaaaggacaagcacuagagagaugacucagugguuaagagcacuugcucuucacccaaguuugacucccacccagcacccgcucaaauagcccacccucauguacaagucuaguuccauggggacugacaggcccaaguaaaaauagauagguagauggauggauggauggauggauggauggauggauggauggaguaaaaauagauagauggaaggaaggauagauagauagauagauagauagauagauagauagaugauagaacacaaaaaauaaauuuuauuuacuuauuuuuauuuugcguuuuuucuacaaaauaaauucuacaaaaauaaagggggaagguaccaugugacucagucucuaugaggucccuagagccaucauauucaaggacacauaaggugggaugaguaccagauaauugccuuacuguuaugcccaagugucugacaagaagcaacuuaaggaaggaagcguuugucuggcucacagcacaagggcacagccaggagcacagcucauugcaguggugaagacuuagcaagcaggauccugaagcaccuggucacauuguaucuaagucaagaggcagaaggauggaugcuggcacuuggcuuccuuucuuuuuagucuaugaggaacuccagacuuaggaagguguuaccauauucaggguagaucuucccucuugaguuaagcaucucuagaaacaucauggacccacagacagauagggaguguuuccuaagugauucuauacccuguccaguugacagucaagauuaaccaucacaauagaugugguggggcaggggcugaaagaaggaauuguacuucaggcuuaauggaccguaauuuuggaagguaggaacacucuggaaucagauggcagugauaacuguacagcaaugugaauuuguuuguuugguuuucccuugaacucugcaccuuaaaauggauaagaugcuaugguuugaaugugaaauguauugaacacuuaauuccccagagaguguguuuugggauguuuugugcccuuugagaggugaagucaguucaguuggcacaagugggucacuggaggucaagucuugaguuguauauucuagcucuguucacuuccuguccuaucucugcuucuuaacugguaagaaguaaaggaccaccacauagcccucccucugcauuccauuccucuuaugauggauuguauccccagaauuauaacuccaaauaaacaauucuccuuuaaguugcuucuauuagguauucugucaaagcaacaaaaaguaacuaauacagaauacugguaccagaaguggggcagaaguaguuucuguguuaaaccuggccauguacugcacaggcuuuagggauuggguuuagagguggacaugguugaguuuguaguugugagcuaacaaagcucuagaauacuguaagaagaacucacugggcaacucgaguugggagcccugaagaccugaaugcccauaauaacuuagacaccgaagacugugugcaugugguuucagagaauaaggacuccauuaggaauugagcuaaagaccauuuguguuacauuuugacaaggacugucuuuauucuuaguacuugaauauggcugaauugaaaaauaauagaauagcugggcgauggugcuguacuccuuuaauccuagcacucaggaggcagaggcaaguggaucucugugaguuugaggccagucuggucuacugaaggaguuucaggacaggcagggcuacauagagaaaccucaucuugaaaaaaugaaaauaa

SEQ ID NO: 23 - RNA, 35130 nt, Mus musculus
ugaagcccuugguacuuguagucucucauacacaggccugcuuugagcuccuuuuucuuccuugacuauggagacuugagucuuuugaaaaaccucacaaguuagggcuguugauugucccugaagcaggaaggucugucuuccggugaccuuuuuacuaucucugcccauaugccagucacugugguggcucuuccuggaccuguauuacugcccuuguggguuugucugacucccugcugguuccccuuccaccagagagaacacuugaaaguacaguccagagcuugacccuccagguccccagggccaggcucagacucuagccuuuacucucucucucucucucucacuuccuaugcugucugguuugggguuuuuguccacacgcugaccaagugucagacauaggcuucacuucaguuacgucucugcuuagucauucaguuaaccacugauggguagugauuacuuuuuccucauccccuuuggcuccucccaaauucccuagcuugcugacagguccucucaccccagagcucuccuaguuugcuaaaugugaugaccagaaaugacagaggccucccuguucuaguuuguuuucuguugcugugauaaaacauuaugaucaacaggcaaacuuaggggaagaaauuguuaacuuggcguauacuucgaguucacagccuaucauugaggcagaaaccagauguaugcagccaaaaccccaaagauguguugugauaagaccucucaggguagcauuagcaccaccuucacagcuccagacaagggcaagccucccuucuaccucuauuauucuaccacuauuaguuuacauacucucagcugcugcugcugcugcugcugcugcuccuccuccuccucuuccuccuccuccucuucuucuucuuuucuucuucuucuuccuucuuucuucuucuuccuccuccuccuccuccuucuucuucuucuucuuuugagacaggguuucucuguauagcccuggcuguccuggaacucacuuuguagaccagacuggccuugaacucagaaauccaccugucucugccucccaagugcugggauuaaaggugugcaccuccacugccugccuagauagggucucuuuaugaagucuugcuauucugaaacucucuguguagacaaugcuggcuggccuugagcucacagaaaccugucugccucugcuuccuaagugcuggaaucgaaggaaugcauacauuugacuuuucucagcauuuuaaaaggaagcaucaaauauaaggucuuuuacaccuggccuuuuucaucaacaaaacauuuaaggguuuuguuuuguuuugucuuuguuuugagacagggucuuacuuuauaggccugguuggccuggaaccuguggagauccuccugucucugucuuccagguuacacucauaugucacaauaccugacucagcauuuucaagacccgucugaguuauaccauguaucauggcuuccuucauuucaauggcugcauuacacucuguggucuggacaaugucauguggacacauuugucacuugaugggcaucuuuaguuuuuguacuuaaaaauauauuauuuuacuuuuauguuugccuuggguuaucuaaaggaacagaacugauaaaaugaauauauaucaaauauauuaaaagaguauuagaaugacuuaccggcuguagccugguauuccaacaauagcaguauuccagugggaaggccaagaaucuggcaguuguucaguccccaagacugggugucucagcaguaccaucuagugcuggaguccuagaggauuccugaagagaugcuggucuuuggucuauguugaaauccuaaaaaaaaaaaaaaaaguagauccuaacaccagcaaaggaaugacucaccaacaaaacagaugaacaagccaauaagagugagggaaaaugggggcaggggaggaagcaaguuuccuucuuccauguucuuuuauaugaccugcuaccaggagguaugacccagaguuaggucuccccuccuaacugaagcaaccaaguaaaucccucaaaggaaugcucagcugcuugaguuuuaguugauuccagauauagucaaguuaacagccaaaguuagucauuacaaaguguauggauggaugccuugccugcauguaugugcaucauaugcuugcagugccugucaaggccagaagagggcauuagaucccucugagcugaaacuacagaacauuauaagaacccacacucagguuccuguguuugagaagcaagcucucugaacuucugggccaucucaccagcccuggcucuacuuuuuggcuaugauaacaaaugcacauacaaaaaguauguggaucuguucuuguauggauguguuuucauugcucuugguugaacauacacauguuucaacauauggguaaauccuugagccaaaugucuugauuaucaaccccaccucaagacaaaaucagauuccuuuggggaaauuuagaaguuuuaugacgauaagacuuuccucucaugacagugcaaagauggcuauuuguugucacagguaucuuuuagaaaugaguauuuucaugaaaguauaucacacacauacagaauuacagagagugugggaaccgugguuauugcaaguucagcucauauuuuggucucuauuuacucuucaaguagagaagugaaacacuuuggguaucuggguacuugcaugcauagagauauuacuggauuuagagucacugccugagucccaacaagccagauugggcugcucauccuuaaacucguuaaaaaugccaagucaaggcgcaagagagauggcucaguggucaagagagcggcugcuuuuguagaggacccaugucagacagcucacaacaacuugcaauuccaacuccaguggcuucuacaccccuuacgggucucuauaggcacccacacauccacaccacacacacacacacacacacacacacacacacacacacacacacacacagacagagagacagaaacagagagagacagagacagagagagacagaagcacagaaacagacagacagagagcauacacucacacagacacauuuauacauaaauggaauggaaauacaccuuuucaaaaggagacaaauuaauaaacagaaagggagcgauuuauccaccauggcuacauugggaagaaggauagugggauccagcaauccucugccccaaguccaucuucuagacgcugacaugagcuuaaggucgagaggucagguaugcauaacugugcagcccugaucaaaguauggcuccuuggcccacgguuauuucagcucccaagucuuuccuacaguguccuuggacaaguuguaaaucuuucuucaggagacaaaauccucucccaguuguugcagcacuuacaccuuuucuccccccgccccccccacccccgcugccccagauuucuggggaaaaucuaauuuauuugggcccauugucucaacagacugauaaccaaagagaggggcagggauauucauuccuccgaggcagcccauuaagaggcauccuuuaggcuggugcuuggcuguguucugauagcaugacauauuuacaaauacgucuuucaauuccccuuuucucaacaaacagagccaaucuccugccaauacaauguugggacuuccuguuucaguacaaauauugaguuagcuuucucaucgugacaaaauaguugucaaaacuaacuucaggaaguuauuuuggcuccugauugaggcuccugcagacaaggcgaggcagcagggagaugaggcagcgggucacaucacguucacaguuagcacacagaugaaugcuggcgcucagucaucucccucucuucuuucaugcaaccuggguccaaguccaugcacuugugugcuugguaucauagauaggaaauugcuauuuuaaggcaagaucaccaaugcaugcaucuauccauccauccuuccuuccuuccuuccuuucuuuguuuuguaaaaaauucaucuuggauguccugaaacuugcucuguggacaaugcuggcuucaaacucaagagcucugccugccucugccucccaagugcuggacugaaggugugugucaccaugcccagcuaaagguuuagcucuuaccuucagaucuagggcucauucuuuaagauuuauuuuugccuaauuaauuuuuaacuauuuuauguauauagguguuuugucugcauacaugucugcacaccagugccaauggaagccauaugagagcuucagaucuccuggaacuggaguuacaggugguugugagcugccaugugagugcugggaaaugaauccagguccccuugaagaacagccagugcucuuagucauugagucauggcucuauccccuaggucucauuuucaucauaauguuggcagguauuacacuggauagauuugucuucguuuuucuguguacaaggauagcaauacuagaaccauguuuaaaaagaccauuccuuccccccauugaacugucuuguccucucauuuaaaaugaaagaucuauuccuagaauuucaauucuauuuauuccauugaucucuguuguuauuguguuaguuuuuuguuuuguuuguuguugguaguuuugcuuuuugucaaccugacacaagguagagucaccugggaagagggaaccuauuggccuguaggcaggucuuuggaacauuuucuuuuuuaauuauggauaugggagggcucagauagugguuggugccaccccagagugagugguccugggcuacauaaaauagcaaauuaaggaagcuuugaggagcaagucaguaagcagcaucccuccauagccucugcuuccguuccugccuuggcuuuccacaaugauggacuauggcuggcaugcauaagccaaauaaacucuuuccucugugugcuggacaguuuuaugucaacugacauaagcugaagucaucugagagaggggaaccucaauuuuaaaauaaaagaaaaagaaaaaaaaagaaaagaaaaugccuccauaagauuagguuuccauaagauaggcaagccuaugaggcauuuucuuaauuagugacugaugggggagggcucagccaaaugugggugaugccagcccuggguuucuauaagaaggcaggcugagcaagcuaugaggaacaagccagagaacagcacccuccauggccucugcaucagcagggccuccaggcuccugcccuguuuugauuccugucccaaccucauuuggugauucacaguuaucuggaaguauaagccaaauaagcaccuuccucccuaaguugcuucggucauaggguuucaucacagcaauagcaacccuaaccaaaacacacccuaaauugcuuuugguucugguauuuaucacaguaguagaaagccgacuaaaauagcuauccuuaugcuaucccucugucucccccaccuccccuuuugaagacaaugucucauauagucaaggcuggcuuugaacucccaacucuccugccuucacccuuugcaugcugggaguacagccauauuuuaccauacuagacuuuagaacaauacucuccugacuacucuagcuuuguacugugaaucaagaaguauaagcccuccaucuuuguucuuuuccaaaauuguuuuggcuauccuuaguccuuuaccuuucccugugaauuuagggucaggucuugcaagauaguucaguggguaaaggagcuugacgccaagcuugauuccuuaaggucaaucccuagcacccacaugguggaagcagagaaucuagcuguccucugaccuccacacacaugccacaugcuauagcauguacguguacaugugcacacacacacacacacacacacacacacagagagagagagagagagagagagagggagggagggagagagagagagagagagagagagagagagaaaauaaacaaauaauguuuuuuaauuaaaaagaaaauaaccuugaauuuagaaucagaaaaaaaaaaggccagacaacuucugaaguguuaugaccugaaugauaauuuugucuuugauuugugaaagucagauccucucaaauauaguuagauacuugguuucuuccaagucugcaagucucacacaucuuuagugacuuuaucccuugauguuucguucuuucugcugcuauucuaaaugagaucaucauuuagacuccauuuuggauuauuuacuacuagucuauagaaauauuugucuuuuucauauugauuuuauaucugccacguuguuaaacacguuaacucaggcaacuguucaaugucuugucuuguuucugugccaaaaauaccugacaaagugacauaaagaagaacagauuuguugaggcucacaguucaaggguauaguucauaaugacagggaagguguggcuacagcagugugaugcagcuugucacuuaacgcccacaaucaggaagcagagauaaacacugauguucaucucacuuucugauuuuuauucaguuuacaacccaaguuuaugggauggugucacucacacuuagugugaaugccuguagguaugucccacaggagauuuuaaacauuugccagcacccuguccugcauggcaccuuuccaucuugcuggaucauccuuccuagaacccuggggagaaaugccaagacugccuuguuugcuucacuuuguuacgucucugaccuuggugggugaggagccuucagucuuccuugagaagaacaggcucgagacuuuuauggaucuucaguucguccucaggucuggaggacagagccccuucuauugcugcugaaugaaguauuuuaucaggagaguuguggggcuuggagaauagaggacagcauuuccugugacucuagagaugcucacaagaguuuugucuggcauugcuuggccguuuuuggaugcugagcucuuucaauacacagcugucuuacucccugaccugcauaugaauuucuagcaagcagaagugaugaugguggcagccaacaaacccuacaagagcaagcccuacauaaacagcccagguuggggagucuucauuuuaggaaaccaugguucuacaacaaaaucccccuaccuccugccaaaugcacacagcaggacuccucuguggagugagucacaagacucugggacugagccaaaaagagcuugaccuugacuuucccacaggccaggcccugcuccaaguaacaaggacacauugaccuucuguacuuagagacuuucugcagcauuucugucacacuuggggaaacugagaagccaguacaaguucauacagacaggagaauugugagacaagcccuggcuaggaaggcccauucuucccaucuucccacaccugcuggacaagggaaagcaaauagaaacuucccauccugggcuugagcuucaucacuguuuucuuggaagccagaaaagagauauuuucaggcugagcuaaccgccggggacauuuucugaugcacccucuggguaccuacuugguucccccauguccuuauaaggccagcuggcaggauguuggacaagucacuuaagauguagugcucacaggugcaggcucugcaaggcaccccuuguacucuugcaaccaaccagucaucucagcaagucuccugggccuaugagauuguucccuaccccaaccccuucaaugggaacagaaugcagccuaagucugccuuccaccuaacucagaccugucuggccuucugcccauaucuguuccugauccaagagcuuccuaccaaaguccaacuugguaaaccgauuaguugauuuagguuacuuacaaaaguaugggugagggguuacuuacagcaucagagacaacucaaagggagcugugucaccaaaaaccucagcauaggugauggcucacaaaagcuggaacccuggagaauggcacuugaauaggucaaagcaugggcugucuuccuaauuauguaucuuuagggaggaagggaccuguuaguuucaggaacgucuaaaacuuguuaguuguucauuuccggagucuuaauacuuucccuccagaaagggauguuuuaauuuggaggaaaacugcuuuacaaaaaaauucccuaccaugauuggucaaacaucauggaaacucucuccauagcauguaugugaccagaaccuaagggccccaaagaagcagccuugguuucuaggcuguccauagcccuuggaacaguuccaggaacacaauggcauucacuaaacccagauguaucacacaguacauaaacaaaacagcuggcccugcaugacguucaauguguaaccccacuuuaggcaugagguauccccaucacuggagacaguggagaucugaagagaaagcagguccccaucucugcacgugcaagaacuauucuugcccacuuuuaaauaaaaagaauccuaagagacucccuccuggagacucaaaugacuuuuagugugauauuacuccagcauuuggugacuaguguuacuuuuguugugacaccacuucagccuccaagaacuauaaauguggacacaauccuucacuguagcagcuauaccagccugaagccaaaacaaaugcacaaauuaacucucaagaagccuacuagccuagccgaguagagauagcuccacccaggcagcuacuggccaaucaucagguuuacauguaaauuauacauaguucaaauuuucgcccuuuagacaacugggcaugguguccuaaaccuacagucucagcacuuaggaagcaaaaguagacagagcucuguuccaggaaccagggcuacauugugagauucucauucucugucugucugucugucucugucugucugucucucucuccacauauauauuauagauauuccuuuccuuuguuuaaauauauauguauaucuauuccuuuuuaaacauauuuccaguguccuguagccagaggggugccaggugugaucuccauagggaacaauguccuuaacugcucaaagauuuaagaacauggagugaccuggaaaaggcugagucuugggaacugguccuuccaugguucccagugagucuaaugaagcagccccauugcccuucaguuuggggaagggaaugccaagauuucacaggaauaucaucuaugaugacagcagccauuccucacccgggaaggaagcaccucugcccucugaaucuuuccucacuuccuuauuaaucccagcuuucagggaaccagcuagaggauggaggauggacucuuggaaggcacagccaggauggcaugaauauuugaaggugccccugaggguucucgagccuaaagacuggcuaaagacauuggguacacuauugaccuucccaaaugcagccuccagaacugcagccaggaacucuaucugugagauaggggauuagcaaggcuacaaagaauuccauucuagaccuucaggcccacggaguugcugccugggagaucaauauacacaaaacauguuaacuuuuaagacucuuuacugucgagacaccuccacuaggguacccuccgggaaaguccaaggcguccgaguaccggaggaaguaaguguggcuucuuuggggcaguaucuuguggccaguucuuagucgcgacccagaagccugccccgaggguugggaacccuuaagaaacuuggagauucauccugcgcacgcacagugcaccgaguccccaagaaccagcugcaccaaguuccagaacgcuuacucugggacugagguggcagcacccacccaaguaccccugguccgggcaccccgcgggcggaaggcggggccagggguggagcguccucugggcggggccucggaggggcgggaccuagaggucuauaaagagugaggagcuaggcgcgcgcgcccgguccgagcgagcgcguccuugcuucaaagagauagugacucucgcgccuccggcuaggccuccagcccuucucuacccuacgucucauucuccgcaacgcaguucuccggcccgcaagcgcuccaggcuaucugccagucccggaccccgguacugcguccccauaccgcccgcuccaggaccaauccaagcuccgcaggccgcgcaccgccauggggguggagggcugcaccaaaugcaucaaauaccugcucuucgucuucaauuucgucuucugggugagcagccacuggggacagggcgcaccccacgguagccaggcugggcagcgcgcuaggcccugcugagaaggcgcagcgcaaccgcgaaguugcggcgccaccugugggcuccgugcgccgaucgggguccuggcgccccucgccagcggguugaggccgagggcugagcuucugggccucggcucgaggggcuucuggggccgggaaaucaggggaucgcuggccuguccccucugagugcugggaacuggugcaagagucugcgggcuagagccagguaaucaagagcccucagcuaugaaggggguacucgcacccuccugaauguuguuuuggggaccauccugcaucgcgagcagugaggggggucgagaagggcgggaucuuggcgccccgcccccaugagcucauccuagccaccgccccuggauaggcggccucgaaguggugggggcacgcuccguacuugccucggagaccucaaccccacuauuacuccacccuugcuuacccuccagcuugguauugccacccugggggcucgagcuccaggccuagaaggcagggcagcccgggccgcgugcugcugcgcacggugccccaguucuuggccacccccacccccauucccccagcugccccuccuccuugccugucgucuccugcacagauuacagccccggccugacccuuagauccugagaggaagaggguaugcaguucugaguuggugaaggccaggguguugcaaagaucugggaucuguacaaaccaggagcuuaggaucuuuuccuauauacaggaucuaagcugggcucuccacuuuggaaagaagugcacacccauuuggucaucuuggaaaggagacauggguauaagagggucuccaagugucccuggguccugacugucuucacugcuggggaguagccauuggugguaugggcuucuuuccauuuccuaacuggguugggaauggggagucuuaacagaccugccugcgggcacuugagugagcagugcuggccacuccucuggacaguggugccacccucccugcugcagugcacagacugcuguucccaccacccuccuucccaggaagaaaugagguuaugccaagacaauguuucucuaaaguuguuccugagagggcaaacuuguacaacggccccuggagugaguguguuggacaggggacaccuguuuuccaucgaggacugcugaagaucccagggcgggucagggugggguggaggggaauaagacguuggggaugggcaggaacugggcugaacucagcuggggcuauguaugcucacgcggugcugcagggaccaagauugucagucacggugacuccagagaacacauucuagggagcagcaugggcgaugggguuaaacuugcucugcccgggcaugccuuggggucucgacuggguagucauguuggacagugcuugccuacucugaaccaugcaaggaauugaaugcacccucaagaaguguguuauccaccccaccccacccccauuauucuucagaugugggaugucaggauccuguaggguauuucuuucuuucuuuuuuuucuuuuuuugcucacccaccugauccaagcgcuagacccucagacucccuggagugcugaggcugggugaagcugcucguuucccaggcagcugggguggagucccaacaugucccuggggucucuauugaggcuccaggaaacgguucugaagccucucccugcucccagggaccugccuacugacugcagaacagugaaaacuguagccuuucacaaucccacagaccucuccucccuacucauguuggccccacaguggauagggauguggagcagaaccaggcuacaacugguggacaccacccuggcagagggacuccuuuugucccucguguggcaagguuuguacuguggcugauaguucccugauaucaugaaauugaaccuuuggggagccccaccccaccacucuggcccuuagucuucacuuccucccucuaaagugggaguucuugggggucucugucuccuaggauuguguguagacuagcuaauguacuccagaguggggcaaggggcuuggagcagagaaggcucaggaaauggacacuggacacagucuccaaaagggaguggggccaaaggaagcugagcaaugaugucagaagggccuaaggagggggcugagagguccuuugggccguggugggggcgggggcuaagagcucuaagaagggagauuugguugacaguaaauguuucgauggacacuuuuuaaaauuuccaguuugaagauuaaagugguuucucugugggaggggacauuccgggcacacuaaccugccugcugucacucccaccaguccuccuugggcuugaguucagaaccuauauuggggccagcagaguucuggacucccaagauauauggggcaggacacaaaccugaaagaugagcggugagcagcagagaccauguaagaugcucuuagaagcagggugguuacucauccccugagacaggucugggauuaaggguccagucuccucuggcaauagucaccggcuggcaauagggcaggagagcaggggaugguuuaucacugugccagccuauggccucgggugggucuguaggagcuuugugugacaaugucuccauaggaguagucaguuaaggagaagaaucuucacuguguuccccgacagaacaggcuguuccuccagccuaaggcugcugguggcccccguccaguagcccaggcagccagacccaccacaaaaggcugauuacagccucucaacuggcauuuaauucuccagacugaacaugacugucuguugugcucgcuucagcaacacacauacgugacugucugucacauaguggucugcuggcugccuuccggcagaggggcucuaauucugugggcucaggguggaaugagcacuuccugugacuugccccuugcuccuggggcugucugcuccgcccggcuuugggaaagacaaucauuggccugcaaaggggaagucugugguucaucccugggcuggcuucaaaaaaaggacauccgaacagugggggcacagagcuggaguagaccuggcagccucuacucuggugcccacacacugcgaccucauaauaagagcccccacccccauucuuuccgaacccuuuaggcauucucucggcacuugccuucuagcucaguccuaccucaaacggagcuucugugaugcucuaggagggaaccaacaacugccaaccuugauuccagaacccagaguccugccaaggggauuggaaccucaguuauuaaaccucuagccuuagaguccagcugcccuagggagagagcaaucauccuuguacacaagagagggcguaggguggggcagaguuauggagaagucaagguaccuguggcucuggcccugaugccagggaaccagguaggacacggugugaguguugggugacucugagugugaguguugggugacucugagacccuauagguagggccauuuuguuccuaggacuguugcuagagaaccagguguccugagaacuggccuucaguagccuucaacuguucaguacucugaccuggcaugccagugacuugacugugaccccuaguaccucccucacaaacacaaacacacacacacacacacacacacacacacacacacacacacagagagagagagagagagagagagagagagaucacuucuagauccagucuaagcuacucucccuggcuagcugcagggcauaggcuaugccauucaaaacuauuuggggucuucugagugggcucaaccuuugagggaacuguucacaagggguuggccagugagcagcuagcugguggugggcauccuggaauggcuaccaaaguaacugcaaggggauguugggagagggcaccugccuuccuucauaugaagucuggagugugugugggggggagugcauuagaaccagggcacccauaguuuuauagccccauagcacugaguugguaaccgaagccaagagccugguugccaggcagcuugggcagaagcugcugaguaacagggcccccgaguguccuguguuuccuugcacuaucucucggaucacuccauacaugaugucagcuugggucuucagaacuuucucagggugggucuguggcauccuaugacucauuuagcugugcuuuuacccauggucaagcaucaauguuggcucuguacugcagcuaaacagugagggguuccaaugguguuuaaagaugucccgugugacggggagcaguaaugaggaagcccaggccaccuguccuccugaagcccaucccugagcucuagaguaggaccuuguguugcaagggcuuguggagugugacaaacacauacuguggaguguggcaggcacauacuguggagugacaggcacauauugucacugccaccaacccacuaguguuaacucaccuucucacaacuuuuuuuguuuguuugucuguuuucaaggcagagcuuuucuagccauccuugaacucacucuguaaaccaggcugggcucaaacucagagauccgccucccucugccucccaagggcugagauuaaaggccugugccaccauugccuggacucucauuacuuuucauggcuaaaaauccucaugguuggggcaugacauggccuuugacccuggaaacagucuucuccuguacucuggaguccgugauaacagcucauucagcucaccgaaaguaacacuccguugggcuguuaucagacccguugcgggugauaaggggacugagguuuccaagcaacuagcuaccacguucggaaguaguaggaucggguagaacuacacuccacucugccaccauguuccauagucaaaguggccuguaagacccugccagccccacagccugaccuugggacagagggcuaugcccagccuggaacagauagaaguccuuuggugcugcugguggugaugccagaacuacauagagcucuucuacccacucucaguccccugccucccuuuguuccuuuuucuggguaccaggacucccugcagcacuuaucucuggcagacugcuguggcgggcuggguccacacagucucccuauggggucucacgagacauuggccuuccuagaggagggcaagugcgggauagauggggaagguccuugccuucuaguuuccuugccugagaaggagccauguagucuggcccuggaaggggcccagcuggguggcccagcccaaucucuugaaccucaagacagcaguauauucucccauggccaugccugggccauucacaccacugccccuagccugucaguugggccccagagcuaggcauuugcuuugcugccuauuuuuagaugcuaugacaguggcuuccugagacgaggggccuugugaaaggaaccaugcuuccugcccaaggcgaggauuccugccccucucuccagcuuccuuccugagcuuccuuugguagacuguaagucuuuaccucuccuaggaaggccugagcaagauccauugucucucagagaggaaucuggccuuguccccauccucuauaccccagaccaggcccaggaccccagcuagaaggacagcaccuaagucagccucuaccuaaccaaugccccuaaaaccagucugagccucuuuacucugacuuaucccagcugcccagggucuucacaaccucugccaucacaggagagguucuugggccccucagcaccuccgaauugcuuaggugggugagcacuuuguggugcaccuucuagcuugcaucauguacucaggaggcuuugaguaagccccaacccugucugccucugccuuugguucuucucuugcggcccaaaugguaacucaaaggaacaagcugcuguuacagccagccuccaggagcauuuuggggugcuuuguggugaccauucauaccuaccaagcugguuucaggagcccugucccuuccuagagaacuucauauggguagcaauaggaaugcuucagagaagccccuaucugagucuggccaaggcugggcagugggcagcuagcacaggguagaaugcugucccaagccuguacccuuucagucgcuucugggaaaccacaagagcagcugggcagggacccagcaugcuuggcagcuccucgacuuguuaaaguuugagucuguuauggauuagcccuuaagaaggaggaagcaacacaauccuguauagagucaugaaugcauccuuuugugccagggaaggagcuccaggaaccuggacaugccaccugggugcgucccacccccaccucuaaacagaaggucuuuuaggcugcaggagcagguggcagggccaccuggagaaaggaagcuuugggcagagguaucuuagagccccugaguggauucgggaagaaaugccagguucugcuuuguggaucacuuccucagcucugucaagagcuaaauacagugacaucacacuuagcagccuuuguguauuacuuccccuguuuacaaaugaccauaaggguggaggagauagagauggauuugugacacccuagcuccgauaugacacagauagagauucaggccaucuuuacccuuuccuggaccuccaucuaauggcacuacuccauauucccauggacauuggacucacacacucucccucccuccuucuuucuuucuuucuuucuuucuuucuuucuuucuuucuuucuuucuuucuauuucuuuuuuuucguuuauuuuuuaaaugaguguugcccagauuuugcagaucauucugaccuaugguucuguaaacaagguguauuccuaauugcugcuaauacugggacaccccuauacccuucuugggccuggggaauauacuugagcagagccacugauccagggaccguggaguggagggggguaaguagcuuucuguagcugugcuuggcauuuacacccccaugaaacuuagcaccaucaggagaguacccugggcucuuuguggucuaaccccagaacuuccauuggguuaucacuguacuaucuugaacgaccuuugaauucugcuuucaucugagcagggucagaaggcgcuagcugcuucagcuucuguguccuccuuuugcuccccaugauugaacuguccuccgugcucucucacgggucugucuuuucccuggagauucuaccauucgauggacccagggccugugcauucacugacuggaacuagaacuccagaacucccucuaccucucccuagaguagcaggguagacggucacuuugcuggaggaagccaucucaguaccuggcauuccuucccacucagcucugauugccccugggacaauggggugaguggccaaguccccauuuccagaugccuugccuacccccaccccaguuuggccucucuucugauugacagucacagauccuuagccccccccccccgugcaccccccauucaggacugucaguuaaugaauaaagcccagagacuuuucuagaguuaacguccucaucccaccucuuucauaaaacccggcucuaagugguggcuuggccagacacccacauuagcagccuuuggggcucggcugaacagcaugccucacuccccuuugccccucagcucacagacaguauucccguaccauuagagaagccagagucaggcaugguugcaugcucagcuguuuuacagguaagcacacagacugaggaaagcaaggugacccaccagcugccccuuagccucugugacuaucagggauugucaccagggucauguuaucaaugagggaaggauggggaacaggugugccaccugguucuccugcccugggacaucucagagcagccuccagaccagaucuuaaacaaaauauaggauguuuaaaagcugcaaaggaagccugguuaccagggcaacucagacccgucaccucccacccuccugcuucuguugcccaagcugauucgagcgagguucuuaagggcagauggauaaagagcugucaguguaacaugcuggaaauucuggggaucccuggcaucgcuagggccguuacaugugaaggcacugucagagucucagccuucaugccauuugugguuugggcaacgggugcccgggugugacuuugauugcuguaucacacacccucuucucucaggcccugguggagguugggggcucaucccuccuggauuggagugugaaaaacgaaauuaagcacuuaaagaggagucugagaaacugagaaagaagggguggagggagagggagauggugaucaggaaaguaccccuccccagcuuccucucugaggguuaagcagcggacaugauccuaggguagaagaaggcagauggguccauaggucuucuuuccugaaccagccugcuugcaaauuucucccagagcuuucuugagcuuguguucuggccuggauccccagagugaagagcagauacuuuuuuuuagacccagguuuugguuucuauuugcuguuucugcuggggagugccacugacccuucaagaagaggagaccuggcgcuggggaggagacugccuuccuuggucuguucugaggcccagcuucugcucccagguaccugcuucucucugcggggccugguggcaucacauggucaccccugaggacuuggugucuccaccacagaguucccaguauccugccugaagcagucucuaaucaaucccaggacuguugggacaggguaccugaggagagcccaccagcauccugaguggcugggccucacuguggccauuucuacgguaaaaauguugcauaguuggucaaucuggaacaguaggggggggggauguuuccugcugauuuuggagacaagguuucauauagcccaggcuagucucaaacucacaugaccuugaauuccugauccuccugccucuaccucucaagugcugggaugacaaacaauugccaccaaacccuacgugguacuggggauugaacccagggcucccuacaugcccaaguacucuuaucaacugagccauauuuuucagaccaaacuucuuguaugugucuugcgcuauuggagguacacuugaauucuguucuggaguuacaaccaagaggagcuggugggacccagggcucaguggcaguggcucagacaacugcuuggcaucuggcuccacaacuggaagugagggcucuacaugauaagcauuguaggcuuccauuggccccaguacucuggccucuauaugacacuguuccugguuuucauuucuuucuuucuuuuuuuuuuuuuuuucuagcuggcuggaggcgugauccuagguguagcucugugguugcgucaugauccacagaccaccagccugcuguaccuggaacugggaaacaaaccggcacccaacaccuucuacgugggugaguaccaaggagacggguuccagucacagugcagaacagucagggagggcuuccaagaagaggcugaugguccaaaucuggugggugaggcguuagagcugggaguggccuaggccuaguaugagcuggguagggaggcugccuauaagaggagaaugaguuggcuguggugcugcuggugaccccacagaucugagacuagacuaggcagaaaggaagcaacgggguggggcaggggccuuguaggaccuugcuuauuuuaacaugggcauuucuagugaaccucccugggcaggguggggcaggaugccugggcuagcaacagcugaggcuccaggaguccugaguugggaagggcuggagacugggccgacagugaaugacucagacaccccaccccaccccacccccaccagcacacagcccagacuguuacaccugccuuauuuggcugccuguaggggcugaacacccucccuccuaaguaagaugauggcuguugugcugugugguccuaugcucugguccacuacacugugcugaaggagaaaacuuuccucuuuccucccuggaagagggaccugguguccugagaacugaagaaguauuuggagaugucuuuacccuuccaaagcuccuaccuucaucagggcucugauguggaucuuccuucuccuccuguggagccuagaagaggcuugggaggcaugcuugaggcugagugggggaccaggaggucugaaauauucucccuuucugcccaauugccucagagcagacagggcuuuugguuaccccauggcucgcucuguuuccuuccucccuauacucuguccacagccuuagcauggguaaaauggacagcaguggaguccaggcaauaugggcaggggcagaaccuggucuccuuugaggaaagccaugagggguagcaguuuucagguuugguuguuaguagggaagggcccacacuagcuaucccuccuucuaucugguaccuucagagaaggaggaugcccuccagcucauagaaacuggauuguggcaacugguaggcaucuucacaagggaaaucugggaaucagagacagacagggguagaacuggccggugggcccuccacaaggggaaggcugugcucccacucugcacagguauggcaggagaggcuggcuacccugcagagcccagauagggugguuaggaagcaagucucuauccuaauguucucauaauagucuauaccaggcuccaguuccagagcggcucagccaccugccugucugguuauggccuccuggguacuggggaaauagucuuagggacuggacccuguagcagguucuucuaccuauggguagaagcuacucuggcugccaugucccuggccaaucugaauuggcuuucuggagccccaugcugccccuguacugagucccucuaggagcagauguggcccugaaaaaggugucuuauuuagugcuuaggagaguucauucagagcuugcuaaacaucccagacaacaccacaggggcuucagaugagacaugugcuagacauaggagggugccuagggccuagaaaguccugggacagugccuguguguugggugcccuguauguauccuccuguugagacagagccuccuguugagacagagugagguugggguuuuagggccugacaacuggggugcucugccaguugggaggcaagggggaaaacaguuucuaggcagcccuggugggaggccuuccccggaccagacguguuuagugaggccaaaggauuuggccuauuuuuaagucuggcagcagguccaggccauggugccuucuccucuggucuggccaggcagggaacaaugggccugacuuugugcaaggaagcuuggacugcccuacaguguugccguggagacugggggauggacggcuucugccgagggaccaagagauggaacgcucaucaaagacacagugggcuuucccaggggcagaaggggguauugugggcacugaggcagggacauggcccaguugguaccucaugggcuacagugcuccccuguaaacugugacagacauugggugcucugcuuaagcuuccccuaccauucucuuagccauccacccacacacaggaucccguccuuagaguuaggugagccaaacaguuauacaccaguguuccugagaugaggugccuggaguugguuacugccauagcuuacccuugauuucacacucaccgaguauugggagucuugggcauuggcuccugacacccaagccacuuccccuaacugaaacggauaguccgucucagcccuuuacagugcgugcugaggguuccuguucucagaugcagguggugggagacuggcuccagagcagagcauaccugugaaauggagaccacccauguucucuggucacugaauugcugcuuuguccccugguggcaguggcagcuccuccagcagcacacggaggcauaaacggcgcacauugcuaaacucugccugcugugguugugaguuaggccuuccugugugauucaugcagccugcucacucaggucuucccuuccccaggcaucuacauucucauugcugugggagcugugaugauguuuguaggcuuccuggggugcuauggggccauccaggagucccagugucugcuggggacgguaaguagaaagggcugaagggcuggggagcaggguuccuagcaacuuauaugucuuccccaagguuuugguuuuccuaggggcuugauuuccauugaaucugaguaugaauauacauguuggaaaaggggguuucuguuuaaaaaagcauaaacuccagaagggugucucaccccuaaagccaaccuuagugcuccuggccacacuagcugcuggugaagcugaaucccagauuugccagaaucuggccagccugggagggaggcgcugccaguaucagaagcuggggaaaggcagcacacgucauagaauguaggauaaaggaggugaggaaacugagguuaggguuggggagugucuugcugcaugugccucagugaaggcuguggacacuuugucaacugcauuucuacaccagccacauccugcaaaguaggaugcaaggugaggcuaugagaacuugaacaucucagugcaggacuguaucaggcucuugucucucaauggcucuguguggcucaugcuuaaucaggacaugguugguggauauggccaacccccuuggcacauagcuguuggucaugugggcuaggccugggcuugcuggucaaggcucugaccucuucuuuccccuaguucuucaccugccuugugauccuguuugccugugagguggcugcaggcaucuggggcuucguaaacaaagaccagguaagccuagguucaccgagugggagauaugcccucugcccuccaacagauguggguugcucugagcccauaguuauagggugcuuuuugaauuucuuggaccugcugcuugggugggggcagggucuugggagcucaguggaagagguggcaucaggcugagcccaucgggaaguugagugcucuugggcguagccccgacacuguaugugacuaugauucucccccagaucgccaaggaugugaagcaguucuaugaccaggcccuucagcaagcugugauggaugaugaugccaacaaugccaaggcuguggugaagacuuuccaugagacgguauagcuaggcucaagcaggaggggaggcugugggguuccuagugugugagggcaugggucuccuuucuuuccaacacaacagggccuaggaaagggucuccucuaugauuuguggguccucagguaggaaucuaaugggccucauuuucccagggguuugaaggaacagggcuccugugcagggugacaaacagggcagaaggacaacucccaaguguauuuuggggugacggugugcugugugccugaucuuucccuugucuccugaagcuccaaagcugacaguguuguucuuggucccugcagcucaacuguuguggcuccaacgcacugaccacacugacuaccaccauacugaggaacagccugugucccucaggcggcaacauacucacccccuuacugcagguagcauggaguggggaugaggugguggugguggucgguagggugguguggccaaucaggaagaucagcacuuugagcaagaccucagaagucccauagaccaucucuauuacugggguaccggguccucacagcuugaguuaaccccugcaacaucccagaaaacuguucucuugaguggucccucauacccuggugacccuagggugcuagugagguaaaaaaacacuccccugugacaaaaggcugcaggcagcagguccgugugucuuaaauuuguuuugggguggaagauaagcugugauacauagguccugucacugaguagggugguggcugugacuuagccacugaugguuaaccacgcucuugccaucccugcagcaagauugucaucagaaaaucgaugagcucuucucugggaagcuguaccucauuggaauugcagccauugugguagcugucauuaugguaagcacagggucucuggugggugggugggauccuucccagggccuuaggugcugacuaugccccucccuccugcagaucuuugagaugauucugagcauggugcugugcuguggcauccggaacagcuccguguacugaggcccuuugcauugcaccagaggaucccuggagugaccagaggccaccuugggggacauggccuguguauauaauauuucuguaucacucugcuacacuuagucuuuuuacuuuugaguuuuuuguuuuguuuuguuuuguuuuuguuuuaguuuuuuuuuuuguccugaacuuuuccuguuaccuuuugggagcugacaucacacauggguggcauaugugggauguagggguggagcuggcccuggcuugcagggcccuguacgucugggaccccuggagaguucugccugcugagccaaaccuccucuacagcuacuugcccagaggcuuuguagccuagcuagagggccaugcccacccacucaacccacugugggucacauugcucacaucuuuuuaaucuuuguuccuuuccugccuccauuucaagagcuggguuuguaagcccucuuaugccuucaaugcacuuauucuuucuaacgugucaccuucaacuguaauuaaaucuugaaacagucauuuaauaaaggaggaaaaaaaucaggcaugcuaaugggacugccagaccucuuccugugcuagcggugucagagaccuggcucaucagcucugaacuuugccaggcacagggugagcagguccaauagaggcuguggaacacaguggguggggagggcugggacccugggagcacuccauauggguccucccucauuuguaccuccuuauacugggagcucaaugcugacuuuacgccagccuugaccucauuuccacucaucuguuggacaugacaggucaggcugagucggguaggaggagccaccuaagcagggaaauucagcacagaaugauggagauaagcugcaagaacacccuccuuuucagggacaagacaguaaagguuagcccauuaccccauccaucucaagaaaagauuccacggagcuggguggcucuggcuugugucucaauaaguaaaaggcaagauggcaguucacuuaccccugugaacugaggaucaggcuaagcaaccucccggacgccaggggcaaccaccacugucucuuucccuuugucuccugucugcgccccucccccaggcugcuggcauaguuaauuggccacuagaggagagacgcccuagccaagauucauggcccagcuucuagcagccucccaguaggcuuauuugucggugaaccccaagcuuguacuaggacauucuaggucuccgccaccucuaccucccacgccuaugcaaccuguuccgugcuugguugguuucuggucugaggagcccuuuauauccuauguuaugagguccaugggcaccaggccaaagcuguuggaggccugcugcacagcuucagaaacauaggaaaggagaggcgcaugcagcagccccauggugucucagacucugaucccuaaggauacaagaaaacagccccacgccuggaggaggauuauguguggccuugacuaguaggggcggcguccugcaacuaaaguguccguuccugcgucaggaagcacagacaggcagagcccaggauagcggcuucgaaucucugaagccccaaccaacccaccccagggaccacuacgucucuucaugccaagagccaaccaggaccuuggccccgccucacuccagaaagccaacaaagcacaagacccacaccacuuccgcccagggccggaaaugucuaggaaacugguuggcgcucacagugcguggugacgcacuuccuccuugugucggacccggccgggacggcuuccgacaggcgaagcugcaggccucaacccuuugcgauuggcaguuagcccuggaguauugugggaaccguggcuccgccuuuuccuuuuucgucauuucuggguggguuuccgugugcgcuccggguuggcacgcuuguuaagguuacaagucccggcugacauuaggcgggaacccauugccuucugggaguuguaguuucucgggcgcugaagccacgaaaaucugaucgcccgagacucgguuucccaggaacccgagcgagacuggacaggaccgaaucccggggaacuggcgggacgcugcgagaaaggcggcaggguauugaggcguguacggacgcuggaacggugagcacuggccucccuaaggccgcggccagggcauucccgugccuguuucugccagcccuucguccggacccggguggcgcuuguaccuagagaggcugcgcuuuacugagagcccgugaugggacaagcagcugauggagaucuccugucaccagcaucucccagugcucaucuauuguauguccacacuguuaugaucucaugguugacucucuccuuaaccccaccuaaccugcagcuccuguaucugugcgcgcuaggauacccuuuaaccacccagcuucgcgaggccucccguccggcugugaguagaggcacuugacacauaguggaggugaaagacgggagccugggaggacggggagggaugaggccuuaaauacaccccucacggcggaacugggacugcuucgcuacaggugggacgggugucaggucguauggcggagacagaggcuggccuggaggcugaugaacccaccgaggaugacacccugccuucugacaccgucucccucagcgacucggacucggaccuuagcuuaccuagugguguggagguccaaguguuguccccagagaggcuuucggaggagggccaggaggacuccggcccugaggacccuccaucgccccccacgggcacccucaccacugcagugcagccauuccaccuccgaggcaugaguucuaccuucucccagcgcagccacagcaucuuugauugucuggagagugcagcccggcaggcaccgugcucugcuccccaaaccagugugagugacaauggcagcuucaggcggcccgugacucccccaagucagacuccagcaaggggccugagcagagugcaugggaacacuggcccgacuaggguacucccagucccugacuaugugucacacccugagcguuggaccaaauacagucuggaggaugugucugaagccagugagcagagcaaucgugaugcugcccuggccuuccugagcucucgaagccaggugucccacacagacuaugugccuucuuucaaccaggaccccucuagcuguggggagggaagaguggucuucaccaaaccagugagggacagugaggcuagggcugagaggaagaggguccuaaagaaggggguugggucaggugcggggggugaggccgcuguggagcuagcccaucucgcuggaccugaggcugaggaauggaguggccaccagggacagccagagguggugguaccuucagaagcugcccauccugaguccucaucaggccccauaggugugaaggcuguugguuuccauggcagcaagaagcggagcagagaccacuuccggaacagggacgguaacccuggggggccggggucugagagaggacccucaguuugacugcagugcuaucacucuaccccucaccugcuaguccaagugggaaggugugggcugucugugguagggggaugugugcagccgcucuggcagagacugugggaauugugggucaggggaccucgaaggccuuugugccccaguguuuaggaugaauaauaaacguuuggaauauuucuugaauuguguggcuuuuuccgggccccacucaaagaguucuguccaaacaguccugggcagccaacuacaggacugcaucucuggcagccucaccuugccuuccccacuccagugaggacugccgugaagguuugccauggucauuuacauuugucacugaugaaacuacccagagggacugggcucuuagcuguguucagccuugugccccugaugguagugaaugagcauaaucugcacaacccacccccacccccacccccagaaaccaaugcagccccagcacugggccuguacagaccacagguuauaggaagaggaugaguugugaagcagcauaugguuggugucuggcugugucuccaggacuuguguguguaagacacagcugaugcugggucauuccacugaagcugagccagagaagaagagaaggaugcagggaggaugcaugagcgaauguuuccuguggaggccagggacuuggaccaaguuagcuagaccugcuaagacccaggucugccccagccucuguaguccccauucucugaguuccucuaaaaaggaccuggauggucauuuaauuugaggagcaguggaaggaacggagaugccuuucacuaggucagacaauccuccauauuccccggguguuugaaaugucccguuuagccaccauuguggcccaguuuagcugauuugagguggucuacaggcuuuauagaaaguaaaguagcauuggguacccuugagcaauaucuugggguuucugccagaaugaucagacagauaaugcuguggggggugaaagaugggagguaauuacaauagaucugaguccugcccucuaggagcuggucagcuaaugagugggucaggggucagaaagaaaccuaguguuuaagagguuggcuucuuaggaacucaggguaagacagggguuagaccuaaauagccccauccaggcagaugguguccuauguaggacuuggccagauccagcuguccaguccaagccagugaaagcuuuagugggacaugaaaaaucuugcccugcuggagaggauacuucugaggcucccgaauagaugccaaagacaugaguuucauucucuuaggaagggauguccaagaagugaucuguagcaaggccuugaagaccauuucuuggggcugcugggagugggggaagguugaugugccccaaaaacucgauguggccaggucuggggcucuagagcaagugguuucuccauuucaggugucagaggguggcaagccagacucuagguacucccugucucuagcagaggcuggcugacuccugcaaccacaguucugagagccugggagcaagaaagggagaaaggacccucagcuggagagccucagcuggggcagggcaggagugaggcaagggccaggacauggaaaguggcaaggcuagcaaggccagugcuaggcagagccuugggacacuaaggaacaguggccugccgaggguaaccgaccucuagcacagguggagaaggcaggaccuaauacaauacacagcccgcagcuuugcucuugcccuaaucuaguggcugaagggaggagcccauacccaucucauucccauggccugaacccauacuuacuugaguaggugccuccuggagccaguguauccgucauagaggacaagaggagcauacaguaguuggccuggagagagccaagggagguacugagacuucgguggggacuggggggaccggguugguuuccucccaugugauugcccuccugccagggcuacugcugcccugggacuccacacucuggaccagguccucccauagugcaugauaagggauagugaccggauguggugcugaaccuagguuuuguuggaccagcucuagaacaacaaugagucucgaaagugaguuggggcaggggcaggccacucuauccaggcccuaaugcuacccaccaggaugcugguacagggcugugguaguucccauggaaccagaaggaugcccccaccccaggaagaaagauggauagugaguugcuagcuugccugugauuccagacacuugauccucuuuucuugcucucucagccccccgauguauuuggcaaucaaguccacucuguagaaagcagggucagccucaguugugacacuuccaugucacuccacaagggggagcuuuuuguccuaacugcuuucucagggccucaguuaacuguuggccucuugcuuuacugcccuuccagucuuuaucuggggccugucuauggauauggagcacugcuguacccucaaagagauugagauccccucccugcuuggaauaggccaccaagcaauaggaugaacacuaggucaucccuauaagcauucaagaacagccccuccaccaucuagcaccaacugggcguggaucuucagaccugagagaggaggaaaagagucccauuggagagagaugccuaauuauggacuuaugcucucaacccacacauauacacacacuccuagggcaagagggcugggucuugugacccagccauguuuccccagcucagagguccuguuauuggcacuagauggucucacccagccuuaaggugguucagaaaaccccaccuauuacugaaaaggcuagauauccccccauuuccacauguucacaauggggagccccuccuagacuuacugccccucauaacacccagcugaucaaggucagcccagcccugcugcaucugaguuuaccucccuccugucagagcccuuucuacaucucugggcagcucaugaacaggaaugacaccugccagccugagccucauaugccugcugucccacaggcugccccaccugugugccguuuuccucagcaccucccccucgcugucccuccuccguuucuccaugguacucaggaaguucuccuuuugaaccguuucccagguaaugaucuucugguccaaggggucaggcaagucucucucuggcaaugugggagacagcagcaagcuuuggagagugguguggaccucuagggaaagucuaggcccaggcugaugcaagggagacugagggcagaugccaccaggcagggcacaagguagaugacagaaauaagcccuaugcagggauuucaggcugcaaggagacaggcuggccuuguggcugucuagucucaagucuaccuggagcuuugguuaaccuggacagggccuagacaaggaaccccagucccuucuauggucuccucugucaauugggacccuccccucgggagcaguggcauccagccuggggccucacccagauguugucgcuuaugcugggcuuccuuccugaagaccugcuugagcaccaggcucagguggcugagcaggaugaagggcggggccagagcuggucuuccaugguauucaacgaugaggugguagcguugaaacuuccagaacaugucugcauugccuugcaccaccuggaauguguagcuacaggacacauagccaagcccuugccuuauaagcugcucuaccugccaugaaagcacccuaccucaacccagcaucuaccuuccaccccacacacaacgccccuguaucccauuucccaucuuucaucucaccccuccaccucccacuccuuauaugucaucccccauugcauccaguugguagcuuggcugugcugggagcccuuucagaaagauagaggcuaauaguuagcuuuaacucucaacuugacacagccuagagucaccugagaagggaaccacaauagagggacugucaagaucauagugaccugugggcgugucucugggggauuaguccacuaugggcugcaccauucccugugcaagaggucuugaguuguguaagaagucuagguaaacaugagccugaggaguuagcaaacagcacuccucugugguuccugccuugagcuccugcccugacuucccucaguggcagacugugauccaggaguauaagaugaaauaagccuuuucuuguccuacauuguuuucaauuaguuuuaucagagccacagaaaggaggcuuggaugggggucuggcaccccucaaacacauucucagguauacugcaguggagcuuccucagugggguauuuacacagcucugaguccccaacccuguagacccaucuuccuuccuaacaggauaaacagcaggggugugcucacaguguguccauaccuguaguguuggcucucuacugcagguccagcccacuggacacagcagcaaaauaccaggacauggguccugucucugucagcacccugaaaccagcccuacuaagauggagcauggauuggcgagggcagaugggcagaaguggaagcaggaggguaccugaacauggcgaucagaagguucaugagcagcacauuagugacaagcaggaagguaaccagcaggagaaugaccagccaguuggcauagagauuagggcaggaagccgagcuuuccagcagcagagggugaagagaacaguucacacgagccucuguaaggcaaacagacaccuucagacugggagugugguuccaagcugaggccgacaggcugugggugccagguagguggccaggggccugguuaacauggggcuagcuaguuuaagcaccaaaaguaccagcccuaguuacaccaagccaacaaguucaucuucugccuccucugcugggauuccauggaggcaagcccaguccaugugaggaagugagaacaagagccauagagcccuuuagaucuccuguccaugccuuucucaccuagugcucucagaugggaugcaaaccugcagcuuucuggguaccucugcccauaaugggaguacccagaucccugggcaucccccaaggacucugagucacaaugcuagccccuuauaaaugucauccccuuuauuucugcuucuccccugccugcagggcuuuacccugccaagccugcagggaagcauaggcugagauugcuaucccuccuccuggcuccauccccugucuucuccaggcuguaugcuggcacauaacugucuguauaaguaggugugggcauauaugcauguaugcaugcagcuguaccaccuguacacuucagugaguuauuauugauucuguucuuccggcucucagaauuaugggugaugcucuaggcgaggcugccuugagguacaauuuugggauauuugacuuucaagucuaguauauguacuggcauucuucugaccugccuuguuucucaaaucccugccuuguuuacccagugaguuauuaugaccagucaacccaugugagauguagaguguucuaucauauggagggaugcaaucagucaucugggagugccagauccugccuugcccccuccaaggcugcuuuagcagucacuccauuccccacccuaugaaucugcuccagguucuguuucuccagcucucuucccuucucuaggugccccagaggguggccaagccccuuagaagcaaggaggccuugaaaaagcauaaauccugccugaggccugagaaggccugccugaccugguugaacacaaguuuggcccugaagcccagagccuggugggaaaagggggaagugcgugaaauguggaggagaggugaggacuacccugcagacugggccagaacuacccaggccucaguuucccucugaguacacuguagcuaucuuaagacacaccagaagagggcaucggaucccacuacagaugguugugagccacaaaugguuauguaguugcugggaauugaacucaggaccucuggaagagcaguuagugcucuuaaccacugagccaucucuccagucccaguuucccucugagcacaggcauguuagagaauaccagcccacucccagcauaguagacacaguguagggacuggcaaugcuauuucacugcucacucugccugccacaucuauagugguucugcugacccugcaguggccuccauaccuagacuaaggaccacccugcuacccuucuaaacugccagguggccugagcuuguuccccaauuccuguggagaagaaaccagaauuauaguuacuauggaacucagaccccagagcugcccuggcugggguacucaccuuccucuuccuggccccagggacugaggccaugaggccauauggcucaggggaagggagaagcgggcaaugucuguuuaagcuaauggccuagaaaagugauggcucaguugagcaaacaccaaaagcaaugugguggggagaagaaaacagcccaggguauggcuugggagcaccccaauuagaaguuaauuuccagcccgucugucccuggaggccugggcuugcuccaaucucacugucaucuguugacaaauauucauccaguguuguaauugcugaccuggccucauuacuggccucccccagaauggcuggggucaggucucuauugaccauccaagcuguauaacacuaagucccuugacacuagccagaauacugacaccucccccagugccugaaucugcauccuaucucuaagccuacacauauggacauauggagccucuguucugaucccccacucucuaggccucuuuccggccuaaugagcugaaucucuauguuugcccaaucuuagccaccuuaggucugccuggguccccacucugucuccaggguuuuucuuccuccacuacccacaagaccccugcaguaaguacagagcuguguccacuugucaugaagucccuagaaucuccaucagcccuaacuagguu

SEQ ID NO: 24 - RNA, 35130 nt, Mus musculus
aaccuaguuagggcugauggagauucuagggacuucaugacaaguggacacagcucuguacuuacugcaggggucuuguggguaguggaggaagaaaaacccuggagacagaguggggacccaggcagaccuaagguggcuaagauugggcaaacauagagauucagcucauuaggccggaaagaggccuagagagugggggaucagaacagaggcuccauauguccauauguguaggcuuagagauaggaugcagauucaggcacugggggaggugucaguauucuggcuagugucaagggacuuaguguuauacagcuuggauggucaauagagaccugaccccagccauucugggggaggccaguaaugaggccaggucagcaauuacaacacuggaugaauauuugucaacagaugacagugagauuggagcaagcccaggccuccagggacagacgggcuggaaauuaacuucuaauuggggugcucccaagccauacccugggcuguuuucuucuccccaccacauugcuuuugguguuugcucaacugagccaucacuuuucuaggccauuagcuuaaacagacauugcccgcuucucccuuccccugagccauauggccucauggccucagucccuggggccaggaagaggaaggugaguaccccagccagggcagcucuggggucugaguuccauaguaacuauaauucugguuucuucuccacaggaauuggggaacaagcucaggccaccuggcaguuuagaaggguagcagggugguccuuagucuagguauggaggccacugcagggucagcagaaccacuauagauguggcaggcagagugagcagugaaauagcauugccagucccuacacugugucuacuaugcugggagugggcugguauucucuaacaugccugugcucagagggaaacugggacuggagagauggcucagugguuaagagcacuaacugcucuuccagagguccugaguucaauucccagcaacuacauaaccauuuguggcucacaaccaucuguagugggauccgaugcccucuucuggugugucuuaagauagcuacaguguacucagagggaaacugaggccuggguaguucuggcccagucugcaggguaguccucaccucuccuccacauuucacgcacuucccccuuuucccaccaggcucugggcuucagggccaaacuuguguucaaccaggucaggcaggccuucucaggccucaggcaggauuuaugcuuuuucaaggccuccuugcuucuaaggggcuuggccacccucuggggcaccuagagaagggaagagagcuggagaaacagaaccuggagcagauucauaggguggggaauggagugacugcuaaagcagccuuggagggggcaaggcaggaucuggcacucccagaugacugauugcaucccuccauaugauagaacacucuacaucucacauggguugacuggucauaauaacucacuggguaaacaaggcagggauuugagaaacaaggcaggucagaagaaugccaguacauauacuagacuugaaagucaaauaucccaaaauuguaccucaaggcagccucgccuagagcaucacccauaauucugagagccggaagaacagaaucaauaauaacucacugaaguguacaggugguacagcugcaugcauacaugcauauaugcccacaccuacuuauacagacaguuaugugccagcauacagccuggagaagacaggggauggagccaggaggagggauagcaaucucagccuaugcuucccugcaggcuuggcaggguaaagcccugcaggcaggggagaagcagaaauaaaggggaugacauuuauaaggggcuagcauugugacucagaguccuugggggaugcccagggaucuggguacucccauuaugggcagagguacccagaaagcugcagguuugcaucccaucugagagcacuaggugagaaaggcauggacaggagaucuaaagggcucuauggcucuuguucucacuuccucacauggacugggcuugccuccauggaaucccagcagaggaggcagaagaugaacuuguuggcuugguguaacuagggcugguacuuuuggugcuuaaacuagcuagccccauguuaaccaggccccuggccaccuaccuggcacccacagccugucggccucagcuuggaaccacacucccagucugaaggugucuguuugccuuacagaggcucgugugaacuguucucuucacccucugcugcuggaaagcucggcuuccugcccuaaucucuaugccaacuggcuggucauucuccugcugguuaccuuccugcuugucacuaaugugcugcucaugaaccuucugaucgccauguucagguacccuccugcuuccacuucugcccaucugcccucgccaauccaugcuccaucuuaguagggcugguuucagggugcugacagagacaggacccauguccugguauuuugcugcuguguccagugggcuggaccugcaguagagagccaacacuacagguauggacacacugugagcacaccccugcuguuuauccuguuaggaaggaagaugggucuacaggguuggggacucagagcuguguaaauaccccacugaggaagcuccacugcaguauaccugagaauguguuugaggggugccagacccccauccaagccuccuuucuguggcucugauaaaacuaauugaaaacaauguaggacaagaaaaggcuuauuucaucuuauacuccuggaucacagucugccacugagggaagucagggcaggagcucaaggcaggaaccacagaggagugcuguuugcuaacuccucaggcucauguuuaccuagacuucuuacacaacucaagaccucuugcacagggaauggugcagcccauaguggacuaaucccccagagacacgcccacaggucacuaugaucuugacagucccucuauugugguucccuucucaggugacucuaggcugugucaaguugagaguuaaagcuaacuauuagccucuaucuuucugaaagggcucccagcacagccaagcuaccaacuggaugcaaugggggaugacauauaaggagugggagguggaggggugagaugaaagaugggaaaugggauacaggggcguugugugugggguggaagguagaugcuggguugagguagggugcuuucauggcagguagagcagcuuauaaggcaagggcuuggcuauguguccuguagcuacacauuccagguggugcaaggcaaugcagacauguucuggaaguuucaacgcuaccaccucaucguugaauaccauggaagaccagcucuggccccgcccuucauccugcucagccaccugagccuggugcucaagcaggucuucaggaaggaagcccagcauaagcgacaacaucugggugaggccccaggcuggaugccacugcucccgaggggagggucccaauugacagaggagaccauagaagggacugggguuccuugucuaggcccuguccagguuaaccaaagcuccagguagacuugagacuagacagccacaaggccagccugucuccuugcagccugaaaucccugcauagggcuuauuucugucaucuaccuugugcccugccugguggcaucugcccucagucucccuugcaucagccugggccuagacuuucccuagagguccacaccacucuccaaagcuugcugcugucucccacauugccagagagagacuugccugaccccuuggaccagaagaucauuaccugggaaacgguucaaaaggagaacuuccugaguaccauggagaaacggaggagggacagcgagggggaggugcugaggaaaacggcacacagguggggcagccugugggacagcaggcauaugaggcucaggcuggcaggugucauuccuguucaugagcugcccagagauguagaaagggcucugacaggagggagguaaacucagaugcagcagggcugggcugaccuugaucagcuggguguuaugaggggcaguaagucuaggaggggcuccccauugugaacauguggaaauggggggauaucuagccuuuucaguaauaggugggguuuucugaaccaccuuaaggcugggugagaccaucuagugccaauaacaggaccucugagcuggggaaacauggcugggucacaagacccagcccucuugcccuaggaguguguguauauguguggguugagagcauaaguccauaauuaggcaucucucuccaaugggacucuuuuccuccucucucaggucugaagauccacgcccaguuggugcuagaugguggaggggcuguucuugaaugcuuauagggaugaccuaguguucauccuauugcuugguggccuauuccaagcagggaggggaucucaaucucuuugaggguacagcagugcuccauauccauagacaggccccagauaaagacuggaagggcaguaaagcaagaggccaacaguuaacugaggcccugagaaagcaguuaggacaaaaagcucccccuuguggagugacauggaagugucacaacugaggcugacccugcuuucuacagaguggacuugauugccaaauacaucggggggcugagagagcaagaaaagaggaucaagugucuggaaucacaggcaagcuagcaacucacuauccaucuuucuuccuggggugggggcauccuucugguuccaugggaacuaccacagcccuguaccagcauccugguggguagcauuagggccuggauagaguggccugccccugccccaacucacuuucgagacucauuguuguucuagagcugguccaacaaaaccuagguucagcaccacauccggucacuaucccuuaucaugcacuaugggaggaccugguccagaguguggagucccagggcagcaguagcccuggcaggagggcaaucacaugggaggaaaccaacccgguccccccaguccccaccgaagucucaguaccucccuuggcucucuccaggccaacuacuguaugcuccucuuguccucuaugacggauacacuggcuccaggaggcaccuacucaaguaaguauggguucaggccaugggaaugagauggguaugggcuccucccuucagccacuagauuagggcaagagcaaagcugcgggcuguguauuguauuagguccugccuucuccaccugugcuagaggucgguuacccucggcaggccacuguuccuuagugucccaaggcucugccuagcacuggccuugcuagccuugccacuuuccauguccuggcccuugccucacuccugcccugccccagcugaggcucuccagcugaggguccuuucucccuuucuugcucccaggcucucagaacugugguugcaggagucagccagccucugcuagagacagggaguaccuagagucuggcuugccacccucugacaccugaaauggagaaaccacuugcucuagagccccagaccuggccacaucgaguuuuuggggcacaucaaccuucccccacucccagcagccccaagaaauggucuucaaggccuugcuacagaucacuucuuggacaucccuuccuaagagaaugaaacucaugucuuuggcaucuauucgggagccucagaaguauccucuccagcagggcaagauuuuucaugucccacuaaagcuuucacuggcuuggacuggacagcuggaucuggccaaguccuacauaggacaccaucugccuggauggggcuauuuaggucuaaccccugucuuacccugaguuccuaagaagccaaccucuuaaacacuagguuucuuucugaccccugacccacucauuagcugaccagcuccuagagggcaggacucagaucuauuguaauuaccucccaucuuucaccccccacagcauuaucugucugaucauucuggcagaaaccccaagauauugcucaaggguacccaaugcuacuuuacuuucuauaaagccuguagaccaccucaaaucagcuaaacugggccacaaugguggcuaaacgggacauuucaaacacccggggaauauggaggauugucugaccuagugaaaggcaucuccguuccuuccacugcuccucaaauuaaaugaccauccagguccuuuuuagaggaacucagagaauggggacuacagaggcuggggcagaccugggucuuagcaggucuagcuaacuugguccaagucccuggccuccacaggaaacauucgcucaugcauccucccugcauccuucucuucuucucuggcucagcuucaguggaaugacccagcaucagcugugucuuacacacacaaguccuggagacacagccagacaccaaccauaugcugcuucacaacucauccucuuccuauaaccuguggucuguacaggcccagugcuggggcugcauugguuucuggggguggggguggggguggguugugcagauuaugcucauucacuaccaucaggggcacaaggcugaacacagcuaagagcccagucccucuggguaguuucaucagugacaaauguaaaugaccauggcaaaccuucacggcaguccucacuggaguggggaaggcaaggugaggcugccagagaugcaguccuguaguuggcugcccaggacuguuuggacagaacucuuugaguggggcccggaaaaagccacacaauucaagaaauauuccaaacguuuauuauucauccuaaacacuggggcacaaaggccuucgagguccccugacccacaauucccacagucucugccagagcggcugcacacaucccccuaccacagacagcccacaccuucccacuuggacuagcaggugagggguagagugauagcacugcagucaaacugaggguccucucucagaccccggccccccaggguuaccgucccuguuccggaaguggucucugcuccgcuucuugcugccauggaaaccaacagccuucacaccuauggggccugaugaggacucaggaugggcagcuucugaagguaccaccaccucuggcugucccugguggccacuccauuccucagccucagguccagcgagaugggcuagcuccacagcggccucaccccccgcaccugacccaacccccuucuuuaggacccucuuccucucagcccuagccucacugucccucacugguuuggugaagaccacucuucccuccccacagcuagagggguccugguugaaagaaggcacauagucugugugggacaccuggcuucgagagcucaggaaggccagggcagcaucacgauugcucugcucacuggcuucagacacauccuccagacuguauuugguccaacgcucagggugugacacauagucagggacugggaguacccuagucgggccaguguucccaugcacucugcucaggccccuugcuggagucugacuugggggagucacgggccgccugaagcugccauugucacucacacugguuuggggagcagagcacggugccugccgggcugcacucuccagacaaucaaagaugcuguggcugcgcugggagaagguagaacucaugccucggagguggaauggcugcacugcaguggugagggugcccguggggggcgauggaggguccucagggccggaguccuccuggcccuccuccgaaagccucucuggggacaacacuuggaccuccacaccacuagguaagcuaagguccgaguccgagucgcugagggagacggugucagaaggcagggugucauccucgguggguucaucagccuccaggccagccucugucuccgccauacgaccugacacccgucccaccuguagcgaagcagucccaguuccgccgugagggguguauuuaaggccucaucccuccccguccucccaggcucccgucuuucaccuccacuaugugucaagugccucuacucacagccggacgggaggccucgcgaagcugggugguuaaaggguauccuagcgcgcacagauacaggagcugcagguuaggugggguuaaggagagagucaaccaugagaucauaacaguguggacauacaauagaugagcacugggagaugcuggugacaggagaucuccaucagcugcuugucccaucacgggcucucaguaaagcgcagccucucuagguacaagcgccacccggguccggacgaagggcuggcagaaacaggcacgggaaugcccuggccgcggccuuagggaggccagugcucaccguuccagcguccguacacgccucaauacccugccgccuuucucgcagcgucccgccaguuccccgggauucgguccuguccagucucgcucggguuccugggaaaccgagucucgggcgaucagauuuucguggcuucagcgcccgagaaacuacaacucccagaaggcaauggguucccgccuaaugucagccgggacuuguaaccuuaacaagcgugccaacccggagcgcacacggaaacccacccagaaaugacgaaaaaggaaaaggcggagccacgguucccacaauacuccagggcuaacugccaaucgcaaaggguugaggccugcagcuucgccugucggaagccgucccggccggguccgacacaaggaggaagugcgucaccacgcacugugagcgccaaccaguuuccuagacauuuccggcccugggcggaaguggugugggucuugugcuuuguuggcuuucuggagugaggcggggccaagguccugguuggcucuuggcaugaagagacguaguggucccugggguggguugguuggggcuucagagauucgaagccgcuauccugggcucugccugucugugcuuccugacgcaggaacggacacuuuaguugcaggacgccgccccuacuagucaaggccacacauaauccuccuccaggcguggggcuguuuucuuguauccuuagggaucagagucugagacaccauggggcugcugcaugcgccucuccuuuccuauguuucugaagcugugcagcaggccuccaacagcuuuggccuggugcccauggaccucauaacauaggauauaaagggcuccucagaccagaaaccaaccaagcacggaacagguugcauaggcgugggagguagagguggcggagaccuagaauguccuaguacaagcuugggguucaccgacaaauaagccuacugggaggcugcuagaagcugggccaugaaucuuggcuagggcgucucuccucuaguggccaauuaacuaugccagcagccugggggaggggcgcagacaggagacaaagggaaagagacaguggugguugccccuggcguccgggagguugcuuagccugauccucaguucacagggguaagugaacugccaucuugccuuuuacuuauugagacacaagccagagccacccagcuccguggaaucuuuucuugagauggaugggguaaugggcuaaccuuuacugucuugucccugaaaaggaggguguucuugcagcuuaucuccaucauucugugcugaauuucccugcuuagguggcuccuccuacccgacucagccugaccugucauguccaacagaugaguggaaaugaggucaaggcuggcguaaagucagcauugagcucccaguauaaggagguacaaaugagggaggacccauauggagugcucccagggucccagcccuccccacccacuguguuccacagccucuauuggaccugcucacccugugccuggcaaaguucagagcugaugagccaggucucugacaccgcuagcacaggaagaggucuggcagucccauuagcaugccugauuuuuuuccuccuuuauuaaaugacuguuucaagauuuaauuacaguugaaggugacacguuagaaagaauaagugcauugaaggcauaagagggcuuacaaacccagcucuugaaauggaggcaggaaaggaacaaagauuaaaaagaugugagcaaugugacccacaguggguugagugggugggcauggcccucuagcuaggcuacaaagccucugggcaaguagcuguagaggagguuuggcucagcaggcagaacucuccaggggucccagacguacagggcccugcaagccagggccagcuccaccccuacaucccacauaugccacccaugugugaugucagcucccaaaagguaacaggaaaaguucaggacaaaaaaaaaaacuaaaacaaaaacaaaacaaaacaaaacaaaaaacucaaaaguaaaaagacuaaguguagcagagugauacagaaauauuauauacacaggccaugucccccaagguggccucuggucacuccagggauccucuggugcaaugcaaagggccucaguacacggagcuguuccggaugccacagcacagcaccaugcucagaaucaucucaaagaucugcaggagggaggggcauagucagcaccuaaggcccugggaaggaucccacccacccaccagagacccugugcuuaccauaaugacagcuaccacaauggcugcaauuccaaugagguacagcuucccagagaagagcucaucgauuuucugaugacaaucuugcugcagggauggcaagagcgugguuaaccaucaguggcuaagucacagccaccacccuacucagugacaggaccuauguaucacagcuuaucuuccaccccaaaacaaauuuaagacacacggaccugcugccugcagccuuuugucacaggggaguguuuuuuuaccucacuagcacccuagggucaccaggguaugagggaccacucaagagaacaguuuucugggauguugcagggguuaacucaagcugugaggacccgguaccccaguaauagagauggucuaugggacuucugaggucuugcucaaagugcugaucuuccugauuggccacaccacccuaccgaccaccaccaccaccucauccccacuccaugcuaccugcaguaagggggugaguauguugccgccugagggacacaggcuguuccucaguauggugguagucaguguggucagugcguuggagccacaacaguugagcugcagggaccaagaacaacacugucagcuuuggagcuucaggagacaagggaaagaucaggcacacagcacaccgucaccccaaaauacacuugggaguuguccuucugcccuguuugucacccugcacaggagcccuguuccuucaaaccccugggaaaaugaggcccauuagauuccuaccugaggacccacaaaucauagaggagacccuuuccuaggcccuguuguguuggaaagaaaggagacccaugcccucacacacuaggaaccccacagccuccccuccugcuugagccuagcuauaccgucucauggaaagucuucaccacagccuuggcauuguuggcaucaucauccaucacagcuugcugaagggccuggucauagaacugcuucacauccuuggcgaucugggggagaaucauagucacauacagugucggggcuacgcccaagagcacucaacuucccgaugggcucagccugaugccaccucuuccacugagcucccaagacccugcccccacccaagcagcagguccaagaaauucaaaaagcacccuauaacuaugggcucagagcaacccacaucuguuggagggcagagggcauaucucccacucggugaaccuaggcuuaccuggucuuuguuuacgaagccccagaugccugcagccaccucacaggcaaacaggaucacaaggcaggugaagaacuaggggaaagaagaggucagagccuugaccagcaagcccaggccuagcccacaugaccaacagcuaugugccaaggggguuggccauauccaccaaccauguccugauuaagcaugagccacacagagccauugagagacaagagccugauacaguccugcacugagauguucaaguucucauagccucaccuugcauccuacuuugcaggauguggcugguguagaaaugcaguugacaaaguguccacagccuucacugaggcacaugcagcaagacacuccccaacccuaaccucaguuuccucaccuccuuuauccuacauucuaugacgugugcugccuuuccccagcuucugauacuggcagcgccucccucccaggcuggccagauucuggcaaaucugggauucagcuucaccagcagcuaguguggccaggagcacuaagguuggcuuuaggggugagacacccuucuggaguuuaugcuuuuuuaaacagaaacccccuuuuccaacauguauauucauacucagauucaauggaaaucaagccccuaggaaaaccaaaaccuuggggaagacauauaaguugcuaggaacccugcuccccagcccuucagcccuuucuacuuaccguccccagcagacacugggacuccuggauggccccauagcaccccaggaagccuacaaacaucaucacagcucccacagcaaugagaauguagaugccuggggaagggaagaccugagugagcaggcugcaugaaucacacaggaaggccuaacucacaaccacagcaggcagaguuuagcaaugugcgccguuuaugccuccgugugcugcuggaggagcugccacugccaccaggggacaaagcagcaauucagugaccagagaacauggguggucuccauuucacagguaugcucugcucuggagccagucucccaccaccugcaucugagaacaggaacccucagcacgcacuguaaagggcugagacggacuauccguuucaguuaggggaaguggcuugggugucaggagccaaugcccaagacucccaauacucggugagugugaaaucaaggguaagcuauggcaguaaccaacuccaggcaccucaucucaggaacacugguguauaacuguuuggcucaccuaacucuaaggacgggauccuguguguggguggauggcuaagagaaugguaggggaagcuuaagcagagcacccaaugucugucacaguuuacaggggagcacuguagcccaugagguaccaacugggccaugucccugccucagugcccacaauacccccuucugccccugggaaagcccacugugucuuugaugagcguuccaucucuuggucccucggcagaagccguccaucccccagucuccacggcaacacuguagggcaguccaagcuuccuugcacaaagucaggcccauuguucccugccuggccagaccagaggagaaggcaccauggccuggaccugcugccagacuuaaaaauaggccaaauccuuuggccucacuaaacacgucugguccggggaaggccucccaccagggcugccuagaaacuguuuucccccuugccucccaacuggcagagcaccccaguugucaggcccuaaaaccccaaccucacucugucucaacaggaggcucugucucaacaggaggauacauacagggcacccaacacacaggcacugucccaggacuuucuaggcccuaggcacccuccuaugucuagcacaugucucaucugaagccccugugguguugucugggauguuuagcaagcucugaaugaacucuccuaagcacuaaauaagacaccuuuuucagggccacaucugcuccuagagggacucaguacaggggcagcauggggcuccagaaagccaauucagauuggccagggacauggcagccagaguagcuucuacccauagguagaagaaccugcuacaggguccagucccuaagacuauuuccccaguacccaggaggccauaaccagacaggcagguggcugagccgcucuggaacuggagccugguauagacuauuaugagaacauuaggauagagacuugcuuccuaaccacccuaucugggcucugcaggguagccagccucuccugccauaccugugcagagugggagcacagccuuccccuuguggagggcccaccggccaguucuaccccugucugucucugauucccagauuucccuugugaagaugccuaccaguugccacaauccaguuucuaugagcuggagggcauccuccuucucugaagguaccagauagaaggagggauagcuagugugggcccuucccuacuaacaaccaaaccugaaaacugcuaccccucauggcuuuccucaaaggagaccagguucugccccugcccauauugccuggacuccacugcuguccauuuuacccaugcuaaggcuguggacagaguauagggaggaaggaaacagagcgagccaugggguaaccaaaagcccugucugcucugaggcaauugggcagaaagggagaauauuucagaccuccuggucccccacucagccucaagcaugccucccaagccucuucuaggcuccacaggaggagaaggaagauccacaucagagcccugaugaagguaggagcuuuggaaggguaaagacaucuccaaauacuucuucaguucucaggacaccaggucccucuuccagggaggaaagaggaaaguuuucuccuucagcacaguguaguggaccagagcauaggaccacacagcacaacagccaucaucuuacuuaggagggaggguguucagccccuacaggcagccaaauaaggcagguguaacagucugggcugugugcugguggggguggggugggguggggugucugagucauucacugucggcccagucuccagcccuucccaacucaggacuccuggagccucagcuguugcuagcccaggcauccugccccacccugcccagggagguucacuagaaaugcccauguuaaaauaagcaagguccuacaaggccccugccccaccccguugcuuccuuucugccuagucuagucucagaucuguggggucaccagcagcaccacagccaacucauucuccucuuauaggcagccucccuacccagcucauacuaggccuaggccacucccagcucuaacgccucacccaccagauuuggaccaucagccucuucuuggaagcccucccugacuguucugcacugugacuggaacccgucuccuugguacucacccacguagaagguguugggugccgguuuguuucccaguuccagguacagcaggcugguggucuguggaucaugacgcaaccacagagcuacaccuaggaucacgccuccagccagcuagaaaaaaaaaaaaaaaagaaagaaagaaaugaaaaccaggaacagugucauauagaggccagaguacuggggccaauggaagccuacaaugcuuaucauguagagcccucacuuccaguuguggagccagaugccaagcaguugucugagccacugccacugagcccugggucccaccagcuccucuugguuguaacuccagaacagaauucaaguguaccuccaauagcgcaagacacauacaagaaguuuggucugaaaaauauggcucaguugauaagaguacuugggcauguagggagcccuggguucaauccccaguaccacguaggguuugguggcaauuguuugucaucccagcacuugagagguagaggcaggaggaucaggaauucaaggucaugugaguuugagacuagccugggcuauaugaaaccuugucuccaaaaucagcaggaaacauccccccccccuacuguuccagauugaccaacuaugcaacauuuuuaccguagaaauggccacagugaggcccagccacucaggaugcuggugggcucuccucagguacccugucccaacaguccugggauugauuagagacugcuucaggcaggauacugggaacucugugguggagacaccaaguccucaggggugaccaugugaugccaccaggccccgcagagagaagcagguaccugggagcagaagcugggccucagaacagaccaaggaaggcagucuccuccccagcgccaggucuccucuucuugaagggucaguggcacuccccagcagaaacagcaaauagaaaccaaaaccugggucuaaaaaaaaguaucugcucuucacucuggggauccaggccagaacacaagcucaagaaagcucugggagaaauuugcaagcaggcugguucaggaaagaagaccuauggacccaucugccuucuucuacccuaggaucauguccgcugcuuaacccucagagaggaagcuggggagggguacuuuccugaucaccaucucccucucccuccaccccuucuuucucaguuucucagacuccucuuuaagugcuuaauuucguuuuucacacuccaauccaggagggaugagcccccaaccuccaccagggccugagagaagagggugugugauacagcaaucaaagucacacccgggcacccguugcccaaaccacaaauggcaugaaggcugagacucugacagugccuucacauguaacggcccuagcgaugccagggauccccagaauuuccagcauguuacacugacagcucuuuauccaucugcccuuaagaaccucgcucgaaucagcuugggcaacagaagcaggagggugggaggugacgggucugaguugcccugguaaccaggcuuccuuugcagcuuuuaaacauccuauauuuuguuuaagaucuggucuggaggcugcucugagaugucccagggcaggagaaccagguggcacaccuguuccccauccuucccucauugauaacaugacccuggugacaaucccugauagucacagaggcuaaggggcagcuggugggucaccuugcuuuccucagucugugugcuuaccuguaaaacagcugagcaugcaaccaugccugacucuggcuucucuaaugguacgggaauacugucugugagcugaggggcaaaggggagugaggcaugcuguucagccgagccccaaaggcugcuaaugugggugucuggccaagccaccacuuagagccggguuuuaugaaagaggugggaugaggacguuaacucuagaaaagucucugggcuuuauucauuaacugacaguccugaauggggggugcacggggggggggggcuaaggaucugugacugucaaucagaagagaggccaaacugggguggggguaggcaaggcaucuggaaauggggacuuggccacucaccccauugucccaggggcaaucagagcugagugggaaggaaugccagguacugagauggcuuccuccagcaaagugaccgucuacccugcuacucuagggagagguagagggaguucuggaguucuaguuccagucagugaaugcacaggcccuggguccaucgaaugguagaaucuccagggaaaagacagacccgugagagagcacggaggacaguucaaucauggggagcaaaaggaggacacagaagcugaagcagcuagcgccuucugacccugcucagaugaaagcagaauucaaaggucguucaagauaguacagugauaacccaauggaaguucugggguuagaccacaaagagcccaggguacucuccugauggugcuaaguuucauggggguguaaaugccaagcacagcuacagaaagcuacuuaccccccuccacuccacggucccuggaucaguggcucugcucaaguauauuccccaggcccaagaaggguauaggggugucccaguauuagcagcaauuaggaauacaccuuguuuacagaaccauaggucagaaugaucugcaaaaucugggcaacacucauuuaaaaaauaaacgaaaaaaaagaaauagaaagaaagaaagaaagaaagaaagaaagaaagaaagaaagaaagaaagaaggagggagggagagugugugaguccaauguccaugggaauauggaguagugccauuagauggagguccaggaaaggguaaagauggccugaaucucuaucugugucauaucggagcuagggugucacaaauccaucucuaucuccuccacccuuauggucauuuguaaacaggggaaguaauacacaaaggcugcuaagugugaugucacuguauuuagcucuugacagagcugaggaagugauccacaaagcagaaccuggcauuucuucccgaauccacucaggggcucuaagauaccucugcccaaagcuuccuuucuccagguggcccugccaccugcuccugcagccuaaaagaccuucuguuuagaggugggggugggacgcacccagguggcauguccagguuccuggagcuccuucccuggcacaaaaggaugcauucaugacucuauacaggauuguguugcuuccuccuucuuaagggcuaauccauaacagacucaaacuuuaacaagucgaggagcugccaagcaugcugggucccugcccagcugcucuugugguuucccagaagcgacugaaaggguacaggcuugggacagcauucuacccugugcuagcugcccacugcccagccuuggccagacucagauaggggcuucucugaagcauuccuauugcuacccauaugaaguucucuaggaagggacagggcuccugaaaccagcuugguagguaugaauggucaccacaaagcaccccaaaaugcuccuggaggcuggcuguaacagcagcuuguuccuuugaguuaccauuugggccgcaagagaagaaccaaaggcagaggcagacaggguuggggcuuacucaaagccuccugaguacaugaugcaagcuagaaggugcaccacaaagugcucacccaccuaagcaauucggaggugcugaggggcccaagaaccucuccugugauggcagagguugugaagacccugggcagcugggauaagucagaguaaagaggcucagacugguuuuaggggcauugguuagguagaggcugacuuaggugcuguccuucuagcugggguccugggccuggucugggguauagaggauggggacaaggccagauuccucucugagagacaauggaucuugcucaggccuuccuaggagagguaaagacuuacagucuaccaaaggaagcucaggaaggaagcuggagagaggggcaggaauccucgccuugggcaggaagcaugguuccuuucacaaggccccucgucucaggaagccacugucauagcaucuaaaaauaggcagcaaagcaaaugccuagcucuggggcccaacugacaggcuaggggcaguggugugaauggcccaggcauggccaugggagaauauacugcugucuugagguucaagagauugggcugggccacccagcugggccccuuccagggccagacuacauggcuccuucucaggcaaggaaacuagaaggcaaggaccuuccccaucuaucccgcacuugcccuccucuaggaaggccaaugucucgugagaccccauagggagacuguguggacccagcccgccacagcagucugccagagauaagugcugcagggaguccugguacccagaaaaaggaacaaagggaggcaggggacugagaguggguagaagagcucuauguaguucuggcaucaccaccagcagcaccaaaggacuucuaucuguuccaggcugggcauagcccucugucccaaggucaggcuguggggcuggcagggucuuacaggccacuuugacuauggaacaugguggcagaguggaguguaguucuacccgauccuacuacuuccgaacgugguagcuaguugcuuggaaaccucaguccccuuaucacccgcaacgggucugauaacagcccaacggaguguuacuuucggugagcugaaugagcuguuaucacggacuccagaguacaggagaagacuguuuccagggucaaaggccaugucaugccccaaccaugaggauuuuuagccaugaaaaguaaugagaguccaggcaaugguggcacaggccuuuaaucucagcccuugggaggcagagggaggcggaucucugaguuugagcccagccugguuuacagagugaguucaaggauggcuagaaaagcucugccuugaaaacagacaaacaaacaaaaaaaguugugagaaggugaguuaacacuaguggguugguggcagugacaauaugugccugucacuccacaguaugugccugccacacuccacaguauguguuugucacacuccacaagcccuugcaacacaagguccuacucuagagcucagggaugggcuucaggaggacagguggccugggcuuccucauuacugcuccccgucacacgggacaucuuuaaacaccauuggaaccccucacuguuuagcugcaguacagagccaacauugaugcuugaccauggguaaaagcacagcuaaaugagucauaggaugccacagacccacccugagaaaguucugaagacccaagcugacaucauguauggagugauccgagagauagugcaaggaaacacaggacacucgggggcccuguuacucagcagcuucugcccaagcugccuggcaaccaggcucuuggcuucgguuaccaacucagugcuauggggcuauaaaacuaugggugcccugguucuaaugcacucccccccacacacacuccagacuucauaugaaggaaggcaggugcccucucccaacauccccuugcaguuacuuugguagccauuccaggaugcccaccaccagcuagcugcucacuggccaaccccuugugaacaguucccucaaagguugagcccacucagaagaccccaaauaguuuugaauggcauagccuaugcccugcagcuagccagggagaguagcuuagacuggaucuagaagugaucucucucucucucucucucucucucucucuguguguguguguguguguguguguguguguguguguguguguuuguguuugugagggagguacuaggggucacagucaagucacuggcaugccaggucagaguacugaacaguugaaggcuacugaaggccaguucucaggacaccugguucucuagcaacaguccuaggaacaaaauggcccuaccuauagggucucagagucacccaacacucacacucagagucacccaacacucacaccguguccuaccugguucccuggcaucagggccagagccacagguaccuugacuucuccauaacucugccccacccuacgcccucucuuguguacaaggaugauugcucucucccuagggcagcuggacucuaaggcuagagguuuaauaacugagguuccaauccccuuggcaggacucuggguucuggaaucaagguuggcaguuguugguucccuccuagagcaucacagaagcuccguuugagguaggacugagcuagaaggcaagugccgagagaaugccuaaaggguucggaaagaaugggggugggggcucuuauuaugaggucgcagugugugggcaccagaguagaggcugccaggucuacuccagcucugugcccccacuguucggauguccuuuuuuugaagccagcccagggaugaaccacagacuuccccuuugcaggccaaugauugucuuucccaaagccgggcggagcagacagccccaggagcaaggggcaagucacaggaagugcucauuccacccugagcccacagaauuagagccccucugccggaaggcagccagcagaccacuaugugacagacagucacguauguguguugcugaagcgagcacaacagacagucauguucagucuggagaauuaaaugccaguugagaggcuguaaucagccuuuuguggugggucuggcugccugggcuacuggacgggggccaccagcagccuuaggcuggaggaacagccuguucugucggggaacacagugaagauucuucuccuuaacugacuacuccuauggagacauugucacacaaagcuccuacagacccacccgaggccauaggcuggcacagugauaaaccauccccugcucuccugcccuauugccagccggugacuauugccagaggagacuggacccuuaaucccagaccugucucaggggaugaguaaccacccugcuucuaagagcaucuuacauggucucugcugcucaccgcucaucuuucagguuuguguccugccccauauaucuugggaguccagaacucugcuggccccaauauagguucugaacucaagcccaaggaggacuggugggagugacagcaggcagguuagugugcccggaauguccccucccacagagaaaccacuuuaaucuucaaacuggaaauuuuaaaaaguguccaucgaaacauuuacugucaaccaaaucucccuucuuagagcucuuagcccccgcccccaccacggcccaaaggaccucucagcccccuccuuaggcccuucugacaucauugcucagcuuccuuuggccccacucccuuuuggagacuguguccaguguccauuuccugagccuucucugcuccaagccccuugccccacucuggaguacauuagcuagucuacacacaauccuaggagacagagacccccaagaacucccacuuuagagggaggaagugaagacuaagggccagaguggugggguggggcuccccaaagguucaauuucaugauaucagggaacuaucagccacaguacaaaccuugccacacgagggacaaaaggagucccucugccagggugguguccaccaguuguagccugguucugcuccacaucccuauccacuguggggccaacaugaguagggaggagaggucugugggauugugaaaggcuacaguuuucacuguucugcagucaguaggcaggucccugggagcagggagaggcuucagaaccguuuccuggagccucaauagagaccccagggacauguugggacuccaccccagcugccugggaaacgagcagcuucacccagccucagcacuccagggagucugagggucuagcgcuuggaucaggugggugagcaaaaaaagaaaaaaaagaaagaaagaaauacccuacaggauccugacaucccacaucugaagaauaauggggguggggugggguggauaacacacuucuugagggugcauucaauuccuugcaugguucagaguaggcaagcacuguccaacaugacuacccagucgagaccccaaggcaugcccgggcagagcaaguuuaaccccaucgcccaugcugcucccuagaauguguucucuggagucaccgugacugacaaucuuggucccugcagcaccgcgugagcauacauagccccagcugaguucagcccaguuccugcccauccccaacgucuuauuccccuccaccccacccugacccgcccugggaucuucagcaguccucgauggaaaacagguguccccuguccaacacacucacuccaggggccguuguacaaguuugcccucucaggaacaacuuuagagaaacauugucuuggcauaaccucauuucuuccugggaaggaggguggugggaacagcagucugugcacugcagcagggaggguggcaccacuguccagaggaguggccagcacugcucacucaagugcccgcaggcaggucuguuaagacuccccauucccaacccaguuaggaaauggaaagaagcccauaccaccaauggcuacuccccagcagugaagacagucaggacccagggacacuuggagacccucuuauacccaugucuccuuuccaagaugaccaaaugggugugcacuucuuuccaaaguggagagcccagcuuagauccuguauauaggaaaagauccuaagcuccugguuuguacagaucccagaucuuugcaacacccuggccuucaccaacucagaacugcauacccucuuccucucaggaucuaagggucaggccggggcuguaaucugugcaggagacgacaggcaaggaggaggggcagcugggggaauggggguggggguggccaagaacuggggcaccgugcgcagcagcacgcggcccgggcugcccugccuucuaggccuggagcucgagcccccaggguggcaauaccaagcuggaggguaagcaaggguggaguaauagugggguugaggucuccgaggcaaguacggagcgugcccccaccacuucgaggccgccuauccaggggcgguggcuaggaugagcucaugggggcggggcgccaagaucccgcccuucucgaccccccucacugcucgcgaugcaggaugguccccaaaacaacauucaggagggugcgaguacccccuucauagcugagggcucuugauuaccuggcucuagcccgcagacucuugcaccaguucccagcacucagaggggacaggccagcgauccccugauuucccggccccagaagccccucgagccgaggcccagaagcucagcccucggccucaacccgcuggcgaggggcgccaggaccccgaucggcgcacggagcccacagguggcgccgcaacuucgcgguugcgcugcgccuucucagcagggccuagcgcgcugcccagccuggcuaccguggggugcgcccuguccccaguggcugcucacccagaagacgaaauugaagacgaagagcagguauuugaugcauuuggugcagcccuccacccccauggcggugcgcggccugcggagcuuggauugguccuggagcgggcgguauggggacgcaguaccgggguccgggacuggcagauagccuggagcgcuugcgggccggagaacugcguugcggagaaugagacguaggguagagaagggcuggaggccuagccggaggcgcgagagucacuaucucuuugaagcaaggacgcgcucgcucggaccgggcgcgcgcgccuagcuccucacucuuuauagaccucuaggucccgccccuccgaggccccgcccagaggacgcuccaccccuggccccgccuuccgcccgcggggugcccggaccagggguacuugggugggugcugccaccucagucccagaguaagcguucuggaacuuggugcagcugguucuuggggacucggugcacugugcgugcgcaggaugaaucuccaaguuucuuaaggguucccaacccucggggcaggcuucugggucgcgacuaagaacuggccacaagauacugccccaaagaagccacacuuacuuccuccgguacucggacgccuuggacuuucccggaggguacccuaguggaggugucucgacaguaaagagucuuaaaaguuaacauguuuuguguauauugaucucccaggcagcaacuccgugggccugaaggucuagaauggaauucuuuguagccuugcuaauccccuaucucacagauagaguuccuggcugcaguucuggaggcugcauuugggaaggucaauaguguacccaaugucuuuagccagucuuuaggcucgagaacccucaggggcaccuucaaauauucaugccauccuggcugugccuuccaagaguccauccuccauccucuagcugguucccugaaagcugggauuaauaaggaagugaggaaagauucagagggcagaggugcuuccuucccgggugaggaauggcugcugucaucauagaugauauuccugugaaaucuuggcauucccuuccccaaacugaagggcaauggggcugcuucauuagacucacugggaaccauggaaggaccaguucccaagacucagccuuuuccaggucacuccauguucuuaaaucuuugagcaguuaaggacauuguucccuauggagaucacaccuggcaccccucuggcuacaggacacuggaaauauguuuaaaaaggaauagauauacauauauauuuaaacaaaggaaaggaauaucuauaauauauauguggagagagagacagacagacagagacagacagacagacagagaaugagaaucucacaauguagcccugguuccuggaacagagcucugucuacuuuugcuuccuaagugcugagacuguagguuuaggacaccaugcccaguugucuaaagggcgaaaauuugaacuauguauaauuuacauguaaaccugaugauuggccaguagcugccuggguggagcuaucucuacucggcuaggcuaguaggcuucuugagaguuaauuugugcauuuguuuuggcuucaggcugguauagcugcuacagugaaggauuguguccacauuuauaguucuuggaggcugaaguggugucacaacaaaaguaacacuagucaccaaaugcuggaguaauaucacacuaaaagucauuugagucuccaggagggagucucuuaggauucuuuuuauuuaaaagugggcaagaauaguucuugcacgugcagagauggggaccugcuuucucuucagaucuccacugucuccagugauggggauaccucaugccuaaagugggguuacacauugaacgucaugcagggccagcuguuuuguuuauguacugugugauacaucuggguuuagugaaugccauuguguuccuggaacuguuccaagggcuauggacagccuagaaaccaaggcugcuucuuuggggcccuuagguucuggucacauacaugcuauggagagaguuuccaugauguuugaccaaucaugguagggaauuuuuuuguaaagcaguuuuccuccaaauuaaaacaucccuuucuggagggaaaguauuaagacuccggaaaugaacaacuaacaaguuuuagacguuccugaaacuaacaggucccuuccucccuaaagauacauaauuaggaagacagcccaugcuuugaccuauucaagugccauucuccaggguuccagcuuuugugagccaucaccuaugcugagguuuuuggugacacagcucccuuugaguugucucugaugcuguaaguaaccccucacccauacuuuuguaaguaaccuaaaucaacuaaucgguuuaccaaguuggacuuugguaggaagcucuuggaucaggaacagauaugggcagaaggccagacaggucugaguuagguggaaggcagacuuaggcugcauucuguucccauugaagggguugggguagggaacaaucucauaggcccaggagacuugcugagaugacugguugguugcaagaguacaaggggugccuugcagagccugcaccugugagcacuacaucuuaagugacuuguccaacauccugccagcuggccuuauaaggacaugggggaaccaaguagguacccagagggugcaucagaaaauguccccggcgguuagcucagccugaaaauaucucuuuucuggcuuccaagaaaacagugaugaagcucaagcccaggaugggaaguuucuauuugcuuucccuuguccagcaggugugggaagaugggaagaaugggccuuccuagccagggcuugucucacaauucuccugucuguaugaacuuguacuggcuucucaguuuccccaagugugacagaaaugcugcagaaagucucuaaguacagaaggucaauguguccuuguuacuuggagcagggccuggccugugggaaagucaaggucaagcucuuuuuggcucagucccagagucuugugacucacuccacagaggaguccugcugugugcauuuggcaggagguagggggauuuuguuguagaaccaugguuuccuaaaaugaagacuccccaaccugggcuguuuauguagggcuugcucuuguaggguuuguuggcugccaccaucaucacuucugcuugcuagaaauucauaugcaggucagggaguaagacagcuguguauugaaagagcucagcauccaaaaacggccaagcaaugccagacaaaacucuugugagcaucucuagagucacaggaaaugcuguccucuauucuccaagccccacaacucuccugauaaaauacuucauucagcagcaauagaaggggcucuguccuccagaccugaggacgaacugaagauccauaaaagucucgagccuguucuucucaaggaagacugaaggcuccucacccaccaaggucagagacguaacaaagugaagcaaacaaggcagucuuggcauuucuccccaggguucuaggaaggaugauccagcaagauggaaaggugccaugcaggacagggugcuggcaaauguuuaaaaucuccugugggacauaccuacaggcauucacacuaagugugagugacaccaucccauaaacuuggguuguaaacugaauaaaaaucagaaagugagaugaacaucaguguuuaucucugcuuccugauugugggcguuaagugacaagcugcaucacacugcuguagccacaccuucccugucauuaugaacuauacccuugaacugugagccucaacaaaucuguucuucuuuaugucacuuugucagguauuuuuggcacagaaacaagacaagacauugaacaguugccugaguuaacguguuuaacaacguggcagauauaaaaucaauaugaaaaagacaaauauuucuauagacuaguaguaaauaauccaaaauggagucuaaaugaugaucucauuuagaauagcagcagaaagaacgaaacaucaagggauaaagucacuaaagaugugugagacuugcagacuuggaagaaaccaaguaucuaacuauauuugagaggaucugacuuucacaaaucaaagacaaaauuaucauucaggucauaacacuucagaaguugucuggccuuuuuuuuuucugauucuaaauucaagguuauuuucuuuuuaauuaaaaaacauuauuuguuuauuuucucucucucucucucucucucucucucucucccucccucccucucucucucucucucucucucucugugugugugugugugugugugugugugugcacauguacacguacaugcuauagcauguggcauguguguggaggucagaggacagcuagauucucugcuuccaccaugugggugcuagggauugaccuuaaggaaucaagcuuggcgucaagcuccuuuacccacugaacuaucuugcaagaccugacccuaaauucacagggaaagguaaaggacuaaggauagccaaaacaauuuuggaaaagaacaaagauggagggcuuauacuucuugauucacaguacaaagcuagaguagucaggagaguauuguucuaaagucuaguaugguaaaauauggcuguacucccagcaugcaaagggugaaggcaggagaguugggaguucaaagccagccuugacuauaugagacauugucuucaaaaggggaggugggggagacagagggauagcauaaggauagcuauuuuagucggcuuucuacuacugugauaaauaccagaaccaaaagcaauuuaggguguguuuugguuaggguugcuauugcugugaugaaacccuaugaccgaagcaacuuagggaggaaggugcuuauuuggcuuauacuuccagauaacugugaaucaccaaaugagguugggacaggaaucaaaacagggcaggagccuggaggcccugcugaugcagaggccauggagggugcuguucucuggcuuguuccucauagcuugcucagccugccuucuuauagaaacccagggcuggcaucacccacauuuggcugagcccucccccaucagucacuaauuaagaaaaugccucauaggcuugccuaucuuauggaaaccuaaucuuauggaggcauuuucuuuucuuuuuuuuucuuuuucuuuuauuuuaaaauugagguuccccucucucagaugacuucagcuuaugucaguugacauaaaacuguccagcacacagaggaaagaguuuauuuggcuuaugcaugccagccauaguccaucauuguggaaagccaaggcaggaacggaagcagaggcuauggagggaugcugcuuacugacuugcuccucaaagcuuccuuaauuugcuauuuuauguagcccaggaccacucacucugggguggcaccaaccacuaucugagcccucccauauccauaauuaaaaaagaaaauguuccaaagaccugccuacaggccaauagguucccucuucccaggugacucuaccuugugucagguugacaaaaagcaaaacuaccaacaacaaacaaaacaaaaaacuaacacaauaacaacagagaucaauggaauaaauagaauugaaauucuaggaauagaucuuucauuuuaaaugagaggacaagacaguucaauggggggaaggaauggucuuuuuaaacaugguucuaguauugcuauccuuguacacagaaaaacgaagacaaaucuauccaguguaauaccugccaacauuaugaugaaaaugagaccuaggggauagagccaugacucaaugacuaagagcacuggcuguucuucaaggggaccuggauucauuucccagcacucacauggcagcucacaaccaccuguaacuccaguuccaggagaucugaagcucucauauggcuuccauuggcacuggugugcagacauguaugcagacaaaacaccuauauacauaaaauaguuaaaaauuaauuaggcaaaaauaaaucuuaaagaaugagcccuagaucugaagguaagagcuaaaccuuuagcugggcauggugacacacaccuucaguccagcacuugggaggcagaggcaggcagagcucuugaguuugaagccagcauuguccacagagcaaguuucaggacauccaagaugaauuuuuuacaaaacaaagaaaggaaggaaggaaggaaggauggauggauagaugcaugcauuggugaucuugccuuaaaauagcaauuuccuaucuaugauaccaagcacacaagugcauggacuuggacccagguugcaugaaagaagagagggagaugacugagcgccagcauucaucugugugcuaacugugaacgugaugugacccgcugccucaucucccugcugccucgccuugucugcaggagccucaaucaggagccaaaauaacuuccugaaguuaguuuugacaacuauuuugucacgaugagaaagcuaacucaauauuuguacugaaacaggaagucccaacauuguauuggcaggagauuggcucuguuuguugagaaaaggggaauugaaagacguauuuguaaauaugucaugcuaucagaacacagccaagcaccagccuaaaggaugccucuuaaugggcugccucggaggaaugaauaucccugccccucucuuugguuaucagucuguugagacaaugggcccaaauaaauuagauuuuccccagaaaucuggggcagcggggguggggggggcggggggagaaaagguguaagugcugcaacaacugggagaggauuuugucuccugaagaaagauuuacaacuuguccaaggacacuguaggaaagacuugggagcugaaauaaccgugggccaaggagccauacuuugaucagggcugcacaguuaugcauaccugaccucucgaccuuaagcucaugucagcgucuagaagauggacuuggggcagaggauugcuggaucccacuauccuucuucccaauguagccaugguggauaaaucgcucccuuucuguuuauuaauuugucuccuuuugaaaagguguauuuccauuccauuuauguauaaaugugucugugugaguguaugcucucugucugucuguuucugugcuucugucucucucugucucugucucucucuguuucugucucucugucugugugugugugugugugugugugugugugugugugugugugugugugugguguggaugugugggugccuauagagacccguaagggguguagaagccacuggaguuggaauugcaaguuguugugagcugucugacauggguccucuacaaaagcagccgcucucuugaccacugagccaucucucuugcgccuugacuuggcauuuuuaacgaguuuaaggaugagcagcccaaucuggcuuguugggacucaggcagugacucuaaauccaguaauaucucuaugcaugcaaguacccagauacccaaaguguuucacuucucuacuugaagaguaaauagagaccaaaauaugagcugaacuugcaauaaccacgguucccacacucucuguaauucuguaugugugugauauacuuucaugaaaauacucauuucuaaaagauaccugugacaacaaauagccaucuuugcacugucaugagaggaaagucuuaucgucauaaaacuucuaaauuuccccaaaggaaucugauuuugucuugaggugggguugauaaucaagacauuuggcucaaggauuuacccauauguugaaacauguguauguucaaccaagagcaaugaaaacacauccauacaagaacagauccacauacuuuuuguaugugcauuuguuaucauagccaaaaaguagagccagggcuggugagauggcccagaaguucagagagcuugcuucucaaacacaggaaccugaguguggguucuuauaauguucuguaguuucagcucagagggaucuaaugcccucuucuggccuugacaggcacugcaagcauaugaugcacauacaugcaggcaaggcauccauccauacacuuuguaaugacuaacuuuggcuguuaacuugacuauaucuggaaucaacuaaaacucaagcagcugagcauuccuuugagggauuuacuugguugcuucaguuaggaggggagaccuaacucugggucauaccuccugguagcaggucauauaaaagaacauggaagaaggaaacuugcuuccuccccugcccccauuuucccucacucuuauuggcuuguucaucuguuuuguuggugagucauuccuuugcugguguuaggaucuacuuuuuuuuuuuuuuuuaggauuucaacauagaccaaagaccagcaucucuucaggaauccucuaggacuccagcacuagaugguacugcugagacacccagucuuggggacugaacaacugccagauucuuggccuucccacuggaauacugcuauuguuggaauaccaggcuacagccgguaagucauucuaauacucuuuuaauauauuugauauauauucauuuuaucaguucuguuccuuuagauaacccaaggcaaacauaaaaguaaaauaauauauuuuuaaguacaaaaacuaaagaugcccaucaagugacaaauguguccacaugacauuguccagaccacagaguguaaugcagccauugaaaugaaggaagccaugauacaugguauaacucagacgggucuugaaaaugcugagucagguauugugacauaugaguguaaccuggaagacagagacaggaggaucuccacagguuccaggccaaccaggccuauaaaguaagacccugucucaaaacaaagacaaaacaaaacaaaacccuuaaauguuuuguugaugaaaaaggccagguguaaaagaccuuauauuugaugcuuccuuuuaaaaugcugagaaaagucaaauguaugcauuccuucgauuccagcacuuaggaagcagaggcagacagguuucugugagcucaaggccagccagcauugucuacacagagaguuucagaauagcaagacuucauaaagagacccuaucuaggcaggcaguggaggugcacaccuuuaaucccagcacuugggaggcagagacagguggauuucugaguucaaggccagucuggucuacaaagugaguuccaggacagccagggcuauacagagaaacccugucucaaaagaagaagaagaagaaggaggaggaggaggaggaagaagaagaaagaaggaagaagaagaagaaaagaagaagaagaggaggaggaggaagaggaggaggaggagcagcagcagcagcagcagcagcagcugagaguauguaaacuaauagugguagaauaauagagguagaagggaggcuugcccuugucuggagcugugaagguggugcuaaugcuacccugagaggucuuaucacaacacaucuuugggguuuuggcugcauacaucugguuucugccucaaugauaggcugugaacucgaaguauacgccaaguuaacaauuucuuccccuaaguuugccuguugaucauaauguuuuaucacagcaacagaaaacaaacuagaacagggaggccucugucauuucuggucaucacauuuagcaaacuaggagagcucuggggugagaggaccugucagcaagcuagggaauuugggaggagccaaaggggaugaggaaaaaguaaucacuacccaucagugguuaacugaaugacuaagcagagacguaacugaagugaagccuaugucugacacuuggucagcguguggacaaaaaccccaaaccagacagcauaggaagugagagagagagagagagaguaaaggcuagagucugagccuggcccuggggaccuggagggucaagcucuggacuguacuuucaaguguucucucugguggaaggggaaccagcagggagucagacaaacccacaagggcaguaauacagguccaggaagagccaccacagugacuggcauaugggcagagauaguaaaaaggucaccggaagacagaccuuccugcuucagggacaaucaacagcccuaacuugugagguuuuucaaaagacucaagucuccauagucaaggaagaaaaaggagcucaaagcaggccuguguaugagagacuacaaguaccaagggcuuca

SEQ ID NO: 25 - RNA, 21720 nt, Mus musculus
gaaggaggaagcaacacaauccuguauagagucaugaaugcauccuuuugugccagggaaggagcuccaggaaccuggacaugccaccugggugcgucccacccccaccucuaaacagaaggucuuuuaggcugcaggagcagguggcagggccaccuggagaaaggaagcuuugggcagagguaucuuagagccccugaguggauucgggaagaaaugccagguucugcuuuguggaucacuuccucagcucugucaagagcuaaauacagugacaucacacuuagcagccuuuguguauuacuuccccuguuuacaaaugaccauaaggguggaggagauagagauggauuugugacacccuagcuccgauaugacacagauagagauucaggccaucuuuacccuuuccuggaccuccaucuaauggcacuacuccauauucccauggacauuggacucacacacucucccucccuccuucuuucuuucuuucuuucuuucuuucuuucuuucuuucuuucuuucuuucuauuucuuuuuuuucguuuauuuuuuaaaugaguguugcccagauuuugcagaucauucugaccuaugguucuguaaacaagguguauuccuaauugcugcuaauacugggacaccccuauacccuucuugggccuggggaauauacuugagcagagccacugauccagggaccguggaguggagggggguaaguagcuuucuguagcugugcuuggcauuuacacccccaugaaacuuagcaccaucaggagaguacccugggcucuuuguggucuaaccccagaacuuccauuggguuaucacuguacuaucuugaacgaccuuugaauucugcuuucaucugagcagggucagaaggcgcuagcugcuucagcuucuguguccuccuuuugcuccccaugauugaacuguccuccgugcucucucacgggucugucuuuucccuggagauucuaccauucgauggacccagggccugugcauucacugacuggaacuagaacuccagaacucccucuaccucucccuagaguagcaggguagacggucacuuugcuggaggaagccaucucaguaccuggcauuccuucccacucagcucugauugccccugggacaauggggugaguggccaaguccccauuuccagaugccuugccuacccccaccccaguuuggccucucuucugauugacagucacagauccuuagccccccccccccgugcaccccccauucaggacugucaguuaaugaauaaagcccagagacuuuucuagaguuaacguccucaucccaccucuuucauaaaacccggcucuaagugguggcuuggccagacacccacauuagcagccuuuggggcucggcugaacagcaugccucacuccccuuugccccucagcucacagacaguauucccguaccauuagagaagccagagucaggcaugguugcaugcucagcuguuuuacagguaagcacacagacugaggaaagcaaggugacccaccagcugccccuuagccucugugacuaucagggauugucaccagggucauguuaucaaugagggaaggauggggaacaggugugccaccugguucuccugcccugggacaucucagagcagccuccagaccagaucuuaaacaaaauauaggauguuuaaaagcugcaaaggaagccugguuaccagggcaacucagacccgucaccucccacccuccugcuucuguugcccaagcugauucgagcgagguucuuaagggcagauggauaaagagcugucaguguaacaugcuggaaauucuggggaucccuggcaucgcuagggccguuacaugugaaggcacugucagagucucagccuucaugccauuugugguuugggcaacgggugcccgggugugacuuugauugcuguaucacacacccucuucucucaggcccugguggagguugggggcucaucccuccuggauuggagugugaaaaacgaaauuaagcacuuaaagaggagucugagaaacugagaaagaagggguggagggagagggagauggugaucaggaaaguaccccuccccagcuuccucucugaggguuaagcagcggacaugauccuaggguagaagaaggcagauggguccauaggucuucuuuccugaaccagccugcuugcaaauuucucccagagcuuucuugagcuuguguucuggccuggauccccagagugaagagcagauacuuuuuuuuagacccagguuuugguuucuauuugcuguuucugcuggggagugccacugacccuucaagaagaggagaccuggcgcuggggaggagacugccuuccuuggucuguucugaggcccagcuucugcucccagguaccugcuucucucugcggggccugguggcaucacauggucaccccugaggacuuggugucuccaccacagaguucccaguauccugccugaagcagucucuaaucaaucccaggacuguugggacaggguaccugaggagagcccaccagcauccugaguggcugggccucacuguggccauuucuacgguaaaaauguugcauaguuggucaaucuggaacaguaggggggggggauguuuccugcugauuuuggagacaagguuucauauagcccaggcuagucucaaacucacaugaccuugaauuccugauccuccugccucuaccucucaagugcugggaugacaaacaauugccaccaaacccuacgugguacuggggauugaacccagggcucccuacaugcccaaguacucuuaucaacugagccauauuuuucagaccaaacuucuuguaugugucuugcgcuauuggagguacacuugaauucuguucuggaguuacaaccaagaggagcuggugggacccagggcucaguggcaguggcucagacaacugcuuggcaucuggcuccacaacuggaagugagggcucuacaugauaagcauuguaggcuuccauuggccccaguacucuggccucuauaugacacuguuccugguuuucauuucuuucuuucuuuuuuuuuuuuuuuucuagcuggcuggaggcgugauccuagguguagcucugugguugcgucaugauccacagaccaccagccugcuguaccuggaacugggaaacaaaccggcacccaacaccuucuacgugggugaguaccaaggagacggguuccagucacagugcagaacagucagggagggcuuccaagaagaggcugaugguccaaaucuggugggugaggcguuagagcugggaguggccuaggccuaguaugagcuggguagggaggcugccuauaagaggagaaugaguuggcuguggugcugcuggugaccccacagaucugagacuagacuaggcagaaaggaagcaacgggguggggcaggggccuuguaggaccuugcuuauuuuaacaugggcauuucuagugaaccucccugggcaggguggggcaggaugccugggcuagcaacagcugaggcuccaggaguccugaguugggaagggcuggagacugggccgacagugaaugacucagacaccccaccccaccccacccccaccagcacacagcccagacuguuacaccugccuuauuuggcugccuguaggggcugaacacccucccuccuaaguaagaugauggcuguugugcugugugguccuaugcucugguccacuacacugugcugaaggagaaaacuuuccucuuuccucccuggaagagggaccugguguccugagaacugaagaaguauuuggagaugucuuuacccuuccaaagcuccuaccuucaucagggcucugauguggaucuuccuucuccuccuguggagccuagaagaggcuugggaggcaugcuugaggcugagugggggaccaggaggucugaaauauucucccuuucugcccaauugccucagagcagacagggcuuuugguuaccccauggcucgcucuguuuccuuccucccuauacucuguccacagccuuagcauggguaaaauggacagcaguggaguccaggcaauaugggcaggggcagaaccuggucuccuuugaggaaagccaugagggguagcaguuuucagguuugguuguuaguagggaagggcccacacuagcuaucccuccuucuaucugguaccuucagagaaggaggaugcccuccagcucauagaaacuggauuguggcaacugguaggcaucuucacaagggaaaucugggaaucagagacagacagggguagaacuggccggugggcccuccacaaggggaaggcugugcucccacucugcacagguauggcaggagaggcuggcuacccugcagagcccagauagggugguuaggaagcaagucucuauccuaauguucucauaauagucuauaccaggcuccaguuccagagcggcucagccaccugccugucugguuauggccuccuggguacuggggaaauagucuuagggacuggacccuguagcagguucuucuaccuauggguagaagcuacucuggcugccaugucccuggccaaucugaauuggcuuucuggagccccaugcugccccuguacugagucccucuaggagcagauguggcccugaaaaaggugucuuauuuagugcuuaggagaguucauucagagcuugcuaaacaucccagacaacaccacaggggcuucagaugagacaugugcuagacauaggagggugccuagggccuagaaaguccugggacagugccuguguguugggugcccuguauguauccuccuguugagacagagccuccuguugagacagagugagguugggguuuuagggccugacaacuggggugcucugccaguugggaggcaagggggaaaacaguuucuaggcagcccuggugggaggccuuccccggaccagacguguuuagugaggccaaaggauuuggccuauuuuuaagucuggcagcagguccaggccauggugccuucuccucuggucuggccaggcagggaacaaugggccugacuuugugcaaggaagcuuggacugcccuacaguguugccguggagacugggggauggacggcuucugccgagggaccaagagauggaacgcucaucaaagacacagugggcuuucccaggggcagaaggggguauugugggcacugaggcagggacauggcccaguugguaccucaugggcuacagugcuccccuguaaacugugacagacauugggugcucugcuuaagcuuccccuaccauucucuuagccauccacccacacacaggaucccguccuuagaguuaggugagccaaacaguuauacaccaguguuccugagaugaggugccuggaguugguuacugccauagcuuacccuugauuucacacucaccgaguauugggagucuugggcauuggcuccugacacccaagccacuuccccuaacugaaacggauaguccgucucagcccuuuacagugcgugcugaggguuccuguucucagaugcagguggugggagacuggcuccagagcagagcauaccugugaaauggagaccacccauguucucuggucacugaauugcugcuuuguccccugguggcaguggcagcuccuccagcagcacacggaggcauaaacggcgcacauugcuaaacucugccugcugugguugugaguuaggccuuccugugugauucaugcagccugcucacucaggucuucccuuccccaggcaucuacauucucauugcugugggagcugugaugauguuuguaggcuuccuggggugcuauggggccauccaggagucccagugucugcuggggacgguaaguagaaagggcugaagggcuggggagcaggguuccuagcaacuuauaugucuuccccaagguuuugguuuuccuaggggcuugauuuccauugaaucugaguaugaauauacauguuggaaaaggggguuucuguuuaaaaaagcauaaacuccagaagggugucucaccccuaaagccaaccuuagugcuccuggccacacuagcugcuggugaagcugaaucccagauuugccagaaucuggccagccugggagggaggcgcugccaguaucagaagcuggggaaaggcagcacacgucauagaauguaggauaaaggaggugaggaaacugagguuaggguuggggagugucuugcugcaugugccucagugaaggcuguggacacuuugucaacugcauuucuacaccagccacauccugcaaaguaggaugcaaggugaggcuaugagaacuugaacaucucagugcaggacuguaucaggcucuugucucucaauggcucuguguggcucaugcuuaaucaggacaugguugguggauauggccaacccccuuggcacauagcuguuggucaugugggcuaggccugggcuugcuggucaaggcucugaccucuucuuuccccuaguucuucaccugccuugugauccuguuugccugugagguggcugcaggcaucuggggcuucguaaacaaagaccagguaagccuagguucaccgagugggagauaugcccucugcccuccaacagauguggguugcucugagcccauaguuauagggugcuuuuugaauuucuuggaccugcugcuugggugggggcagggucuugggagcucaguggaagagguggcaucaggcugagcccaucgggaaguugagugcucuugggcguagccccgacacuguaugugacuaugauucucccccagaucgccaaggaugugaagcaguucuaugaccaggcccuucagcaagcugugauggaugaugaugccaacaaugccaaggcuguggugaagacuuuccaugagacgguauagcuaggcucaagcaggaggggaggcugugggguuccuagugugugagggcaugggucuccuuucuuuccaacacaacagggccuaggaaagggucuccucuaugauuuguggguccucagguaggaaucuaaugggccucauuuucccagggguuugaaggaacagggcuccugugcagggugacaaacagggcagaaggacaacucccaaguguauuuuggggugacggugugcugugugccugaucuuucccuugucuccugaagcuccaaagcugacaguguuguucuuggucccugcagcucaacuguuguggcuccaacgcacugaccacacugacuaccaccauacugaggaacagccugugucccucaggcggcaacauacucacccccuuacugcagguagcauggaguggggaugaggugguggugguggucgguagggugguguggccaaucaggaagaucagcacuuugagcaagaccucagaagucccauagaccaucucuauuacugggguaccggguccucacagcuugaguuaaccccugcaacaucccagaaaacuguucucuugaguggucccucauacccuggugacccuagggugcuagugagguaaaaaaacacuccccugugacaaaaggcugcaggcagcagguccgugugucuuaaauuuguuuugggguggaagauaagcugugauacauagguccugucacugaguagggugguggcugugacuuagccacugaugguuaaccacgcucuugccaucccugcagcaagauugucaucagaaaaucgaugagcucuucucugggaagcuguaccucauuggaauugcagccauugugguagcugucauuaugguaagcacagggucucuggugggugggugggauccuucccagggccuuaggugcugacuaugccccucccuccugcagaucuuugagaugauucugagcauggugcugugcuguggcauccggaacagcuccguguacugaggcccuuugcauugcaccagaggaucccuggagugaccagaggccaccuugggggacauggccuguguauauaauauuucuguaucacucugcuacacuuagucuuuuuacuuuugaguuuuuuguuuuguuuuguuuuguuuuuguuuuaguuuuuuuuuuuguccugaacuuuuccuguuaccuuuugggagcugacaucacacauggguggcauaugugggauguagggguggagcuggcccuggcuugcagggcccuguacgucugggaccccuggagaguucugccugcugagccaaaccuccucuacagcuacuugcccagaggcuuuguagccuagcuagagggccaugcccacccacucaacccacugugggucacauugcucacaucuuuuuaaucuuuguuccuuuccugccuccauuucaagagcuggguuuguaagcccucuuaugccuucaaugcacuuauucuuucuaacgugucaccuucaacuguaauuaaaucuugaaacagucauuuaauaaaggaggaaaaaaaucaggcaugcuaaugggacugccagaccucuuccugugcuagcggugucagagaccuggcucaucagcucugaacuuugccaggcacagggugagcagguccaauagaggcuguggaacacaguggguggggagggcugggacccugggagcacuccauauggguccucccucauuuguaccuccuuauacugggagcucaaugcugacuuuacgccagccuugaccucauuuccacucaucuguuggacaugacaggucaggcugagucggguaggaggagccaccuaagcagggaaauucagcacagaaugauggagauaagcugcaagaacacccuccuuuucagggacaagacaguaaagguuagcccauuaccccauccaucucaagaaaagauuccacggagcuggguggcucuggcuugugucucaauaaguaaaaggcaagauggcaguucacuuaccccugugaacugaggaucaggcuaagcaaccucccggacgccaggggcaaccaccacugucucuuucccuuugucuccugucugcgccccucccccaggcugcuggcauaguuaauuggccacuagaggagagacgcccuagccaagauucauggcccagcuucuagcagccucccaguaggcuuauuugucggugaaccccaagcuuguacuaggacauucuaggucuccgccaccucuaccucccacgccuaugcaaccuguuccgugcuugguugguuucuggucugaggagcccuuuauauccuauguuaugagguccaugggcaccaggccaaagcuguuggaggccugcugcacagcuucagaaacauaggaaaggagaggcgcaugcagcagccccauggugucucagacucugaucccuaaggauacaagaaaacagccccacgccuggaggaggauuauguguggccuugacuaguaggggcggcguccugcaacuaaaguguccguuccugcgucaggaagcacagacaggcagagcccaggauagcggcuucgaaucucugaagccccaaccaacccaccccagggaccacuacgucucuucaugccaagagccaaccaggaccuuggccccgccucacuccagaaagccaacaaagcacaagacccacaccacuuccgcccagggccggaaaugucuaggaaacugguuggcgcucacagugcguggugacgcacuuccuccuugugucggacccggccgggacggcuuccgacaggcgaagcugcaggccucaacccuuugcgauuggcaguuagcccuggaguauugugggaaccguggcuccgccuuuuccuuuuucgucauuucuggguggguuuccgugugcgcuccggguuggcacgcuuguuaagguuacaagucccggcugacauuaggcgggaacccauugccuucugggaguuguaguuucucgggcgcugaagccacgaaaaucugaucgcccgagacucgguuucccaggaacccgagcgagacuggacaggaccgaaucccggggaacuggcgggacgcugcgagaaaggcggcaggguauugaggcguguacggacgcuggaacggugagcacuggccucccuaaggccgcggccagggcauucccgugccuguuucugccagcccuucguccggacccggguggcgcuuguaccuagagaggcugcgcuuuacugagagcccgugaugggacaagcagcugauggagaucuccugucaccagcaucucccagugcucaucuauuguauguccacacuguuaugaucucaugguugacucucuccuuaaccccaccuaaccugcagcuccuguaucugugcgcgcuaggauacccuuuaaccacccagcuucgcgaggccucccguccggcugugaguagaggcacuugacacauaguggaggugaaagacgggagccugggaggacggggagggaugaggccuuaaauacaccccucacggcggaacugggacugcuucgcuacaggugggacgggugucaggucguauggcggagacagaggcuggccuggaggcugaugaacccaccgaggaugacacccugccuucugacaccgucucccucagcgacucggacucggaccuuagcuuaccuagugguguggagguccaaguguuguccccagagaggcuuucggaggagggccaggaggacuccggcccugaggacccuccaucgccccccacgggcacccucaccacugcagugcagccauuccaccuccgaggcaugaguucuaccuucucccagcgcagccacagcaucuuugauugucuggagagugcagcccggcaggcaccgugcucugcuccccaaaccagugugagugacaauggcagcuucaggcggcccgugacucccccaagucagacuccagcaaggggccugagcagagugcaugggaacacuggcccgacuaggguacucccagucccugacuaugugucacacccugagcguuggaccaaauacagucuggaggaugugucugaagccagugagcagagcaaucgugaugcugcccuggccuuccugagcucucgaagccaggugucccacacagacuaugugccuucuuucaaccaggaccccucuagcuguggggagggaagaguggucuucaccaaaccagugagggacagugaggcuagggcugagaggaagaggguccuaaagaaggggguugggucaggugcggggggugaggccgcuguggagcuagcccaucucgcuggaccugaggcugaggaauggaguggccaccagggacagccagagguggugguaccuucagaagcugcccauccugaguccucaucaggccccauaggugugaaggcuguugguuuccauggcagcaagaagcggagcagagaccacuuccggaacagggacgguaacccuggggggccggggucugagagaggacccucaguuugacugcagugcuaucacucuaccccucaccugcuaguccaagugggaaggugugggcugucugugguagggggaugugugcagccgcucuggcagagacugugggaauugugggucaggggaccucgaaggccuuugugccccaguguuuaggaugaauaauaaacguuuggaauauuucuugaauuguguggcuuuuuccgggccccacucaaagaguucuguccaaacaguccugggcagccaacuacaggacugcaucucuggcagccucaccuugccuuccccacuccagugaggacugccgugaagguuugccauggucauuuacauuugucacugaugaaacuacccagagggacugggcucuuagcuguguucagccuugugccccugaugguagugaaugagcauaaucugcacaacccacccccacccccacccccagaaaccaaugcagccccagcacugggccuguacagaccacagguuauaggaagaggaugaguugugaagcagcauaugguuggugucuggcugugucuccaggacuuguguguguaagacacagcugaugcugggucauuccacugaagcugagccagagaagaagagaaggaugcagggaggaugcaugagcgaauguuuccuguggaggccagggacuuggaccaaguuagcuagaccugcuaagacccaggucugccccagccucuguaguccccauucucugaguuccucuaaaaaggaccuggauggucauuuaauuugaggagcaguggaaggaacggagaugccuuucacuaggucagacaauccuccauauuccccggguguuugaaaugucccguuuagccaccauuguggcccaguuuagcugauuugagguggucuacaggcuuuauagaaaguaaaguagcauuggguacccuugagcaauaucuugggguuucugccagaaugaucagacagauaaugcuguggggggugaaagaugggagguaauuacaauagaucugaguccugcccucuaggagcuggucagcuaaugagugggucaggggucagaaagaaaccuaguguuuaagagguuggcuucuuaggaacucaggguaagacagggguuagaccuaaauagccccauccaggcagaugguguccuauguaggacuuggccagauccagcuguccaguccaagccagugaaagcuuuagugggacaugaaaaaucuugcccugcuggagaggauacuucugaggcucccgaauagaugccaaagacaugaguuucauucucuuaggaagggauguccaagaagugaucuguagcaaggccuugaagaccauuucuuggggcugcugggagugggggaagguugaugugccccaaaaacucgauguggccaggucuggggcucuagagcaagugguuucuccauuucaggugucagaggguggcaagccagacucuagguacucccugucucuagcagaggcuggcugacuccugcaaccacaguucugagagccugggagcaagaaagggagaaaggacccucagcuggagagccucagcuggggcagggcaggagugaggcaagggccaggacauggaaaguggcaaggcuagcaaggccagugcuaggcagagccuugggacacuaaggaacaguggccugccgaggguaaccgaccucuagcacagguggagaaggcaggaccuaauacaauacacagcccgcagcuuugcucuugcccuaaucuaguggcugaagggaggagcccauacccaucucauucccauggccugaacccauacuuacuugaguaggugccuccuggagccaguguauccgucauagaggacaagaggagcauacaguaguuggccuggagagagccaagggagguacugagacuucgguggggacuggggggaccggguugguuuccucccaugugauugcccuccugccagggcuacugcugcccugggacuccacacucuggaccagguccucccauagugcaugauaagggauagugaccggauguggugcugaaccuagguuuuguuggaccagcucuagaacaacaaugagucucgaaagugaguuggggcaggggcaggccacucuauccaggcccuaaugcuacccaccaggaugcugguacagggcugugguaguucccauggaaccagaaggaugcccccaccccaggaagaaagauggauagugaguugcuagcuugccugugauuccagacacuugauccucuuuucuugcucucucagccccccgauguauuuggcaaucaaguccacucuguagaaagcagggucagccucaguugugacacuuccaugucacuccacaagggggagcuuuuuguccuaacugcuuucucagggccucaguuaacuguuggccucuugcuuuacugcccuuccagucuuuaucuggggccugucuauggauauggagcacugcuguacccucaaagagauugagauccccucccugcuuggaauaggccaccaagcaauaggaugaacacuaggucaucccuauaagcauucaagaacagccccuccaccaucuagcaccaacugggcguggaucuucagaccugagagaggaggaaaagagucccauuggagagagaugccuaauuauggacuuaugcucucaacccacacauauacacacacuccuagggcaagagggcugggucuugugacccagccauguuuccccagcucagagguccuguuauuggcacuagauggucucacccagccuuaaggugguucagaaaaccccaccuauuacugaaaaggcuagauauccccccauuuccacauguucacaauggggagccccuccuagacuuacugccccucauaacacccagcugaucaaggucagcccagcccugcugcaucugaguuuaccucccuccugucagagcccuuucuacaucucugggcagcucaugaacaggaaugacaccugccagccugagccucauaugccugcugucccacaggcugccccaccugugugccguuuuccucagcaccucccccucgcugucccuccuccguuucuccaugguacucaggaaguucuccuuuugaaccguuucccagguaaugaucuucugguccaaggggucaggcaagucucucucuggcaaugugggagacagcagcaagcuuuggagagugguguggaccucuagggaaagucuaggcccaggcugaugcaagggagacugagggcagaugccaccaggcagggcacaagguagaugacagaaauaagcccuaugcagggauuucaggcugcaaggagacaggcuggccuuguggcugucuagucucaagucuaccuggagcuuugguuaaccuggacagggccuagacaaggaaccccagucccuucuauggucuccucugucaauugggacccuccccucgggagcaguggcauccagccuggggccucacccagauguugucgcuuaugcugggcuuccuuccugaagaccugcuugagcaccaggcucagguggcugagcaggaugaagggcggggccagagcuggucuuccaugguauucaacgaugaggugguagcguugaaacuuccagaacaugucugcauugccuugcaccaccuggaauguguagcuacaggacacauagccaagcccuugccuuauaagcugcucuaccugccaugaaagcacccuaccucaacccagcaucuaccuuccaccccacacacaacgccccuguaucccauuucccaucuuucaucucaccccuccaccucccacuccuuauaugucaucccccauugcauccaguugguagcuuggcugugcugggagcccuuucagaaagauagaggcuaauaguuagcuuuaacucucaacuugacacagccuagagucaccugagaagggaaccacaauagagggacugucaagaucauagugaccugugggcgugucucugggggauuaguccacuaugggcugcaccauucccugugcaagaggucuugaguuguguaagaagucuagguaaacaugagccugaggaguuagcaaacagcacuccucugugguuccugccuugagcuccugcccugacuucccucaguggcagacugugauccaggaguauaagaugaaauaagccuuuucuuguccuacauuguuuucaauuaguuuuaucagagccacagaaaggaggcuuggaugggggucuggcaccccucaaacacauucucagguauacugcaguggagcuuccucagugggguauuuacacagcucugaguccccaacccuguagacccaucuuccuuccuaacaggauaaacagcaggggugugcucacaguguguccauaccuguaguguuggcucucuacugcagguccagcccacuggacacagcagcaaaauaccaggacauggguccugucucugucagcacccugaaaccagcccuacuaagauggagcauggauuggcgagggcagaugggcagaaguggaagcaggaggguaccugaacauggcgaucagaagguucaugagcagcacauuagugacaagcaggaagguaaccagcaggagaaugaccagccaguuggcauagagauuagggcaggaagccgagcuuuccagcagcagagggugaagagaacaguucacacgagccucuguaaggcaaacagacaccuucagacugggagugugguuccaagcugaggccgacaggcugugggugccagguagguggccaggggccugguuaacauggggcuagcuaguuuaagcaccaaaaguaccagcccuaguuacaccaagccaacaaguucaucuucugccuccucugcugggauuccauggaggcaagcccaguccaugugaggaagugagaacaagagccauagagcccuuuagaucuccuguccaugccuuucucaccuagugcucucagaugggaugcaaaccugcagcuuucuggguaccucugcccauaaugggaguacccagaucccugggcaucccccaaggacucugagucacaaugcuagccccuuauaaaugucauccccuuuauuucugcuucuccccugccugcagggcuuuacccugccaagccugcagggaagcauaggcugagauugcuaucccuccuccuggcuccauccccugucuucuccaggcuguaugcuggcacauaacugucuguauaaguaggugugggcauauaugcauguaugcaugcagcuguaccaccuguacacuucagugaguuauuauugauucuguucuuccggcucucagaauuaugggugaugcucuaggcgaggcugccuugagguacaauuuugggauauuugacuuucaagucuaguauauguacuggcauucuucugaccugccuuguuucucaaaucccugccuuguuuacccagugaguuauuaugaccagucaacccaugugagauguagaguguucuaucauauggagggaugcaaucagucaucugggagugccagauccugccuugcccccuccaaggcugcuuuagcagucacuccauuccccacccuaugaaucugcuccagguucuguuucuccagcucucuucccuucucuaggugccccagaggguggccaagccccuuagaagcaaggaggccuugaaaaagcauaaauccugccugaggccugagaaggccugccugaccugguugaacacaaguuuggcccugaagcccagagccuggugggaaaagggggaagugcgugaaauguggaggagaggugaggacuacccugcagacugggccagaacuacccaggccucaguuucccucugaguacacuguagcuaucuuaagacacaccagaagagggcaucggaucccacuacagaugguugugagccacaaaugguuauguaguugcugggaauugaacucaggaccucuggaagagcaguuagugcucuuaaccacugagccaucucuccagucccaguuucccucugagcacaggcauguuagagaauaccagcccacucccagcauaguagacacaguguagggacuggcaaugcuauuucacugcucacucugccugccacaucuauagugguucugcugacccugcaguggccuccauaccuagacuaaggaccacccugcuacccuucuaaacugccagguggccugagcuuguuccccaauuccuguggagaagaaaccagaauuauaguuacuauggaacucagaccccagagcugcccuggcugggguacucaccuuccucuuccuggccccagggacugaggccaugaggccauauggcucaggggaagggagaagcgggcaaugucuguuuaagcuaauggccuagaaaagugauggcucaguugagcaaacaccaaaagcaaugugguggggagaagaaaacagcccaggguauggcuugggagcaccccaauuagaaguuaauuuccagcccgucugucccuggaggccugggcuugcuccaaucucacugucaucuguugacaaauauucauccaguguuguaauugcugaccuggccucauuacuggccucccccagaauggcuggggucaggucucuauugaccauccaagcuguauaacacuaagucccuugacacuagccagaauacugacaccucccccagugccugaaucugcauccuaucucuaagccuacacauauggacauauggagccucuguucugaucccccacucucuaggccucuuuccggccuaaugagcugaaucucuauguuugcccaaucuuagccaccuuaggucugccuggguccccacucugucuccaggguuuuucuuccuccacuacccacaagaccccugcaguaaguacagagcuguguccacuugucaugaagucccuagaaucuccaucagcccuaacuagguuuagggccuagcuugaggggacacucaugucuacagacaagccucauaccacugacaucaacaggcaacacacacaaguugaagcccauugcaucacuugacuucccuaagaagaaagccaggccugcauauucaggaucuccauggccuacuucccagccagagaaugguugagggcuccacggcuggcugugucuuacccuacucuggaccucagccuaggagguaugcaaggccuguggccuagacuuagggugcuguugugucagccauuuucagccagggaccuggugacccagaagucccaguggagcacauauucuagagcccacccgcccaucagcccacccuuccuggcucagcacaaaccaucaauuucauccagagggauuugcccaaagaucugcagguaaggccuguauagcacacggcggaaaauccacuccaaacggccaucauggggaugcagcagggccugaguggucacaccauaggccacaagccauacgcucaggaagaagaggaaaaagaagacauccuucaucugcagagggagggucacagggcauggccuaggugggaacuugcccucaagggucacagaagggcucacucuaccccaggguggaguucagagaguuuacccucacuuaggguuggaguucuaggguuuuuaccucaaccuaggguuagggucccaggggagucauccccucccaggccugagguguuagggucuucaccauuaccuugguugggguuuuaguacuuaccccuauccagggucggaggucccaggauucucacugcuacccgggguugagacaccacggggcucaccaccacccaaggucaagguccaauagggcucaccccuaacccagguuaggguucuggggagcucaucucacccagggcuagggucccaugggcuaccaccuauccaaagcuggauacuccucauccccaucuagagucaaagcucagugcccuucccaucuaugagucaguuuuccuuuggacucugcagcuauccagagcugggaucccaaagggcucacccccccccacaacaggauuagggucaccauccacugaauaaucuagguuccccaucuauccagggugggguucccgguaccucagcccccucaagggucagggucccaaggacccaccauucgcucuacaaugaugaucuuaggacccaacugcuugugaauagcaaagauguggaugagccgaagugugaacaccaugaagucaauggccagaacgguccugccagccucaaacaccgagggcaccauucuggagagggacggaggcuggguaaggcugcuggugcccauguaggacaggagguuucccccaagacacaaaguaugcuagucagcuggccaaaaaccagguuccaggaccacacuuggguuucagagggauaaguaggaccccuagagccugcccacauaccuacaggugacucccacaaugaacaggaagauggccaccaugucacacuuguuccaguugucuuccacauacagagugaauuucuucaccaggugcguguccucaucugugaagaagcccuggcagagggagaaagccugguugcagcaccgugucuuucuugcugagaccaggguggaaucugcaugaaucagaacucaguuuccaaguuuaucagaaucaauugaugacuagcacucucuguauggcuaggaauggagauaucaacugaagauauuucagggauaagucuggggacaaaaaaaaugaggucaauccaaacuuagggucaggacugucugugacuaaaacucagagucuggacuuagucagugacucaggucaggguucagacucugacuaggguaucagaaucaagaucaaucuggagcagagaucagaggucaagauggugcugaaaucagcucagguuggcucuaggauugugacuaggaucaggacuuagucugauuaagauuggggcuuggucuggaucugggauuggggcucacucugugaccaggaccaggacucaguagaguggguugacagaaaggccacacaguggucuuguucuaauggauuaaaaaguccuaccucccccggaacaggucccaccugaggcacauagaacacagccugaguugcagagcccaggagaaggccaugccggccacugaccugucggauuuccuccagcaccagugugaacacccagaaauagaggguaaccucggauccagacggccccuggggugguggccugaaguccaccagcaggacauaggugaacaggaagaggaaugcgaaguacaugaccacauuccccaggaacacagucacaggagcgccccagaacuuccuccaccgugugagcaggaaggcagcuugugggccuagaucgccuggagcccuuggugccucuguuagcuucuccaaucugugugagugcagaggucaccauggugaggagauaccaaaccaugguacuccaugggagccugacucugucuaccgugugucuaggagcuggccacugccuagugguagcccugacucucuccauccaucccagcauucuccauucuuccuaaccgucacccuccccuaccuucuuagcccugcgcuaucccuucuagcucagucuccuccauuuugucugugcucuaucuuuccaggcccacucuaucuuucuguuuucuaguuccuucccuccuucccuauuucuugcauccuuccugccccccuuuauccccuucaccccccccagcuacuccuuacuggccaccccggcugcauaggaagcucuuuuccauauccaagcugucuggcuccugcagaucuucuagguccauccucugcggggcauccucacugcaacacagagaagaauaucccaagcacguagacggaagaaaguccaacaugggggagagggggcucacauagccaaucaaucagacauaaggccgugagacaugagaacaucgagacugguaccugcugccgccuguguccaccuaccugaaggagaugagguuuguguagaugagggcugggcaggugaaggcacccagaagccguaggaugggugugccuguggccaugucuccccaccagaucuuggucaggaaugccuggaauaaagucau

SEQ ID NO: 26 - RNA, 21720 nt, Mus musculus
augacuuuauuccaggcauuccugaccaagaucugguggggagacauggccacaggcacacccauccuacggcuucugggugccuucaccugcccagcccucaucuacacaaaccucaucuccuucagguagguggacacaggcggcagcagguaccagucucgauguucucaugucucacggccuuaugucugauugauuggcuaugugagcccccucucccccauguuggacuuucuuccgucuacgugcuugggauauucuucucuguguugcagugaggaugccccgcagaggauggaccuagaagaucugcaggagccagacagcuuggauauggaaaagagcuuccuaugcagccgggguggccaguaaggaguagcuggggggggugaaggggauaaaggggggcaggaaggaugcaagaaauagggaaggagggaaggaacuagaaaacagaaagauagagugggccuggaaagauagagcacagacaaaauggaggagacugagcuagaagggauagcgcagggcuaagaagguaggggagggugacgguuaggaagaauggagaaugcugggauggauggagagagucagggcuaccacuaggcaguggccagcuccuagacacacgguagacagagucaggcucccauggaguaccaugguuugguaucuccucaccauggugaccucugcacucacacagauuggagaagcuaacagaggcaccaagggcuccaggcgaucuaggcccacaagcugccuuccugcucacacgguggaggaaguucuggggcgcuccugugacuguguuccuggggaauguggucauguacuucgcauuccucuuccuguucaccuauguccugcugguggacuucaggccaccaccccaggggccgucuggauccgagguuacccucuauuucuggguguucacacuggugcuggaggaaauccgacaggucaguggccggcauggccuucuccugggcucugcaacucaggcuguguucuaugugccucaggugggaccuguuccgggggagguaggacuuuuuaauccauuagaacaagaccacuguguggccuuucugucaacccacucuacugaguccugguccuggucacagagugagccccaaucccagauccagaccaagccccaaucuuaaucagacuaaguccugauccuagucacaauccuagagccaaccugagcugauuucagcaccaucuugaccucugaucucugcuccagauugaucuugauucugauacccuagucagagucugaacccugaccugagucacugacuaaguccagacucugaguuuuagucacagacaguccugacccuaaguuuggauugaccucauuuuuuuuguccccagacuuaucccugaaauaucuucaguugauaucuccauuccuagccauacagagagugcuagucaucaauugauucugauaaacuuggaaacugaguucugauucaugcagauuccacccuggucucagcaagaaagacacggugcugcaaccaggcuuucucccucugccagggcuucuucacagaugaggacacgcaccuggugaagaaauucacucuguauguggaagacaacuggaacaagugugacaugguggccaucuuccuguucauugugggagucaccuguagguaugugggcaggcucuagggguccuacuuaucccucugaaacccaagugugguccuggaaccugguuuuuggccagcugacuagcauacuuugugucuugggggaaaccuccuguccuacaugggcaccagcagccuuacccagccuccgucccucuccagaauggugcccucgguguuugaggcuggcaggaccguucuggccauugacuucaugguguucacacuucggcucauccacaucuuugcuauucacaagcaguuggguccuaagaucaucauuguagagcgaaugguggguccuugggacccugacccuugagggggcugagguaccgggaaccccacccuggauagauggggaaccuagauuauucaguggauggugacccuaauccuguugugggggggggugagcccuuugggaucccagcucuggauagcugcagaguccaaaggaaaacugacucauagaugggaagggcacugagcuuugacucuagauggggaugaggaguauccagcuuuggauaggugguagcccaugggacccuagcccugggugagaugagcuccccagaacccuaaccuggguuaggggugagcccuauuggaccuugaccuugggugguggugagccccguggugucucaaccccggguagcagugagaauccugggaccuccgacccuggauagggguaaguacuaaaaccccaaccaagguaauggugaagacccuaacaccucaggccugggaggggaugacuccccugggacccuaacccuagguugagguaaaaacccuagaacuccaacccuaagugaggguaaacucucugaacuccacccugggguagagugagcccuucugugacccuugagggcaaguucccaccuaggccaugcccugugacccucccucugcagaugaaggaugucuucuuuuuccucuucuuccugagcguauggcuuguggccuauggugugaccacucaggcccugcugcauccccaugauggccguuuggaguggauuuuccgccgugugcuauacaggccuuaccugcagaucuuugggcaaaucccucuggaugaaauugaugguuugugcugagccaggaagggugggcugaugggcgggugggcucuagaauaugugcuccacugggacuucugggucaccaggucccuggcugaaaauggcugacacaacagcacccuaagucuaggccacaggccuugcauaccuccuaggcugagguccagaguaggguaagacacagccagccguggagcccucaaccauucucuggcugggaaguaggccauggagauccugaauaugcaggccuggcuuucuucuuagggaagucaagugaugcaaugggcuucaacuuguguguguugccuguugaugucagugguaugaggcuugucuguagacaugaguguccccucaagcuaggcccuaaaccuaguuagggcugauggagauucuagggacuucaugacaaguggacacagcucuguacuuacugcaggggucuuguggguaguggaggaagaaaaacccuggagacagaguggggacccaggcagaccuaagguggcuaagauugggcaaacauagagauucagcucauuaggccggaaagaggccuagagagugggggaucagaacagaggcuccauauguccauauguguaggcuuagagauaggaugcagauucaggcacugggggaggugucaguauucuggcuagugucaagggacuuaguguuauacagcuuggauggucaauagagaccugaccccagccauucugggggaggccaguaaugaggccaggucagcaauuacaacacuggaugaauauuugucaacagaugacagugagauuggagcaagcccaggccuccagggacagacgggcuggaaauuaacuucuaauuggggugcucccaagccauacccugggcuguuuucuucuccccaccacauugcuuuugguguuugcucaacugagccaucacuuuucuaggccauuagcuuaaacagacauugcccgcuucucccuuccccugagccauauggccucauggccucagucccuggggccaggaagaggaaggugaguaccccagccagggcagcucuggggucugaguuccauaguaacuauaauucugguuucuucuccacaggaauuggggaacaagcucaggccaccuggcaguuuagaaggguagcagggugguccuuagucuagguauggaggccacugcagggucagcagaaccacuauagauguggcaggcagagugagcagugaaauagcauugccagucccuacacugugucuacuaugcugggagugggcugguauucucuaacaugccugugcucagagggaaacugggacuggagagauggcucagugguuaagagcacuaacugcucuuccagagguccugaguucaauucccagcaacuacauaaccauuuguggcucacaaccaucuguagugggauccgaugcccucuucuggugugucuuaagauagcuacaguguacucagagggaaacugaggccuggguaguucuggcccagucugcaggguaguccucaccucuccuccacauuucacgcacuucccccuuuucccaccaggcucugggcuucagggccaaacuuguguucaaccaggucaggcaggccuucucaggccucaggcaggauuuaugcuuuuucaaggccuccuugcuucuaaggggcuuggccacccucuggggcaccuagagaagggaagagagcuggagaaacagaaccuggagcagauucauaggguggggaauggagugacugcuaaagcagccuuggagggggcaaggcaggaucuggcacucccagaugacugauugcaucccuccauaugauagaacacucuacaucucacauggguugacuggucauaauaacucacuggguaaacaaggcagggauuugagaaacaaggcaggucagaagaaugccaguacauauacuagacuugaaagucaaauaucccaaaauuguaccucaaggcagccucgccuagagcaucacccauaauucugagagccggaagaacagaaucaauaauaacucacugaaguguacaggugguacagcugcaugcauacaugcauauaugcccacaccuacuuauacagacaguuaugugccagcauacagccuggagaagacaggggauggagccaggaggagggauagcaaucucagccuaugcuucccugcaggcuuggcaggguaaagcccugcaggcaggggagaagcagaaauaaaggggaugacauuuauaaggggcuagcauugugacucagaguccuugggggaugcccagggaucuggguacucccauuaugggcagagguacccagaaagcugcagguuugcaucccaucugagagcacuaggugagaaaggcauggacaggagaucuaaagggcucuauggcucuuguucucacuuccucacauggacugggcuugccuccauggaaucccagcagaggaggcagaagaugaacuuguuggcuugguguaacuagggcugguacuuuuggugcuuaaacuagcuagccccauguuaaccaggccccuggccaccuaccuggcacccacagccugucggccucagcuuggaaccacacucccagucugaaggugucuguuugccuuacagaggcucgugugaacuguucucuucacccucugcugcuggaaagcucggcuuccugcccuaaucucuaugccaacuggcuggucauucuccugcugguuaccuuccugcuugucacuaaugugcugcucaugaaccuucugaucgccauguucagguacccuccugcuuccacuucugcccaucugcccucgccaauccaugcuccaucuuaguagggcugguuucagggugcugacagagacaggacccauguccugguauuuugcugcuguguccagugggcuggaccugcaguagagagccaacacuacagguauggacacacugugagcacaccccugcuguuuauccuguuaggaaggaagaugggucuacaggguuggggacucagagcuguguaaauaccccacugaggaagcuccacugcaguauaccugagaauguguuugaggggugccagacccccauccaagccuccuuucuguggcucugauaaaacuaauugaaaacaauguaggacaagaaaaggcuuauuucaucuuauacuccuggaucacagucugccacugagggaagucagggcaggagcucaaggcaggaaccacagaggagugcuguuugcuaacuccucaggcucauguuuaccuagacuucuuacacaacucaagaccucuugcacagggaauggugcagcccauaguggacuaaucccccagagacacgcccacaggucacuaugaucuugacagucccucuauugugguucccuucucaggugacucuaggcugugucaaguugagaguuaaagcuaacuauuagccucuaucuuucugaaagggcucccagcacagccaagcuaccaacuggaugcaaugggggaugacauauaaggagugggagguggaggggugagaugaaagaugggaaaugggauacaggggcguugugugugggguggaagguagaugcuggguugagguagggugcuuucauggcagguagagcagcuuauaaggcaagggcuuggcuauguguccuguagcuacacauuccagguggugcaaggcaaugcagacauguucuggaaguuucaacgcuaccaccucaucguugaauaccauggaagaccagcucuggccccgcccuucauccugcucagccaccugagccuggugcucaagcaggucuucaggaaggaagcccagcauaagcgacaacaucugggugaggccccaggcuggaugccacugcucccgaggggagggucccaauugacagaggagaccauagaagggacugggguuccuugucuaggcccuguccagguuaaccaaagcuccagguagacuugagacuagacagccacaaggccagccugucuccuugcagccugaaaucccugcauagggcuuauuucugucaucuaccuugugcccugccugguggcaucugcccucagucucccuugcaucagccugggccuagacuuucccuagagguccacaccacucuccaaagcuugcugcugucucccacauugccagagagagacuugccugaccccuuggaccagaagaucauuaccugggaaacgguucaaaaggagaacuuccugaguaccauggagaaacggaggagggacagcgagggggaggugcugaggaaaacggcacacagguggggcagccugugggacagcaggcauaugaggcucaggcuggcaggugucauuccuguucaugagcugcccagagauguagaaagggcucugacaggagggagguaaacucagaugcagcagggcugggcugaccuugaucagcuggguguuaugaggggcaguaagucuaggaggggcuccccauugugaacauguggaaauggggggauaucuagccuuuucaguaauaggugggguuuucugaaccaccuuaaggcugggugagaccaucuagugccaauaacaggaccucugagcuggggaaacauggcugggucacaagacccagcccucuugcccuaggaguguguguauauguguggguugagagcauaaguccauaauuaggcaucucucuccaaugggacucuuuuccuccucucucaggucugaagauccacgcccaguuggugcuagaugguggaggggcuguucuugaaugcuuauagggaugaccuaguguucauccuauugcuugguggccuauuccaagcagggaggggaucucaaucucuuugaggguacagcagugcuccauauccauagacaggccccagauaaagacuggaagggcaguaaagcaagaggccaacaguuaacugaggcccugagaaagcaguuaggacaaaaagcucccccuuguggagugacauggaagugucacaacugaggcugacccugcuuucuacagaguggacuugauugccaaauacaucggggggcugagagagcaagaaaagaggaucaagugucuggaaucacaggcaagcuagcaacucacuauccaucuuucuuccuggggugggggcauccuucugguuccaugggaacuaccacagcccuguaccagcauccugguggguagcauuagggccuggauagaguggccugccccugccccaacucacuuucgagacucauuguuguucuagagcugguccaacaaaaccuagguucagcaccacauccggucacuaucccuuaucaugcacuaugggaggaccugguccagaguguggagucccagggcagcaguagcccuggcaggagggcaaucacaugggaggaaaccaacccgguccccccaguccccaccgaagucucaguaccucccuuggcucucuccaggccaacuacuguaugcuccucuuguccucuaugacggauacacuggcuccaggaggcaccuacucaaguaaguauggguucaggccaugggaaugagauggguaugggcuccucccuucagccacuagauuagggcaagagcaaagcugcgggcuguguauuguauuagguccugccuucuccaccugugcuagaggucgguuacccucggcaggccacuguuccuuagugucccaaggcucugccuagcacuggccuugcuagccuugccacuuuccauguccuggcccuugccucacuccugcccugccccagcugaggcucuccagcugaggguccuuucucccuuucuugcucccaggcucucagaacugugguugcaggagucagccagccucugcuagagacagggaguaccuagagucuggcuugccacccucugacaccugaaauggagaaaccacuugcucuagagccccagaccuggccacaucgaguuuuuggggcacaucaaccuucccccacucccagcagccccaagaaauggucuucaaggccuugcuacagaucacuucuuggacaucccuuccuaagagaaugaaacucaugucuuuggcaucuauucgggagccucagaaguauccucuccagcagggcaagauuuuucaugucccacuaaagcuuucacuggcuuggacuggacagcuggaucuggccaaguccuacauaggacaccaucugccuggauggggcuauuuaggucuaaccccugucuuacccugaguuccuaagaagccaaccucuuaaacacuagguuucuuucugaccccugacccacucauuagcugaccagcuccuagagggcaggacucagaucuauuguaauuaccucccaucuuucaccccccacagcauuaucugucugaucauucuggcagaaaccccaagauauugcucaaggguacccaaugcuacuuuacuuucuauaaagccuguagaccaccucaaaucagcuaaacugggccacaaugguggcuaaacgggacauuucaaacacccggggaauauggaggauugucugaccuagugaaaggcaucuccguuccuuccacugcuccucaaauuaaaugaccauccagguccuuuuuagaggaacucagagaauggggacuacagaggcuggggcagaccugggucuuagcaggucuagcuaacuugguccaagucccuggccuccacaggaaacauucgcucaugcauccucccugcauccuucucuucuucucuggcucagcuucaguggaaugacccagcaucagcugugucuuacacacacaaguccuggagacacagccagacaccaaccauaugcugcuucacaacucauccucuuccuauaaccuguggucuguacaggcccagugcuggggcugcauugguuucuggggguggggguggggguggguugugcagauuaugcucauucacuaccaucaggggcacaaggcugaacacagcuaagagcccagucccucuggguaguuucaucagugacaaauguaaaugaccauggcaaaccuucacggcaguccucacuggaguggggaaggcaaggugaggcugccagagaugcaguccuguaguuggcugcccaggacuguuuggacagaacucuuugaguggggcccggaaaaagccacacaauucaagaaauauuccaaacguuuauuauucauccuaaacacuggggcacaaaggccuucgagguccccugacccacaauucccacagucucugccagagcggcugcacacaucccccuaccacagacagcccacaccuucccacuuggacuagcaggugagggguagagugauagcacugcagucaaacugaggguccucucucagaccccggccccccaggguuaccgucccuguuccggaaguggucucugcuccgcuucuugcugccauggaaaccaacagccuucacaccuauggggccugaugaggacucaggaugggcagcuucugaagguaccaccaccucuggcugucccugguggccacuccauuccucagccucagguccagcgagaugggcuagcuccacagcggccucaccccccgcaccugacccaacccccuucuuuaggacccucuuccucucagcccuagccucacugucccucacugguuuggugaagaccacucuucccuccccacagcuagagggguccugguugaaagaaggcacauagucugugugggacaccuggcuucgagagcucaggaaggccagggcagcaucacgauugcucugcucacuggcuucagacacauccuccagacuguauuugguccaacgcucagggugugacacauagucagggacugggaguacccuagucgggccaguguucccaugcacucugcucaggccccuugcuggagucugacuugggggagucacgggccgccugaagcugccauugucacucacacugguuuggggagcagagcacggugccugccgggcugcacucuccagacaaucaaagaugcuguggcugcgcugggagaagguagaacucaugccucggagguggaauggcugcacugcaguggugagggugcccguggggggcgauggaggguccucagggccggaguccuccuggcccuccuccgaaagccucucuggggacaacacuuggaccuccacaccacuagguaagcuaagguccgaguccgagucgcugagggagacggugucagaaggcagggugucauccucgguggguucaucagccuccaggccagccucugucuccgccauacgaccugacacccgucccaccuguagcgaagcagucccaguuccgccgugagggguguauuuaaggccucaucccuccccguccucccaggcucccgucuuucaccuccacuaugugucaagugccucuacucacagccggacgggaggccucgcgaagcugggugguuaaaggguauccuagcgcgcacagauacaggagcugcagguuaggugggguuaaggagagagucaaccaugagaucauaacaguguggacauacaauagaugagcacugggagaugcuggugacaggagaucuccaucagcugcuugucccaucacgggcucucaguaaagcgcagccucucuagguacaagcgccacccggguccggacgaagggcuggcagaaacaggcacgggaaugcccuggccgcggccuuagggaggccagugcucaccguuccagcguccguacacgccucaauacccugccgccuuucucgcagcgucccgccaguuccccgggauucgguccuguccagucucgcucggguuccugggaaaccgagucucgggcgaucagauuuucguggcuucagcgcccgagaaacuacaacucccagaaggcaauggguucccgccuaaugucagccgggacuuguaaccuuaacaagcgugccaacccggagcgcacacggaaacccacccagaaaugacgaaaaaggaaaaggcggagccacgguucccacaauacuccagggcuaacugccaaucgcaaaggguugaggccugcagcuucgccugucggaagccgucccggccggguccgacacaaggaggaagugcgucaccacgcacugugagcgccaaccaguuuccuagacauuuccggcccugggcggaaguggugugggucuugugcuuuguuggcuuucuggagugaggcggggccaagguccugguuggcucuuggcaugaagagacguaguggucccugggguggguugguuggggcuucagagauucgaagccgcuauccugggcucugccugucugugcuuccugacgcaggaacggacacuuuaguugcaggacgccgccccuacuagucaaggccacacauaauccuccuccaggcguggggcuguuuucuuguauccuuagggaucagagucugagacaccauggggcugcugcaugcgccucuccuuuccuauguuucugaagcugugcagcaggccuccaacagcuuuggccuggugcccauggaccucauaacauaggauauaaagggcuccucagaccagaaaccaaccaagcacggaacagguugcauaggcgugggagguagagguggcggagaccuagaauguccuaguacaagcuugggguucaccgacaaauaagccuacugggaggcugcuagaagcugggccaugaaucuuggcuagggcgucucuccucuaguggccaauuaacuaugccagcagccugggggaggggcgcagacaggagacaaagggaaagagacaguggugguugccccuggcguccgggagguugcuuagccugauccucaguucacagggguaagugaacugccaucuugccuuuuacuuauugagacacaagccagagccacccagcuccguggaaucuuuucuugagauggaugggguaaugggcuaaccuuuacugucuugucccugaaaaggaggguguucuugcagcuuaucuccaucauucugugcugaauuucccugcuuagguggcuccuccuacccgacucagccugaccugucauguccaacagaugaguggaaaugaggucaaggcuggcguaaagucagcauugagcucccaguauaaggagguacaaaugagggaggacccauauggagugcucccagggucccagcccuccccacccacuguguuccacagccucuauuggaccugcucacccugugccuggcaaaguucagagcugaugagccaggucucugacaccgcuagcacaggaagaggucuggcagucccauuagcaugccugauuuuuuuccuccuuuauuaaaugacuguuucaagauuuaauuacaguugaaggugacacguuagaaagaauaagugcauugaaggcauaagagggcuuacaaacccagcucuugaaauggaggcaggaaaggaacaaagauuaaaaagaugugagcaaugugacccacaguggguugagugggugggcauggcccucuagcuaggcuacaaagccucugggcaaguagcuguagaggagguuuggcucagcaggcagaacucuccaggggucccagacguacagggcccugcaagccagggccagcuccaccccuacaucccacauaugccacccaugugugaugucagcucccaaaagguaacaggaaaaguucaggacaaaaaaaaaaacuaaaacaaaaacaaaacaaaacaaaacaaaaaacucaaaaguaaaaagacuaaguguagcagagugauacagaaauauuauauacacaggccaugucccccaagguggccucuggucacuccagggauccucuggugcaaugcaaagggccucaguacacggagcuguuccggaugccacagcacagcaccaugcucagaaucaucucaaagaucugcaggagggaggggcauagucagcaccuaaggcccugggaaggaucccacccacccaccagagacccugugcuuaccauaaugacagcuaccacaauggcugcaauuccaaugagguacagcuucccagagaagagcucaucgauuuucugaugacaaucuugcugcagggauggcaagagcgugguuaaccaucaguggcuaagucacagccaccacccuacucagugacaggaccuauguaucacagcuuaucuuccaccccaaaacaaauuuaagacacacggaccugcugccugcagccuuuugucacaggggaguguuuuuuuaccucacuagcacccuagggucaccaggguaugagggaccacucaagagaacaguuuucugggauguugcagggguuaacucaagcugugaggacccgguaccccaguaauagagauggucuaugggacuucugaggucuugcucaaagugcugaucuuccugauuggccacaccacccuaccgaccaccaccaccaccucauccccacuccaugcuaccugcaguaagggggugaguauguugccgccugagggacacaggcuguuccucaguauggugguagucaguguggucagugcguuggagccacaacaguugagcugcagggaccaagaacaacacugucagcuuuggagcuucaggagacaagggaaagaucaggcacacagcacaccgucaccccaaaauacacuugggaguuguccuucugcccuguuugucacccugcacaggagcccuguuccuucaaaccccugggaaaaugaggcccauuagauuccuaccugaggacccacaaaucauagaggagacccuuuccuaggcccuguuguguuggaaagaaaggagacccaugcccucacacacuaggaaccccacagccuccccuccugcuugagccuagcuauaccgucucauggaaagucuucaccacagccuuggcauuguuggcaucaucauccaucacagcuugcugaagggccuggucauagaacugcuucacauccuuggcgaucugggggagaaucauagucacauacagugucggggcuacgcccaagagcacucaacuucccgaugggcucagccugaugccaccucuuccacugagcucccaagacccugcccccacccaagcagcagguccaagaaauucaaaaagcacccuauaacuaugggcucagagcaacccacaucuguuggagggcagagggcauaucucccacucggugaaccuaggcuuaccuggucuuuguuuacgaagccccagaugccugcagccaccucacaggcaaacaggaucacaaggcaggugaagaacuaggggaaagaagaggucagagccuugaccagcaagcccaggccuagcccacaugaccaacagcuaugugccaaggggguuggccauauccaccaaccauguccugauuaagcaugagccacacagagccauugagagacaagagccugauacaguccugcacugagauguucaaguucucauagccucaccuugcauccuacuuugcaggauguggcugguguagaaaugcaguugacaaaguguccacagccuucacugaggcacaugcagcaagacacuccccaacccuaaccucaguuuccucaccuccuuuauccuacauucuaugacgugugcugccuuuccccagcuucugauacuggcagcgccucccucccaggcuggccagauucuggcaaaucugggauucagcuucaccagcagcuaguguggccaggagcacuaagguuggcuuuaggggugagacacccuucuggaguuuaugcuuuuuuaaacagaaacccccuuuuccaacauguauauucauacucagauucaauggaaaucaagccccuaggaaaaccaaaaccuuggggaagacauauaaguugcuaggaacccugcuccccagcccuucagcccuuucuacuuaccguccccagcagacacugggacuccuggauggccccauagcaccccaggaagccuacaaacaucaucacagcucccacagcaaugagaauguagaugccuggggaagggaagaccugagugagcaggcugcaugaaucacacaggaaggccuaacucacaaccacagcaggcagaguuuagcaaugugcgccguuuaugccuccgugugcugcuggaggagcugccacugccaccaggggacaaagcagcaauucagugaccagagaacauggguggucuccauuucacagguaugcucugcucuggagccagucucccaccaccugcaucugagaacaggaacccucagcacgcacuguaaagggcugagacggacuauccguuucaguuaggggaaguggcuugggugucaggagccaaugcccaagacucccaauacucggugagugugaaaucaaggguaagcuauggcaguaaccaacuccaggcaccucaucucaggaacacugguguauaacuguuuggcucaccuaacucuaaggacgggauccuguguguggguggauggcuaagagaaugguaggggaagcuuaagcagagcacccaaugucugucacaguuuacaggggagcacuguagcccaugagguaccaacugggccaugucccugccucagugcccacaauacccccuucugccccugggaaagcccacugugucuuugaugagcguuccaucucuuggucccucggcagaagccguccaucccccagucuccacggcaacacuguagggcaguccaagcuuccuugcacaaagucaggcccauuguucccugccuggccagaccagaggagaaggcaccauggccuggaccugcugccagacuuaaaaauaggccaaauccuuuggccucacuaaacacgucugguccggggaaggccucccaccagggcugccuagaaacuguuuucccccuugccucccaacuggcagagcaccccaguugucaggcccuaaaaccccaaccucacucugucucaacaggaggcucugucucaacaggaggauacauacagggcacccaacacacaggcacugucccaggacuuucuaggcccuaggcacccuccuaugucuagcacaugucucaucugaagccccugugguguugucugggauguuuagcaagcucugaaugaacucuccuaagcacuaaauaagacaccuuuuucagggccacaucugcuccuagagggacucaguacaggggcagcauggggcuccagaaagccaauucagauuggccagggacauggcagccagaguagcuucuacccauagguagaagaaccugcuacaggguccagucccuaagacuauuuccccaguacccaggaggccauaaccagacaggcagguggcugagccgcucuggaacuggagccugguauagacuauuaugagaacauuaggauagagacuugcuuccuaaccacccuaucugggcucugcaggguagccagccucuccugccauaccugugcagagugggagcacagccuuccccuuguggagggcccaccggccaguucuaccccugucugucucugauucccagauuucccuugugaagaugccuaccaguugccacaauccaguuucuaugagcuggagggcauccuccuucucugaagguaccagauagaaggagggauagcuagugugggcccuucccuacuaacaaccaaaccugaaaacugcuaccccucauggcuuuccucaaaggagaccagguucugccccugcccauauugccuggacuccacugcuguccauuuuacccaugcuaaggcuguggacagaguauagggaggaaggaaacagagcgagccaugggguaaccaaaagcccugucugcucugaggcaauugggcagaaagggagaauauuucagaccuccuggucccccacucagccucaagcaugccucccaagccucuucuaggcuccacaggaggagaaggaagauccacaucagagcccugaugaagguaggagcuuuggaaggguaaagacaucuccaaauacuucuucaguucucaggacaccaggucccucuuccagggaggaaagaggaaaguuuucuccuucagcacaguguaguggaccagagcauaggaccacacagcacaacagccaucaucuuacuuaggagggaggguguucagccccuacaggcagccaaauaaggcagguguaacagucugggcugugugcugguggggguggggugggguggggugucugagucauucacugucggcccagucuccagcccuucccaacucaggacuccuggagccucagcuguugcuagcccaggcauccugccccacccugcccagggagguucacuagaaaugcccauguuaaaauaagcaagguccuacaaggccccugccccaccccguugcuuccuuucugccuagucuagucucagaucuguggggucaccagcagcaccacagccaacucauucuccucuuauaggcagccucccuacccagcucauacuaggccuaggccacucccagcucuaacgccucacccaccagauuuggaccaucagccucuucuuggaagcccucccugacuguucugcacugugacuggaacccgucuccuugguacucacccacguagaagguguugggugccgguuuguuucccaguuccagguacagcaggcugguggucuguggaucaugacgcaaccacagagcuacaccuaggaucacgccuccagccagcuagaaaaaaaaaaaaaaaagaaagaaagaaaugaaaaccaggaacagugucauauagaggccagaguacuggggccaauggaagccuacaaugcuuaucauguagagcccucacuuccaguuguggagccagaugccaagcaguugucugagccacugccacugagcccugggucccaccagcuccucuugguuguaacuccagaacagaauucaaguguaccuccaauagcgcaagacacauacaagaaguuuggucugaaaaauauggcucaguugauaagaguacuugggcauguagggagcccuggguucaauccccaguaccacguaggguuugguggcaauuguuugucaucccagcacuugagagguagaggcaggaggaucaggaauucaaggucaugugaguuugagacuagccugggcuauaugaaaccuugucuccaaaaucagcaggaaacauccccccccccuacuguuccagauugaccaacuaugcaacauuuuuaccguagaaauggccacagugaggcccagccacucaggaugcuggugggcucuccucagguacccugucccaacaguccugggauugauuagagacugcuucaggcaggauacugggaacucugugguggagacaccaaguccucaggggugaccaugugaugccaccaggccccgcagagagaagcagguaccugggagcagaagcugggccucagaacagaccaaggaaggcagucuccuccccagcgccaggucuccucuucuugaagggucaguggcacuccccagcagaaacagcaaauagaaaccaaaaccugggucuaaaaaaaaguaucugcucuucacucuggggauccaggccagaacacaagcucaagaaagcucugggagaaauuugcaagcaggcugguucaggaaagaagaccuauggacccaucugccuucuucuacccuaggaucauguccgcugcuuaacccucagagaggaagcuggggagggguacuuuccugaucaccaucucccucucccuccaccccuucuuucucaguuucucagacuccucuuuaagugcuuaauuucguuuuucacacuccaauccaggagggaugagcccccaaccuccaccagggccugagagaagagggugugugauacagcaaucaaagucacacccgggcacccguugcccaaaccacaaauggcaugaaggcugagacucugacagugccuucacauguaacggcccuagcgaugccagggauccccagaauuuccagcauguuacacugacagcucuuuauccaucugcccuuaagaaccucgcucgaaucagcuugggcaacagaagcaggagggugggaggugacgggucugaguugcccugguaaccaggcuuccuuugcagcuuuuaaacauccuauauuuuguuuaagaucuggucuggaggcugcucugagaugucccagggcaggagaaccagguggcacaccuguuccccauccuucccucauugauaacaugacccuggugacaaucccugauagucacagaggcuaaggggcagcuggugggucaccuugcuuuccucagucugugugcuuaccuguaaaacagcugagcaugcaaccaugccugacucuggcuucucuaaugguacgggaauacugucugugagcugaggggcaaaggggagugaggcaugcuguucagccgagccccaaaggcugcuaaugugggugucuggccaagccaccacuuagagccggguuuuaugaaagaggugggaugaggacguuaacucuagaaaagucucugggcuuuauucauuaacugacaguccugaauggggggugcacggggggggggggcuaaggaucugugacugucaaucagaagagaggccaaacugggguggggguaggcaaggcaucuggaaauggggacuuggccacucaccccauugucccaggggcaaucagagcugagugggaaggaaugccagguacugagauggcuuccuccagcaaagugaccgucuacccugcuacucuagggagagguagagggaguucuggaguucuaguuccagucagugaaugcacaggcccuggguccaucgaaugguagaaucuccagggaaaagacagacccgugagagagcacggaggacaguucaaucauggggagcaaaaggaggacacagaagcugaagcagcuagcgccuucugacccugcucagaugaaagcagaauucaaaggucguucaagauaguacagugauaacccaauggaaguucugggguuagaccacaaagagcccaggguacucuccugauggugcuaaguuucauggggguguaaaugccaagcacagcuacagaaagcuacuuaccccccuccacuccacggucccuggaucaguggcucugcucaaguauauuccccaggcccaagaaggguauaggggugucccaguauuagcagcaauuaggaauacaccuuguuuacagaaccauaggucagaaugaucugcaaaaucugggcaacacucauuuaaaaaauaaacgaaaaaaaagaaauagaaagaaagaaagaaagaaagaaagaaagaaagaaagaaagaaagaaagaaggagggagggagagugugugaguccaauguccaugggaauauggaguagugccauuagauggagguccaggaaaggguaaagauggccugaaucucuaucugugucauaucggagcuagggugucacaaauccaucucuaucuccuccacccuuauggucauuuguaaacaggggaaguaauacacaaaggcugcuaagugugaugucacuguauuuagcucuugacagagcugaggaagugauccacaaagcagaaccuggcauuucuucccgaauccacucaggggcucuaagauaccucugcccaaagcuuccuuucuccagguggcccugccaccugcuccugcagccuaaaagaccuucuguuuagaggugggggugggacgcacccagguggcauguccagguuccuggagcuccuucccuggcacaaaaggaugcauucaugacucuauacaggauuguguugcuuccuccuuc

SEQ ID NO: 27 - RNA, 37817 nt, Mus musculus
accugcuucucucugcggggccugguggcaucacauggucaccccugaggacuuggugucuccaccacagaguucccaguauccugccugaagcagucucuaaucaaucccaggacuguugggacaggguaccugaggagagcccaccagcauccugaguggcugggccucacuguggccauuucuacgguaaaaauguugcauaguuggucaaucuggaacaguaggggggggggauguuuccugcugauuuuggagacaagguuucauauagcccaggcuagucucaaacucacaugaccuugaauuccugauccuccugccucuaccucucaagugcugggaugacaaacaauugccaccaaacccuacgugguacuggggauugaacccagggcucccuacaugcccaaguacucuuaucaacugagccauauuuuucagaccaaacuucuuguaugugucuugcgcuauuggagguacacuugaauucuguucuggaguuacaaccaagaggagcuggugggacccagggcucaguggcaguggcucagacaacugcuuggcaucuggcuccacaacuggaagugagggcucuacaugauaagcauuguaggcuuccauuggccccaguacucuggccucuauaugacacuguuccugguuuucauuucuuucuuucuuuuuuuuuuuuuuuucuagcuggcuggaggcgugauccuagguguagcucugugguugcgucaugauccacagaccaccagccugcuguaccuggaacugggaaacaaaccggcacccaacaccuucuacgugggugaguaccaaggagacggguuccagucacagugcagaacagucagggagggcuuccaagaagaggcugaugguccaaaucuggugggugaggcguuagagcugggaguggccuaggccuaguaugagcuggguagggaggcugccuauaagaggagaaugaguuggcuguggugcugcuggugaccccacagaucugagacuagacuaggcagaaaggaagcaacgggguggggcaggggccuuguaggaccuugcuuauuuuaacaugggcauuucuagugaaccucccugggcaggguggggcaggaugccugggcuagcaacagcugaggcuccaggaguccugaguugggaagggcuggagacugggccgacagugaaugacucagacaccccaccccaccccacccccaccagcacacagcccagacuguuacaccugccuuauuuggcugccuguaggggcugaacacccucccuccuaaguaagaugauggcuguugugcugugugguccuaugcucugguccacuacacugugcugaaggagaaaacuuuccucuuuccucccuggaagagggaccugguguccugagaacugaagaaguauuuggagaugucuuuacccuuccaaagcuccuaccuucaucagggcucugauguggaucuuccuucuccuccuguggagccuagaagaggcuugggaggcaugcuugaggcugagugggggaccaggaggucugaaauauucucccuuucugcccaauugccucagagcagacagggcuuuugguuaccccauggcucgcucuguuuccuuccucccuauacucuguccacagccuuagcauggguaaaauggacagcaguggaguccaggcaauaugggcaggggcagaaccuggucuccuuugaggaaagccaugagggguagcaguuuucagguuugguuguuaguagggaagggcccacacuagcuaucccuccuucuaucugguaccuucagagaaggaggaugcccuccagcucauagaaacuggauuguggcaacugguaggcaucuucacaagggaaaucugggaaucagagacagacagggguagaacuggccggugggcccuccacaaggggaaggcugugcucccacucugcacagguauggcaggagaggcuggcuacccugcagagcccagauagggugguuaggaagcaagucucuauccuaauguucucauaauagucuauaccaggcuccaguuccagagcggcucagccaccugccugucugguuauggccuccuggguacuggggaaauagucuuagggacuggacccuguagcagguucuucuaccuauggguagaagcuacucuggcugccaugucccuggccaaucugaauuggcuuucuggagccccaugcugccccuguacugagucccucuaggagcagauguggcccugaaaaaggugucuuauuuagugcuuaggagaguucauucagagcuugcuaaacaucccagacaacaccacaggggcuucagaugagacaugugcuagacauaggagggugccuagggccuagaaaguccugggacagugccuguguguugggugcccuguauguauccuccuguugagacagagccuccuguugagacagagugagguugggguuuuagggccugacaacuggggugcucugccaguugggaggcaagggggaaaacaguuucuaggcagcccuggugggaggccuuccccggaccagacguguuuagugaggccaaaggauuuggccuauuuuuaagucuggcagcagguccaggccauggugccuucuccucuggucuggccaggcagggaacaaugggccugacuuugugcaaggaagcuuggacugcccuacaguguugccguggagacugggggauggacggcuucugccgagggaccaagagauggaacgcucaucaaagacacagugggcuuucccaggggcagaaggggguauugugggcacugaggcagggacauggcccaguugguaccucaugggcuacagugcuccccuguaaacugugacagacauugggugcucugcuuaagcuuccccuaccauucucuuagccauccacccacacacaggaucccguccuuagaguuaggugagccaaacaguuauacaccaguguuccugagaugaggugccuggaguugguuacugccauagcuuacccuugauuucacacucaccgaguauugggagucuugggcauuggcuccugacacccaagccacuuccccuaacugaaacggauaguccgucucagcccuuuacagugcgugcugaggguuccuguucucagaugcagguggugggagacuggcuccagagcagagcauaccugugaaauggagaccacccauguucucuggucacugaauugcugcuuuguccccugguggcaguggcagcuccuccagcagcacacggaggcauaaacggcgcacauugcuaaacucugccugcugugguugugaguuaggccuuccugugugauucaugcagccugcucacucaggucuucccuuccccaggcaucuacauucucauugcugugggagcugugaugauguuuguaggcuuccuggggugcuauggggccauccaggagucccagugucugcuggggacgguaaguagaaagggcugaagggcuggggagcaggguuccuagcaacuuauaugucuuccccaagguuuugguuuuccuaggggcuugauuuccauugaaucugaguaugaauauacauguuggaaaaggggguuucuguuuaaaaaagcauaaacuccagaagggugucucaccccuaaagccaaccuuagugcuccuggccacacuagcugcuggugaagcugaaucccagauuugccagaaucuggccagccugggagggaggcgcugccaguaucagaagcuggggaaaggcagcacacgucauagaauguaggauaaaggaggugaggaaacugagguuaggguuggggagugucuugcugcaugugccucagugaaggcuguggacacuuugucaacugcauuucuacaccagccacauccugcaaaguaggaugcaaggugaggcuaugagaacuugaacaucucagugcaggacuguaucaggcucuugucucucaauggcucuguguggcucaugcuuaaucaggacaugguugguggauauggccaacccccuuggcacauagcuguuggucaugugggcuaggccugggcuugcuggucaaggcucugaccucuucuuuccccuaguucuucaccugccuugugauccuguuugccugugagguggcugcaggcaucuggggcuucguaaacaaagaccagguaagccuagguucaccgagugggagauaugcccucugcccuccaacagauguggguugcucugagcccauaguuauagggugcuuuuugaauuucuuggaccugcugcuugggugggggcagggucuugggagcucaguggaagagguggcaucaggcugagcccaucgggaaguugagugcucuugggcguagccccgacacuguaugugacuaugauucucccccagaucgccaaggaugugaagcaguucuaugaccaggcccuucagcaagcugugauggaugaugaugccaacaaugccaaggcuguggugaagacuuuccaugagacgguauagcuaggcucaagcaggaggggaggcugugggguuccuagugugugagggcaugggucuccuuucuuuccaacacaacagggccuaggaaagggucuccucuaugauuuguggguccucagguaggaaucuaaugggccucauuuucccagggguuugaaggaacagggcuccugugcagggugacaaacagggcagaaggacaacucccaaguguauuuuggggugacggugugcugugugccugaucuuucccuugucuccugaagcuccaaagcugacaguguuguucuuggucccugcagcucaacuguuguggcuccaacgcacugaccacacugacuaccaccauacugaggaacagccugugucccucaggcggcaacauacucacccccuuacugcagguagcauggaguggggaugaggugguggugguggucgguagggugguguggccaaucaggaagaucagcacuuugagcaagaccucagaagucccauagaccaucucuauuacugggguaccggguccucacagcuugaguuaaccccugcaacaucccagaaaacuguucucuugaguggucccucauacccuggugacccuagggugcuagugagguaaaaaaacacuccccugugacaaaaggcugcaggcagcagguccgugugucuuaaauuuguuuugggguggaagauaagcugugauacauagguccugucacugaguagggugguggcugugacuuagccacugaugguuaaccacgcucuugccaucccugcagcaagauugucaucagaaaaucgaugagcucuucucugggaagcuguaccucauuggaauugcagccauugugguagcugucauuaugguaagcacagggucucuggugggugggugggauccuucccagggccuuaggugcugacuaugccccucccuccugcagaucuuugagaugauucugagcauggugcugugcuguggcauccggaacagcuccguguacugaggcccuuugcauugcaccagaggaucccuggagugaccagaggccaccuugggggacauggccuguguauauaauauuucuguaucacucugcuacacuuagucuuuuuacuuuugaguuuuuuguuuuguuuuguuuuguuuuuguuuuaguuuuuuuuuuuguccugaacuuuuccuguuaccuuuugggagcugacaucacacauggguggcauaugugggauguagggguggagcuggcccuggcuugcagggcccuguacgucugggaccccuggagaguucugccugcugagccaaaccuccucuacagcuacuugcccagaggcuuuguagccuagcuagagggccaugcccacccacucaacccacugugggucacauugcucacaucuuuuuaaucuuuguuccuuuccugccuccauuucaagagcuggguuuguaagcccucuuaugccuucaaugcacuuauucuuucuaacgugucaccuucaacuguaauuaaaucuugaaacagucauuuaauaaaggaggaaaaaaaucaggcaugcuaaugggacugccagaccucuuccugugcuagcggugucagagaccuggcucaucagcucugaacuuugccaggcacagggugagcagguccaauagaggcuguggaacacaguggguggggagggcugggacccugggagcacuccauauggguccucccucauuuguaccuccuuauacugggagcucaaugcugacuuuacgccagccuugaccucauuuccacucaucuguuggacaugacaggucaggcugagucggguaggaggagccaccuaagcagggaaauucagcacagaaugauggagauaagcugcaagaacacccuccuuuucagggacaagacaguaaagguuagcccauuaccccauccaucucaagaaaagauuccacggagcuggguggcucuggcuugugucucaauaaguaaaaggcaagauggcaguucacuuaccccugugaacugaggaucaggcuaagcaaccucccggacgccaggggcaaccaccacugucucuuucccuuugucuccugucugcgccccucccccaggcugcuggcauaguuaauuggccacuagaggagagacgcccuagccaagauucauggcccagcuucuagcagccucccaguaggcuuauuugucggugaaccccaagcuuguacuaggacauucuaggucuccgccaccucuaccucccacgccuaugcaaccuguuccgugcuugguugguuucuggucugaggagcccuuuauauccuauguuaugagguccaugggcaccaggccaaagcuguuggaggccugcugcacagcuucagaaacauaggaaaggagaggcgcaugcagcagccccauggugucucagacucugaucccuaaggauacaagaaaacagccccacgccuggaggaggauuauguguggccuugacuaguaggggcggcguccugcaacuaaaguguccguuccugcgucaggaagcacagacaggcagagcccaggauagcggcuucgaaucucugaagccccaaccaacccaccccagggaccacuacgucucuucaugccaagagccaaccaggaccuuggccccgccucacuccagaaagccaacaaagcacaagacccacaccacuuccgcccagggccggaaaugucuaggaaacugguuggcgcucacagugcguggugacgcacuuccuccuugugucggacccggccgggacggcuuccgacaggcgaagcugcaggccucaacccuuugcgauuggcaguuagcccuggaguauugugggaaccguggcuccgccuuuuccuuuuucgucauuucuggguggguuuccgugugcgcuccggguuggcacgcuuguuaagguuacaagucccggcugacauuaggcgggaacccauugccuucugggaguuguaguuucucgggcgcugaagccacgaaaaucugaucgcccgagacucgguuucccaggaacccgagcgagacuggacaggaccgaaucccggggaacuggcgggacgcugcgagaaaggcggcaggguauugaggcguguacggacgcuggaacggugagcacuggccucccuaaggccgcggccagggcauucccgugccuguuucugccagcccuucguccggacccggguggcgcuuguaccuagagaggcugcgcuuuacugagagcccgugaugggacaagcagcugauggagaucuccugucaccagcaucucccagugcucaucuauuguauguccacacuguuaugaucucaugguugacucucuccuuaaccccaccuaaccugcagcuccuguaucugugcgcgcuaggauacccuuuaaccacccagcuucgcgaggccucccguccggcugugaguagaggcacuugacacauaguggaggugaaagacgggagccugggaggacggggagggaugaggccuuaaauacaccccucacggcggaacugggacugcuucgcuacaggugggacgggugucaggucguauggcggagacagaggcuggccuggaggcugaugaacccaccgaggaugacacccugccuucugacaccgucucccucagcgacucggacucggaccuuagcuuaccuagugguguggagguccaaguguuguccccagagaggcuuucggaggagggccaggaggacuccggcccugaggacccuccaucgccccccacgggcacccucaccacugcagugcagccauuccaccuccgaggcaugaguucuaccuucucccagcgcagccacagcaucuuugauugucuggagagugcagcccggcaggcaccgugcucugcuccccaaaccagugugagugacaauggcagcuucaggcggcccgugacucccccaagucagacuccagcaaggggccugagcagagugcaugggaacacuggcccgacuaggguacucccagucccugacuaugugucacacccugagcguuggaccaaauacagucuggaggaugugucugaagccagugagcagagcaaucgugaugcugcccuggccuuccugagcucucgaagccaggugucccacacagacuaugugccuucuuucaaccaggaccccucuagcuguggggagggaagaguggucuucaccaaaccagugagggacagugaggcuagggcugagaggaagaggguccuaaagaaggggguugggucaggugcggggggugaggccgcuguggagcuagcccaucucgcuggaccugaggcugaggaauggaguggccaccagggacagccagagguggugguaccuucagaagcugcccauccugaguccucaucaggccccauaggugugaaggcuguugguuuccauggcagcaagaagcggagcagagaccacuuccggaacagggacgguaacccuggggggccggggucugagagaggacccucaguuugacugcagugcuaucacucuaccccucaccugcuaguccaagugggaaggugugggcugucugugguagggggaugugugcagccgcucuggcagagacugugggaauugugggucaggggaccucgaaggccuuugugccccaguguuuaggaugaauaauaaacguuuggaauauuucuugaauuguguggcuuuuuccgggccccacucaaagaguucuguccaaacaguccugggcagccaacuacaggacugcaucucuggcagccucaccuugccuuccccacuccagugaggacugccgugaagguuugccauggucauuuacauuugucacugaugaaacuacccagagggacugggcucuuagcuguguucagccuugugccccugaugguagugaaugagcauaaucugcacaacccacccccacccccacccccagaaaccaaugcagccccagcacugggccuguacagaccacagguuauaggaagaggaugaguugugaagcagcauaugguuggugucuggcugugucuccaggacuuguguguguaagacacagcugaugcugggucauuccacugaagcugagccagagaagaagagaaggaugcagggaggaugcaugagcgaauguuuccuguggaggccagggacuuggaccaaguuagcuagaccugcuaagacccaggucugccccagccucuguaguccccauucucugaguuccucuaaaaaggaccuggauggucauuuaauuugaggagcaguggaaggaacggagaugccuuucacuaggucagacaauccuccauauuccccggguguuugaaaugucccguuuagccaccauuguggcccaguuuagcugauuugagguggucuacaggcuuuauagaaaguaaaguagcauuggguacccuugagcaauaucuugggguuucugccagaaugaucagacagauaaugcuguggggggugaaagaugggagguaauuacaauagaucugaguccugcccucuaggagcuggucagcuaaugagugggucaggggucagaaagaaaccuaguguuuaagagguuggcuucuuaggaacucaggguaagacagggguuagaccuaaauagccccauccaggcagaugguguccuauguaggacuuggccagauccagcuguccaguccaagccagugaaagcuuuagugggacaugaaaaaucuugcccugcuggagaggauacuucugaggcucccgaauagaugccaaagacaugaguuucauucucuuaggaagggauguccaagaagugaucuguagcaaggccuugaagaccauuucuuggggcugcugggagugggggaagguugaugugccccaaaaacucgauguggccaggucuggggcucuagagcaagugguuucuccauuucaggugucagaggguggcaagccagacucuagguacucccugucucuagcagaggcuggcugacuccugcaaccacaguucugagagccugggagcaagaaagggagaaaggacccucagcuggagagccucagcuggggcagggcaggagugaggcaagggccaggacauggaaaguggcaaggcuagcaaggccagugcuaggcagagccuugggacacuaaggaacaguggccugccgaggguaaccgaccucuagcacagguggagaaggcaggaccuaauacaauacacagcccgcagcuuugcucuugcccuaaucuaguggcugaagggaggagcccauacccaucucauucccauggccugaacccauacuuacuugaguaggugccuccuggagccaguguauccgucauagaggacaagaggagcauacaguaguuggccuggagagagccaagggagguacugagacuucgguggggacuggggggaccggguugguuuccucccaugugauugcccuccugccagggcuacugcugcccugggacuccacacucuggaccagguccucccauagugcaugauaagggauagugaccggauguggugcugaaccuagguuuuguuggaccagcucuagaacaacaaugagucucgaaagugaguuggggcaggggcaggccacucuauccaggcccuaaugcuacccaccaggaugcugguacagggcugugguaguucccauggaaccagaaggaugcccccaccccaggaagaaagauggauagugaguugcuagcuugccugugauuccagacacuugauccucuuuucuugcucucucagccccccgauguauuuggcaaucaaguccacucuguagaaagcagggucagccucaguugugacacuuccaugucacuccacaagggggagcuuuuuguccuaacugcuuucucagggccucaguuaacuguuggccucuugcuuuacugcccuuccagucuuuaucuggggccugucuauggauauggagcacugcuguacccucaaagagauugagauccccucccugcuuggaauaggccaccaagcaauaggaugaacacuaggucaucccuauaagcauucaagaacagccccuccaccaucuagcaccaacugggcguggaucuucagaccugagagaggaggaaaagagucccauuggagagagaugccuaauuauggacuuaugcucucaacccacacauauacacacacuccuagggcaagagggcugggucuugugacccagccauguuuccccagcucagagguccuguuauuggcacuagauggucucacccagccuuaaggugguucagaaaaccccaccuauuacugaaaaggcuagauauccccccauuuccacauguucacaauggggagccccuccuagacuuacugccccucauaacacccagcugaucaaggucagcccagcccugcugcaucugaguuuaccucccuccugucagagcccuuucuacaucucugggcagcucaugaacaggaaugacaccugccagccugagccucauaugccugcugucccacaggcugccccaccugugugccguuuuccucagcaccucccccucgcugucccuccuccguuucuccaugguacucaggaaguucuccuuuugaaccguuucccagguaaugaucuucugguccaaggggucaggcaagucucucucuggcaaugugggagacagcagcaagcuuuggagagugguguggaccucuagggaaagucuaggcccaggcugaugcaagggagacugagggcagaugccaccaggcagggcacaagguagaugacagaaauaagcccuaugcagggauuucaggcugcaaggagacaggcuggccuuguggcugucuagucucaagucuaccuggagcuuugguuaaccuggacagggccuagacaaggaaccccagucccuucuauggucuccucugucaauugggacccuccccucgggagcaguggcauccagccuggggccucacccagauguugucgcuuaugcugggcuuccuuccugaagaccugcuugagcaccaggcucagguggcugagcaggaugaagggcggggccagagcuggucuuccaugguauucaacgaugaggugguagcguugaaacuuccagaacaugucugcauugccuugcaccaccuggaauguguagcuacaggacacauagccaagcccuugccuuauaagcugcucuaccugccaugaaagcacccuaccucaacccagcaucuaccuuccaccccacacacaacgccccuguaucccauuucccaucuuucaucucaccccuccaccucccacuccuuauaugucaucccccauugcauccaguugguagcuuggcugugcugggagcccuuucagaaagauagaggcuaauaguuagcuuuaacucucaacuugacacagccuagagucaccugagaagggaaccacaauagagggacugucaagaucauagugaccugugggcgugucucugggggauuaguccacuaugggcugcaccauucccugugcaagaggucuugaguuguguaagaagucuagguaaacaugagccugaggaguuagcaaacagcacuccucugugguuccugccuugagcuccugcccugacuucccucaguggcagacugugauccaggaguauaagaugaaauaagccuuuucuuguccuacauuguuuucaauuaguuuuaucagagccacagaaaggaggcuuggaugggggucuggcaccccucaaacacauucucagguauacugcaguggagcuuccucagugggguauuuacacagcucugaguccccaacccuguagacccaucuuccuuccuaacaggauaaacagcaggggugugcucacaguguguccauaccuguaguguuggcucucuacugcagguccagcccacuggacacagcagcaaaauaccaggacauggguccugucucugucagcacccugaaaccagcccuacuaagauggagcauggauuggcgagggcagaugggcagaaguggaagcaggaggguaccugaacauggcgaucagaagguucaugagcagcacauuagugacaagcaggaagguaaccagcaggagaaugaccagccaguuggcauagagauuagggcaggaagccgagcuuuccagcagcagagggugaagagaacaguucacacgagccucuguaaggcaaacagacaccuucagacugggagugugguuccaagcugaggccgacaggcugugggugccagguagguggccaggggccugguuaacauggggcuagcuaguuuaagcaccaaaaguaccagcccuaguuacaccaagccaacaaguucaucuucugccuccucugcugggauuccauggaggcaagcccaguccaugugaggaagugagaacaagagccauagagcccuuuagaucuccuguccaugccuuucucaccuagugcucucagaugggaugcaaaccugcagcuuucuggguaccucugcccauaaugggaguacccagaucccugggcaucccccaaggacucugagucacaaugcuagccccuuauaaaugucauccccuuuauuucugcuucuccccugccugcagggcuuuacccugccaagccugcagggaagcauaggcugagauugcuaucccuccuccuggcuccauccccugucuucuccaggcuguaugcuggcacauaacugucuguauaaguaggugugggcauauaugcauguaugcaugcagcuguaccaccuguacacuucagugaguuauuauugauucuguucuuccggcucucagaauuaugggugaugcucuaggcgaggcugccuugagguacaauuuugggauauuugacuuucaagucuaguauauguacuggcauucuucugaccugccuuguuucucaaaucccugccuuguuuacccagugaguuauuaugaccagucaacccaugugagauguagaguguucuaucauauggagggaugcaaucagucaucugggagugccagauccugccuugcccccuccaaggcugcuuuagcagucacuccauuccccacccuaugaaucugcuccagguucuguuucuccagcucucuucccuucucuaggugccccagaggguggccaagccccuuagaagcaaggaggccuugaaaaagcauaaauccugccugaggccugagaaggccugccugaccugguugaacacaaguuuggcccugaagcccagagccuggugggaaaagggggaagugcgugaaauguggaggagaggugaggacuacccugcagacugggccagaacuacccaggccucaguuucccucugaguacacuguagcuaucuuaagacacaccagaagagggcaucggaucccacuacagaugguugugagccacaaaugguuauguaguugcugggaauugaacucaggaccucuggaagagcaguuagugcucuuaaccacugagccaucucuccagucccaguuucccucugagcacaggcauguuagagaauaccagcccacucccagcauaguagacacaguguagggacuggcaaugcuauuucacugcucacucugccugccacaucuauagugguucugcugacccugcaguggccuccauaccuagacuaaggaccacccugcuacccuucuaaacugccagguggccugagcuuguuccccaauuccuguggagaagaaaccagaauuauaguuacuauggaacucagaccccagagcugcccuggcugggguacucaccuuccucuuccuggccccagggacugaggccaugaggccauauggcucaggggaagggagaagcgggcaaugucuguuuaagcuaauggccuagaaaagugauggcucaguugagcaaacaccaaaagcaaugugguggggagaagaaaacagcccaggguauggcuugggagcaccccaauuagaaguuaauuuccagcccgucugucccuggaggccugggcuugcuccaaucucacugucaucuguugacaaauauucauccaguguuguaauugcugaccuggccucauuacuggccucccccagaauggcuggggucaggucucuauugaccauccaagcuguauaacacuaagucccuugacacuagccagaauacugacaccucccccagugccugaaucugcauccuaucucuaagccuacacauauggacauauggagccucuguucugaucccccacucucuaggccucuuuccggccuaaugagcugaaucucuauguuugcccaaucuuagccaccuuaggucugccuggguccccacucugucuccaggguuuuucuuccuccacuacccacaagaccccugcaguaaguacagagcuguguccacuugucaugaagucccuagaaucuccaucagcccuaacuagguuuagggccuagcuugaggggacacucaugucuacagacaagccucauaccacugacaucaacaggcaacacacacaaguugaagcccauugcaucacuugacuucccuaagaagaaagccaggccugcauauucaggaucuccauggccuacuucccagccagagaaugguugagggcuccacggcuggcugugucuuacccuacucuggaccucagccuaggagguaugcaaggccuguggccuagacuuagggugcuguugugucagccauuuucagccagggaccuggugacccagaagucccaguggagcacauauucuagagcccacccgcccaucagcccacccuuccuggcucagcacaaaccaucaauuucauccagagggauuugcccaaagaucugcagguaaggccuguauagcacacggcggaaaauccacuccaaacggccaucauggggaugcagcagggccugaguggucacaccauaggccacaagccauacgcucaggaagaagaggaaaaagaagacauccuucaucugcagagggagggucacagggcauggccuaggugggaacuugcccucaagggucacagaagggcucacucuaccccaggguggaguucagagaguuuacccucacuuaggguuggaguucuaggguuuuuaccucaaccuaggguuagggucccaggggagucauccccucccaggccugagguguuagggucuucaccauuaccuugguugggguuuuaguacuuaccccuauccagggucggaggucccaggauucucacugcuacccgggguugagacaccacggggcucaccaccacccaaggucaagguccaauagggcucaccccuaacccagguuaggguucuggggagcucaucucacccagggcuagggucccaugggcuaccaccuauccaaagcuggauacuccucauccccaucuagagucaaagcucagugcccuucccaucuaugagucaguuuuccuuuggacucugcagcuauccagagcugggaucccaaagggcucacccccccccacaacaggauuagggucaccauccacugaauaaucuagguuccccaucuauccagggugggguucccgguaccucagcccccucaagggucagggucccaaggacccaccauucgcucuacaaugaugaucuuaggacccaacugcuugugaauagcaaagauguggaugagccgaagugugaacaccaugaagucaauggccagaacgguccugccagccucaaacaccgagggcaccauucuggagagggacggaggcuggguaaggcugcuggugcccauguaggacaggagguuucccccaagacacaaaguaugcuagucagcuggccaaaaaccagguuccaggaccacacuuggguuucagagggauaaguaggaccccuagagccugcccacauaccuacaggugacucccacaaugaacaggaagauggccaccaugucacacuuguuccaguugucuuccacauacagagugaauuucuucaccaggugcguguccucaucugugaagaagcccuggcagagggagaaagccugguugcagcaccgugucuuucuugcugagaccaggguggaaucugcaugaaucagaacucaguuuccaaguuuaucagaaucaauugaugacuagcacucucuguauggcuaggaauggagauaucaacugaagauauuucagggauaagucuggggacaaaaaaaaugaggucaauccaaacuuagggucaggacugucugugacuaaaacucagagucuggacuuagucagugacucaggucaggguucagacucugacuaggguaucagaaucaagaucaaucuggagcagagaucagaggucaagauggugcugaaaucagcucagguuggcucuaggauugugacuaggaucaggacuuagucugauuaagauuggggcuuggucuggaucugggauuggggcucacucugugaccaggaccaggacucaguagaguggguugacagaaaggccacacaguggucuuguucuaauggauuaaaaaguccuaccucccccggaacaggucccaccugaggcacauagaacacagccugaguugcagagcccaggagaaggccaugccggccacugaccugucggauuuccuccagcaccagugugaacacccagaaauagaggguaaccucggauccagacggccccuggggugguggccugaaguccaccagcaggacauaggugaacaggaagaggaaugcgaaguacaugaccacauuccccaggaacacagucacaggagcgccccagaacuuccuccaccgugugagcaggaaggcagcuugugggccuagaucgccuggagcccuuggugccucuguuagcuucuccaaucugugugagugcagaggucaccauggugaggagauaccaaaccaugguacuccaugggagccugacucugucuaccgugugucuaggagcuggccacugccuagugguagcccugacucucuccauccaucccagcauucuccauucuuccuaaccgucacccuccccuaccuucuuagcccugcgcuaucccuucuagcucagucuccuccauuuugucugugcucuaucuuuccaggcccacucuaucuuucuguuuucuaguuccuucccuccuucccuauuucuugcauccuuccugccccccuuuauccccuucaccccccccagcuacuccuuacuggccaccccggcugcauaggaagcucuuuuccauauccaagcugucuggcuccugcagaucuucuagguccauccucugcggggcauccucacugcaacacagagaagaauaucccaagcacguagacggaagaaaguccaacaugggggagagggggcucacauagccaaucaaucagacauaaggccgugagacaugagaacaucgagacugguaccugcugccgccuguguccaccuaccugaaggagaugagguuuguguagaugagggcugggcaggugaaggcacccagaagccguaggaugggugugccuguggccaugucuccccaccagaucuuggucaggaaugccuggaauaaagucauauguuguggcugccugucaccacacuuuaucucauguagggaugugugccugagauacccuucccagacccuucucaagcccccuccuggagcacccgcucuggcagaagcauccucuuuauaggagaaugugguugauugucuugcagccugccugcuuuucuucuuuuuucuuugaggaagucuccuguaacccagaaaaacuaucacuaucaacuucauacccaaagauggccuggaacuccugagccuucuguuucuaccaccauagugauaagauugcuggcaugugccacuacaccugccuuauagagugcuggguauugaacccaggucuucaagcaugcuggacacaccauuaaaugagccacacccccagcccuguuguaaccuuucaauaacaggauuauggauuggaguuacagccaaccaaacugagaccagguguugcugggcccaagaaccaagcuaggaaaguauucuugauggaggaagcugaaauucagccacucuucuggucccuccccuguguagcugcaacaugggcuaagagcuucaggcugggacauucauggagugaccucaguauccuauguggguagccugggcccugccaacccucuuugccccuggccauucuuaggcuggucaacuacuuacuugcacaccgucaugggcaaagaaggccuuggcaucagcuucaguggccaggugcaggcacgugguccugcuccagcugugguuccuucgcaccagcagggcaaaggcacgguccucacuguugccguagcacucugagaaaagaucuguaaacaaaaucagcugcugggauggagugcugauguccagucccuggaaccccucucccccuacugccccccuccccccgugccaucugcaguguaugcccugaaucaacuuccuaggguuuagccaggccucccaugcuacaaggccacugagagucccacugaccuuagagcccuucccaaccuuugaccucuggcccuuccccuucucccuugggauugugagggacucuaccucccggucaggacuuccugaacaauuuccaucccaggaggaagugcucuguguucuguucugcacaggaggccauggggguuacccugggccacgugguuaucagagauaucugcaggggaccagaggcagacgcccucugccugugacucacccagggccagcugcucauacuuggccucacgcauggugcgggccaccucugccucuuucuccaggugggacauuuccuuuaugaucuugcaggcagccagagcagcagccacacccucccggcccuggaagauggagagacaggguuuuaggagguggccggaccaucccgacauuccccagucugccucuugagaugcucaaggaagccguggacugagguggcugcucaccauggcccagaaguauguggccaucucauaacgauucugcagcacagcccagaggaacaggucccuccaagggucuucacucuuccuacugaggucuggcagccacuucuggccugcgggccgcuuagguggcccucucuccugcagaacagggcaucaacauucagccuauccaguacgcccuggccuaaccuggcucuacucaccuccauccugcgcccguccugguagaagccacggcaggcgucaugcaggaagucuuugaguacgcgggagaccucguggagugagaaggcaggcagaccaaugggcagcucccgagccugcugggcacccaggccggccagugucagccuacccuccucaugcuuacgcugcagcaguucaaagaggaggcucuugggggacacagaaugguaaagcugcugcagccgcccauaggucaagaacucggccaugucagcaccgcuguccacaaagaggcggacaaagucaggcuuguugcucacgagggcaucugucaucaccucuuccaagucacaggacuggauucacccaguagagaagaucaggacaauaagagggaggaagagagggugaacauccuccccuggacacccccaacauauucccugaagcuggggcaggcaugggucagcagagcaugcuggccucaggugccagggauaagaaagguuuggugaguuaacauuaggaguguuaggauucccucugccccauuugggacuuugaguguucccuaguaucaucuugacccccuccagggcaauaucugagacaggauggacccagaugcuacccaugaaauccuacuacuucaggcuucaguguauucccugccugguguucccaaguugggccaggggagcggggagagcaccuuccauuccacguccccauugaagauuucacucuuggcaauguccacgcgaucccaggccacugcuaacuugagcucaucuagguagucuugggcuucuuggcuguggcucuugcaggcugugggugggggugagucccacagagcuggaggggagggacuagaacucugcgaggacuugauggggguuggcagcugccucuaaacagcagcaagugacauaggacugagugcucaggggcaacaccccagaauccccuggacauagucuggagaggcagaaacaugcucucgggaauauagcaauuuggccagcaucuucuugcccaagagcaggacaaggcuguacauucucauacaagcacacuucuuccaugggaaugccugacacuuucacuggagaccacaguuaccaacaagccccagagugaagaccagcaggcuuuugccuccaugggagugugacucacugaaaaccacaugugguccuguaucucuuccugggccucacuaucucaggcaggggaaugaccaaauccagagcugccccuuuauagucugggcugacugugagauuacuauguagccgauuugcuugagcagccaauccuccugucuaacagguagaagcuaugacaucugguuuauguggcauugacauugaacccagggcuuuguauauggcacacaaacauuuuaccaaaugagccacauccgcagcccccgaugccccaggcucucuuagaguggccccuuccucagguauguccccaucccuuccccagcauggucucucccagauuccagccugugcacacgugcuccaggucugcccugccacauggacaagccugggugacaauccaacauauccaccaguggaugaauguacagaccuauggaacaucuacacaguagacaucagaacucagccauaaaaagggaggacuuccgggcacagacuuccaaggggaugggucugugggcagagugcuucaagaaggaagcuggguacaaauaacauggacuguaauuccauuuauguaaacuggcccuaaagcccacauucuuagacagaaaacaggggacuauuaccugaggacaaggugaaguuauugcuaaggcaauuggaugugugugggguggggugggggugggguuaauagaaaauuuccagaacuggggaugguuacaaugcccugaggcuagauuauaagcuacugaacugaacacuucaugaauuuguaagucaucucuccuaccugggaagggcugacagguauccccugugaacacugcuaagucugcagccucugagggcaggucuacuuggcucaccuuucacaagugccuugaggaugacaguguccagguccuccgaacccuccugcucgaagucauauacugugagcaggugggggugugcagcaauguucuguaacuaagaccaggaagaagccuugagaucugaauauguccuggaagaguccucagauggaccacuuugccccugcugacccacaaaccuagcucagaacugccuaccaggcuaguugucuggucucucugcuacacaaggaccuggauaauucugagguauauaggaagagaggucauaggcuaggcccacaggacuuucagaaagagcauccccacccaggggaggcugggaggacagaggcagccccagcagcacauaccagcucuguccaguguacaauggcuucccaagagaaacacucgcuggggaauuucucucugaacugcuucucagccaccuggggcaccaggagaugaggcuggcucaccagggcagcgaguacaucagcaaugccaccagaaccugccaggaucagccauggggcagccugcuccacugcccuggaaauccucugggggaggcaaagaaggugacacccagaugaaugcuuaggaggugccuuagcccuccacaccacccuguagaugcccugagaaacuaccauauccuucagggcuccagccaggggagggggaguucuuuucuuucugcccuuaccucuaggguguuggggucaccauugaccaacaggcaaaggacagguaucuggaugcagcuggugccugugggcagagcagccaugaggccauuugaugcucagaaugugagaacucaggaccaucuccaacuccaacuucaggcauccuugggugccauguuucugcacgcccuggccuggccuggcaaaagcuuuuuuuuccccuaaucuagucuuuaaaaacaaauuuuauuuauuuauuuauuuauuuaauguauaugaguacacuguagcugucuucagacacaccagaagagggcaucagauccuguuacagaugguugugagccaccaugugguugcugggaauugaacucaggaccucuagaagagcagucagugcucuuaaccgcugagccaucuccccugccccaagucuagucuuaauuuugaaauauaguuuagggugauccccugcuugcaucucuagagugcuagaguuacaggcaugugccacagagccugguuuauucugugcuggggauuaaucccagagcauugugcacaaaaggcaagcacucuacuaacugagcuacauccccagcccacaguggcuuuucccccccaagggugaacccaaacccaaauaguguaucaaaucccugagcugugggcccacaccuuacaucugcacuguccagagcuggcauuaaacacaaaguaacuuaagagaaaagaagccuaguuguaccugccacagcccaaaagcagauacacuguggcuagguagucacucuauaagcauaggacagaguugcucugcauuguaagagacacaccaggccaacaaacggucaaaagcuggugggaucagacccaaucugcagugguucuauugagaccuuugugguaucaaacacagaucuguuuccacuguuaaagugcacuggcuuuaccaaaaauuucuaagcaaugacauuguagcuuauaaauauuuuuuugucccuuaauauuguccuaguaucucucuuucacacccaccauuagccacagauauacccauucccucaggcaauucugcucccugguggcaguaaaggggacugcaccucugggaagacuauuggcuaucagagucugcagccagagcagcaccauuuaaaacaguggcaacugcccugucgucugcccaggagguagcugcugccuagccaaggucacacugcccagcugugucacucuuccaucccacaccaacagcucuucuucccuggccuuguacacucaggcaugcaggacccucccccacuuccuggaaggccuuuucccgcucucucuauaaaguucuuacuggugugugccacaucuccaugucuacauccccaagaugcuguagaugggcagcuagagcaagccuuacccccauaaccuguccucugcugagagaugugcuucuccaggcucagcugcagcucugucagcccgucguucccacucccaagggcgccugacuccacaaggaugaagugggagagauugcuguccagggggcagaggggucccugaauguugcccucaucugcuggguaguggaugggaguauccuccugugccaaggagagagggggaggcagagaccucaggagcagcuugggcugggccuugcugugcugugcacgccaugcuggggcccugggagaggcuucagcaaggccucagaguucccaccccucaggcagagggaggcuggaccgcugggccagggggccucccuggaaugagugaaccauggaaacagcuggggccagggcuuugcaagcuccaccuuccagacucuucugggcugggguccagacuucaccucaguggggccuccugggcuucucauugguucugccuuacacagaccacagggugggggggguguguaugaauaccagagagccaaagccaccuggccagggcuuucugggacuugaggacagccguccagccaggcugggccuagagcguuauaggucuggcuuuccauagggaguacagcagguugccacucuuauuccugagagaugcugccaccuggugggaaguuuugggcccauggaacccacaucuucccacugcagcccauccucccaccucucaccucucaauaguuucagggccucucggaguggcacaauucuucggccugccuauggcuuccucuacccacccaagcucacuaaacccuaucagcugugguccugugaaccugucacuaaccuuuugguggacaccaucuagaaguugacggugaaggauucgauccagagaggccauuccgauggccacuacacggaucuugguggaugugcuagccagagagugaucacguacagcuuguccaacauggcgggccaggcccacguggagggcacuggucaggauccaggcaccuaugggagggggagagaaggguccuggaguccucacagcuggcugaccagggaaucaaguaguggaaaauacuuuuuuuuucuuuccuccagacagguuucuacaaugcaggcuauucgucaacuuaagucauuccauguguuccgugaacuggaaauacaguauguaccaccgugcccagcuacagggaacacuuucagacugacgggaauaguaaggcucaggggggauauauguguggcagacagugaccuuuuccaagauuuauccuagaugcuguccugcagcuuguucugggcaaggaucuaaaugacaaaggucucaucugcauccaacuguaaacuauuccuuuauuauaaccacuucugcaaugagagagacucagaacuucugacccccuuguggguguauguucaugugugcagcacaccugugucaggggacggguguauguggaggccagaggugccauucaccuugucucuguaagaugguuucugaugaaccugaagcuuacugguugggcaacucuggaaggccacugucauaugcuacagggacuugccuguuuuccccuagcacugggacuacaagcacaugccuccauguccaacuuccugugugggugcugggaacugggacucuugucuuuagccauugaguuaucucacuauguugguuaguuuuaauuucuuuguaaaauuauuuaaguguaugucaguauaugcaugggugaagcugccugaggagaucagagguguugagucucccuggagcaggaguuacaagcagcuuccagcugccuggcgugggugcugagaacagaccugcagaucccugcaagggcagcacaugcuugcuuuugagcaucucucugaugcuuaguuccaucaacuugaaacaacccagaaucaccugggaagggaaucuuagccucgaucagaugagccagugggugugucugugauggauugucuuggucguaaagugaugugggaagaccucacccacugagggcagggggagccagccuuaccugugcucugagcugcuuucaccagccccuugcgcaggacaucccgaagccacgacuucauagccaaaggucguuccucacccaccagggacaccaccagguugggggcuggcaggugccacucggugagcaggaguucaaaaagcacggagggggccacacugcuuggcaccuucacaaacugcaggguaaggggcugguggguuccaggugguagacagcacuggguugugggacucugaucaugggggaggaggcugggcuuauggaacagggcaggccacaggaggcaggcuuuagacauucccuccuuggggcaaggcuucugugugguauagucauugcaauauauccucccccugugaguggagagugaggcaggaguccugaaccucaagguucucauuaucaccagggcaggaagcaacucucgacuuuuguccaucuggucagggucucugcacucagcucauaaggaacggacacagagugagcaggccccaggacugggcuuuaaggacgaaguaagacuuggggauuccaggcaugguggacuucacucaggcauguauugccccuaccuugccucgcuucuucccagacccuccgaaguugaucucuccccugcauaggaugggcucccagccauccucaguaucuggggggcugccggggcaggagcucuggguuguuugcaugguggcuuuccugugaaacauauauaugauggaacccacaggauggacuagccacccucuucuccucuucauaaggaagaccugucccaucuggcaugugaggcagcugcccaucuccuggccccaccugagcucgaccucccucucaguagcuauaacuaaagucaggcuccuucuccacugggugugggggcacagcaaacccaccugccugucucuguuucccacacuuaaccaaacuccgggcaucuggauucuaacacacucaucaccguucucagaggcuuuugcaggggguuccuggaaaccuccaaagacaguagggaauucauuuccccaacccaugggagcuauacccuagacugcuccagacaaagucccaggguuuuuugccuggguaguuaggugagaaggcaguugaucuaguucagaggacagagugcaggagaggagggaccugguagaacuggaaguccaggguaggaaagguuaggaaggggaagcaggaacagaaggcaagaagaaaguccaggaagggaaguccacugggggugcaggugaagagggcagggggaagaacagguggaagcagggagagaaagaccccaccaggcucuucccuccacauucccaccgugguaaauagaggaugaagaggcugccugcagcaucccucacccuggcugagcucagguccucucccacccacccaggcaggcuaggccccucagcccuacccuucacuucagggaccugugugguaugcagcuggguucccuaaccccuguguuucuuugaugaaugucaaaaccccuuccuauucauugugguccuacuucaccaugccuuggauccuaaaguagguguccagccagggaggaagaacauacugaaggcccucccuuggcuccacuguagguagagaccugacaugacaugggagagcacuuuauauaccacuucccaggucuucauggcugucccaugugcccagcuuuggggugcccacaugauagcacuucagaaucuguacuuuuuacagugggauaccugugcacauagggggcugagaaggagggguauaggaugguauaaauuaugaggggacuaauucucagccucuuguggcuaaccuggacagaaguugagucaagguucucccuacacaccgcuggagccagcaugcuuauagugugacucccaaagacaguguaucucaaaagauacaccugaucccuagcuccugguacuguacauugugaccuucuacagaaguucaggcuuugcagaugugaacugauguuuaccuccgaugaagguucugcagaugacuggcucauuagaaugucuuaguuauggaagcugaaauguuacagauucucuagcuaaauuaucuugggcugucuucagcacacauuuauuaccaacuucuauugucagaacauccaucuuccaggcaaaaaccuuuagccuguauucuuagcaaaccucaagguuccuuccaccagcccaaaugccaaaaaugucaucagacagcaucugaggccuauagcagaaauugcucccuuagcuguaaccuaccuaaccugguuaucccacuaauguauuugauaaaugccuugacuuacuguuaucauuucugugacaacaaaaguugcaaagguuauuguaaccauggucacagugcaacacaucccuuggggucucauuagcuacauacaguugcucauacuuagcucaguauaaacuaagucuuguugcauuugauguagguguaacugggauaugcuaagccauuggguggaguaggacaugcucuuuacccgaggcaggugugcggacagaaagggagaauugcagguaggacccucagaggcagaagagguaggaaggcuccucuuugugccuugucuggcuugggaagauguggggcuucuuggggucugcucuaggugcuacgcuaugacagggguuuuuguuuuguuuugguuugguuuuuuguggcuucccuuacccgaugaacugcuuaguuuuuucugucgacuugacauaagcuaaggucauuugggaggagggacauuuuauugauuaaugauggcuaugggaagauccagcucacuggaaacaguaccaccccuggacaggcuguccugaguucuauaagacaaucaagucaggaaaccaugaagugcaagccaguacgcagcaugccuuuguggacuuugcuucaguuccugccugcacguuucugccuccacauuccugccucuccccugcccuggauucccuucaugauggacugcauggugcaagugaaaauuaacccuuuccuauccaaguugcuuuuggccaugguauuuaucucaguggcagaaagcagaccuaggacaccugggcuucaccuuggccuccagaccaagagagucaugucacccugauuuuccaguguauggcccuauaugaagguagccaccaugggucacuguguggucacaggcaagcccucucccuuguaucugguucuuauagccaggcucagcucuuugauuacuuggguccccugcagcccauccugccccaguugugggagauguaaauucaccucacccacaccaggaguucacacccagggccuguggaggucaagauuugaauaaaguccuccagccacaggaauaaacagcugaugguuuucccguaggaaucuggcuagagucacaggcaugucccugugugcuggaacacggaccaaagcugggaggccugacccaacugaggugcacuccugaaguguuagggacaaaaacccaaauccaggaauggauaggcuauggggccuuucccagggcucugaggacaacuuucaacucccagggccuccaggcaucccuuuguuuagagcuaugugggcucagucccuaccucuguggucagggacuuaugccugugugugucuguacuuucuucuuccuauaagaaccucauaacuaggacaggacccccaccuucccugcaucucaucuacaaagaccccauuucuagacaaagcuacugucuuagggucaaugugaaaaacaugcugcuagcaguaaaucucacuauugggaagagaguucccagucacaucuggacuugugcucugcaauaagagagguaacucaagcuguaugugugcucuggcuugaaguaugggagccaugcuguuuguccucagucuuuggacugggaaugggaccuccuacucuucuucccacuuaguucccagugggaaagucauggacagguucauuuuggcugggggaggaguacucuggggcuccugagucucuggagguuucuuuuccaaggucuaggcccuagagagugccuuucaagauggaguucaacaacgcacccccacucauggacaauggauuagacccuguagaccagaucaccuugccuugcuucaguauagacuggauggaugguccagacuccuggaugccauggaagguggaagaaacacccaggaagcacuaggccuugcucuccccaccaggcugaggugaaggggcauuugggcaugugccagcaccaggcaaauguggccacaaagagggaaggcaugcaaauaggauuugcaugugcaggugucuaggucuaaaaugccccccuuuguuggugggguuuuuuugcggggguggggggagcuacaugacccugaucauuauccuaugccugaauucugaaagacaaaaaacagauucuuaaucccaaggcaguggagaccuuggaggcucuuacuagcugagacggucacagaaagagccugaaauaaauguacuucuccgccccuaagauaggaagagcccagagcacgacagaucuggcacccaaauccugggguccugaacguacuugucccuaaacucucugugccagcuuacagugauauguggguaaaacuaagaaggucacugcaugcaugaauuagcauggcaccccucauccccuuggugaagagaccugacauugcugacagagcaggacguagauacaacuaugaggagcuggguccccaccccuacaccccucccuccugcagccccugagcuugggcugaguuuccaaggugcugcggcugauguaaucuccaagucugaggcucacaguuuggauugcccuccacccagacccucccgaacaauggguagcccuuucccuugcucauggcagacuuguccucaugaugccaucccugauggagaacaugagguagaaauguggcuagaacauagcuccugcuugcccuuccuaccuucucagcagaggacugagcgacuuucuggccccacuccuaugcaagcugacccuggugugagcuuaccugcccguuccuuccagauuccuggcauguagcugcuggugcugaguguuagaggcacuuaccuacugcaggcuguguuccucccucgauccacccacaugccacacccagcaccuggcagccaaugaugucuuagaaagcugggcaugagugaaccuaggguaccacccauccaccaagggcuagauuggugccacuggucugagagcacauccaggcuggccaagagcccacuguuacaugaagagggguuacaugaaacauggguccuuuccucccugggcucugccuggcacagacgaugaguacggccugggugucuguacucuaacaugagaucagaggucagaugggaauucugcuucauuucucaccaagccucaguuucucuaguugaggaaacaagaacugccuuaaggacacaugauccaugaaagggugucugacaaguggucccaaugaugauaggcaagcagaugaacugucuccugaggucccagaaggucuggagaugucugcccugaucuguggugugccacacuccuggagaauccuauggugugagugagcugaguacuagcuacuuaccagucaggcagucagugccuuggacugcaugaggacugccuccaaauugaggcucagggcuguugcucgugaugcuucucauggcugugacacuggcuuuuuuccuguugaucuauccagcuccuucaacacgaagucccgguuucucuuccuguagaccgagauacucaugccaagcuuccaggcgguugugaauaacuggggaagacccucaugacagcucuugacaguguuucugugagcccuucccccagagaccacaggaucuggcuuucauuacuuugccaugaaccccagggguaggaggauagggguugggcagcagccaaggacccaacauuagccaccagagggcgccaagaucacaggcaaaaacaggaccuggguggggcagggagaggggucucccucuggcuuuguccuaagcaagagggccacaguuacaucaccaucugagcuagcauguccccuagcauaccugucauguuaccuugacauaagccaugcccauuugaugcccuucuaaaauuacaagcugggcugggggcucagaccagcucuagccacuugagcccugaagagcagggacuauaagccuugagugcuugagagcugugggguacagcucuggaggaggguacauagcgggggccuagguggaauggccggaucucaguauagaacaaggccagaguucacuggauucuagaaaucuagccuaaguucauguccaccaagcaauccaaagccuagccuuccuaugucugaggacuagguggagaauaggagugcuuccagaacccuuccuucaucugcugcugccccuuuaccuccaucuuuuggacacucgaaggacugcaccaaauauucccuaaccguucuaggccaauaccauauuaugguucuccuuacccacaaccuuucauggaccccugugauccuaauaaucaaacccagaaaggcccugacacuuuuucuuuugcucccuuggggcaccacuccuuggagcaucuccugcaggcuugucaccacaggcucccaugucuuucaaggaccccuucacccaggcccacacccacacagggcacauccccuauagcucacuucccaggcaccccagcagcguugcucagugcugcuuugucaucugaaaugaccuuugcuuccucauuugcccaucaacagccacuucccccauaguucugcuggacccugggcagccccagccaaccccaagugcagaauaugaaaguauacagaacaugugcccaaaggcaguugugugccugagcaugugcauagucaugagccauaugaaggcauaaguggggucuggggagauagccauuuagugggaagcagcuuccaaaccauuccaggcccugggcagauagacauugggcaaggcucaauugcccguaugcucucauuacgagcacugugaugaggggacagagaaucaaggugccauggagggauaccuaaauugcccucaacagcugcuucccuacauugaucaccauggcuuggcugguagcugugucugucucucuugugguugcucugacuggugccaggaagauauuuccucuugggcaaggcuguguuccagagagcaagucuccagcaagggcugcucccaccccaguuuguguccccaggguagcaguuuuccuucccaccaccuacuguacagucucacuagcugccuuccaugcccaccugcucaaaagccacgucuagcauccaugagggcuaguguucuuugagggccaguguucuuaaguagccugaacgaucucugaggcugacaccuagguuuggacuggagcagaagaggccaaagucuggcaggccuucaagucuccccacccugcagaauuuaacucaaagccucccccacuccagcaugcuuuugggagagaaacuaccuccuaggaucagacacuagcucaauggcccugucccauucugcccuuagacucaauucugucucugacugccuucuguggagagaugcacucugcaggcccagaaagucugcaucuccagcauugacacucagggaaucaagggccuuuccuucccacagcaauucuaaggccaccaauguugcucucaugaccuuaguacccucuuggcccaggauuuuuuacaacguguuggacucgugucuguggucucuaaguuggagacaauggucugggaagagaaaggacaagagcaucacaggccuuacgccugagcucugucuauuagucugacacuggaccuggugcuaucccacaguuguagaccaaagccagaggggcugagggaccaacucagaguuccugccaggccucuaauggaaacuaaugguuuccuggacccauggccuguacuugucuuccaugcacacaucugugcccccuguacaugcugucuauagaauguguaugcuucuacauuaugcagagccguuacaggaccgguagccagccucaguguggcaucaacuaccagcccugaaccuguuccagguccugucaggcaaugaggacagugaucaugaugagcauuuccuaggauucaaugaggacauaccaaggugaguaugcuuagguuagcacccaggauaucuugaaaacugaccacauccacccauucaucaaugacccauccacccaggcaucuuguuuuauaguguguguguguguguguguguaugcgugcagaugcaugcaugccauaugucaucccuugccuugcccuguuugagacagggucucuucuuugccaucacauacacuagacuuucuggaacuugugcuuccugggauucucuugccuucaccucccaacuuauuguaggaguauuaagaucacagauacacacuauguauaguuuuaucuggguuccaggacucugaacuugucuguaugcuuguguagcaaauguuuuaucacugagccacugucccuguuccuaugaaggcaucuaacugacacccaccaccuucuuucugccuaugucccuacccagccaagccuccagacacauuaaucuguguaucaucauccauccaucuaagaguucagcagccuucuccagaggagcagaacucauagaauauauacauauuaaugagauuuauaggguugcuuacaugauagguaccaaguagucuaacaaugaccaucuacaugcugcagaacuaagacccagugucugcagagcccaggaagucagucagccaccucaguaagcccagucugguuccaaucagucuuagaagaucccuggagaaucacugcuguucaguucauguuggaaaaccaaaguagcuggagucugaagucaacagaggacagcaacagcagugauggacacacuugcucaggaggaagaagcaagggaaaguggccauugcucuuuccuugggaccucuuuagaccaggauuacuuucugguguggauccuccccaaucuuaauccucucagacaugcccagagacaguucuccuaaagcgauucuaaaucuugucaaguugacaaucaagacuaaucaggccauucacucacugaucaauuaaucgauccauccauccguccguccaccuacugauccauccaccgauuuacccauucaucuaccauccaucuaucuugcuauacaucugacuuaguuaggguuucuauugcugugaagagacacuaugaccauggaaacucuuauaaaggaaaacguuuaauuggggcuuccuuacagauucaaagguuuaguucauuauugucaugauagaaugcaugguggcaugcaggcagccauaaugcuggagaaggauauuugggucagcaggcaucagcaucaggaagugacagagacacugggcuuggcuugaacuucugaaacaucaaaacccacccucagugacauacuuccuccaacaagaccauaccuccuaauagugcuaauuucuaugagccuauaggggcuauuuucauucuaucuacguaucaacucuacuacuugucaccauccaucauccaucuaauuauccaucuauccuuaugucuaccaacucaugccucuaucucauuauuaccauccaucuauccauucauccuccuguccacuagcuauucauccauuuacccauuuauacaucuaucuacccagauaacaccauccauucauccaucccuccauccauccaaucagcugacuacccauccauucauccacucauucaucuauacaaguucccaccuacuacccacuucccaucaccauccaagcaacccacccaccuauaaagccacccacucauuucucuccaguuauucacucauagucaggagccucugugccuagacucauagaggugaaucaacucccuguuacacgaugcccacacaugggaaugucggcagcugcuucucaggcucugggucacauaagggcuggggcuggucagagcacaugaguggcaugugagguuuucaugugcuuccucccuccaucuguacaucucacagaugugaucuguaucuccugaauuggggccuuucugucuauuguuccagccuuccccacaguguaacuagaagcagugggugccuagaaaauucugccagcaacugagucguuccugccuucucuucuguuccucaguugcccugccccuguucugggcuucagccuuguguggggucauggugguuuggcauggugagcccuccagcuguguugcccauuugauaucauggauacggacaaaaauucugacugggacugcucaccauggcauuggauuuggcuagaaauacccaauacauuucuauccaccaaguggaggcuucguggcuuagcaaaugucuaagauggaguacuguugggcuagaggugucagggaugcuaccagcuaagggauccugaguguagugggcugugcuuuugagcaggcuauuaccucaugcucugguggaggucugagaccuuugaggucccggggcugcuccuaggauaccacuugguaggagaggagugaauucugug

SEQ ID NO: 28 - RNA, 37817 nt, Mus musculus
cacagaauucacuccucuccuaccaagugguauccuaggagcagccccgggaccucaaaggucucagaccuccaccagagcaugagguaauagccugcucaaaagcacagcccacuacacucaggaucccuuagcugguagcaucccugacaccucuagcccaacaguacuccaucuuagacauuugcuaagccacgaagccuccacuugguggauagaaauguauuggguauuucuagccaaauccaaugccauggugagcagucccagucagaauuuuuguccguauccaugauaucaaaugggcaacacagcuggagggcucaccaugccaaaccaccaugaccccacacaaggcugaagcccagaacaggggcagggcaacugaggaacagaagagaaggcaggaacgacucaguugcuggcagaauuuucuaggcacccacugcuucuaguuacacuguggggaaggcuggaacaauagacagaaaggccccaauucaggagauacagaucacaucugugagauguacagauggagggaggaagcacaugaaaaccucacaugccacucaugugcucugaccagccccagcccuuaugugacccagagccugagaagcagcugccgacauucccaugugugggcaucguguaacagggaguugauucaccucuaugagucuaggcacagaggcuccugacuaugagugaauaacuggagagaaaugaguggguggcuuuauagguggguggguugcuuggauggugaugggaaguggguaguaggugggaacuuguauagaugaaugaguggaugaauggauggguagucagcugauuggauggauggagggauggaugaauggaugguguuaucuggguagauagauguauaaauggguaaauggaugaauagcuaguggacaggaggaugaauggauagauggaugguaauaaugagauagaggcaugaguugguagacauaaggauagauggauaauuagauggaugauggauggugacaaguaguagaguugauacguagauagaaugaaaauagccccuauaggcucauagaaauuagcacuauuaggagguauggucuuguuggaggaaguaugucacugaggguggguuuugauguuucagaaguucaagccaagcccagugucucugucacuuccugaugcugaugccugcugacccaaauauccuucuccagcauuauggcugccugcaugccaccaugcauucuaucaugacaauaaugaacuaaaccuuugaaucuguaaggaagccccaauuaaacguuuuccuuuauaagaguuuccauggucauagugucucuucacagcaauagaaacccuaacuaagucagauguauagcaagauagauggaugguagaugaauggguaaaucgguggauggaucaguagguggacggacggauggauggaucgauuaauugaucagugagugaauggccugauuagucuugauugucaacuugacaagauuuagaaucgcuuuaggagaacugucucugggcaugucugagaggauuaagauuggggaggauccacaccagaaaguaauccuggucuaaagaggucccaaggaaagagcaauggccacuuucccuugcuucuuccuccugagcaaguguguccaucacugcuguugcuguccucuguugacuucagacuccagcuacuuugguuuuccaacaugaacugaacagcagugauucuccagggaucuucuaagacugauuggaaccagacugggcuuacugagguggcugacugacuuccugggcucugcagacacugggucuuaguucugcagcauguagauggucauuguuagacuacuugguaccuaucauguaagcaacccuauaaaucucauuaauauguauauauucuaugaguucugcuccucuggagaaggcugcugaacucuuagauggauggaugaugauacacagauuaaugugucuggaggcuuggcuggguagggacauaggcagaaagaagguggugggugucaguuagaugccuucauaggaacagggacaguggcucagugauaaaacauuugcuacacaagcauacagacaaguucagaguccuggaacccagauaaaacuauacauaguguguaucugugaucuuaauacuccuacaauaaguugggaggugaaggcaagagaaucccaggaagcacaaguuccagaaagucuaguguaugugauggcaaagaagagacccugucucaaacagggcaaggcaagggaugacauauggcaugcaugcaucugcacgcauacacacacacacacacacacacuauaaaacaagaugccuggguggaugggucauugaugaauggguggauguggucaguuuucaagauauccugggugcuaaccuaagcauacucaccuugguauguccucauugaauccuaggaaaugcucaucaugaucacuguccucauugccugacaggaccuggaacagguucagggcugguaguugaugccacacugaggcuggcuaccgguccuguaacggcucugcauaauguagaagcauacacauucuauagacagcauguacagggggcacagaugugugcauggaagacaaguacaggccauggguccaggaaaccauuaguuuccauuagaggccuggcaggaacucugaguuggucccucagccccucuggcuuuggucuacaacugugggauagcaccagguccagugucagacuaauagacagagcucaggcguaaggccugugaugcucuuguccuuucucuucccagaccauugucuccaacuuagagaccacagacacgaguccaacacguuguaaaaaauccugggccaagaggguacuaaggucaugagagcaacauugguggccuuagaauugcugugggaaggaaaggcccuugauucccugagugucaaugcuggagaugcagacuuucugggccugcagagugcaucucuccacagaaggcagucagagacagaauugagucuaagggcagaaugggacagggccauugagcuagugucugauccuaggagguaguuucucucccaaaagcaugcuggagugggggaggcuuugaguuaaauucugcaggguggggagacuugaaggccugccagacuuuggccucuucugcuccaguccaaaccuaggugucagccucagagaucguucaggcuacuuaagaacacuggcccucaaagaacacuagcccucauggaugcuagacguggcuuuugagcaggugggcauggaaggcagcuagugagacuguacaguagguggugggaaggaaaacugcuacccuggggacacaaacuggggugggagcagcccuugcuggagacuugcucucuggaacacagccuugcccaagaggaaauaucuuccuggcaccagucagagcaaccacaagagagacagacacagcuaccagccaagccauggugaucaauguagggaagcagcuguugagggcaauuuagguaucccuccauggcaccuugauucucuguccccucaucacagugcucguaaugagagcauacgggcaauugagccuugcccaaugucuaucugcccagggccuggaaugguuuggaagcugcuucccacuaaauggcuaucuccccagaccccacuuaugccuucauauggcucaugacuaugcacaugcucaggcacacaacugccuuugggcacauguucuguauacuuucauauucugcacuugggguuggcuggggcugcccaggguccagcagaacuaugggggaaguggcuguugaugggcaaaugaggaagcaaaggucauuucagaugacaaagcagcacugagcaacgcugcuggggugccugggaagugagcuauaggggaugugcccugugugggugugggccugggugaagggguccuugaaagacaugggagccuguggugacaagccugcaggagaugcuccaaggaguggugccccaagggagcaaaagaaaaagugucagggccuuucuggguuugauuauuaggaucacagggguccaugaaagguuguggguaaggagaaccauaauaugguauuggccuagaacgguuagggaauauuuggugcaguccuucgaguguccaaaagauggagguaaaggggcagcagcagaugaaggaaggguucuggaagcacuccuauucuccaccuaguccucagacauaggaaggcuaggcuuuggauugcuugguggacaugaacuuaggcuagauuucuagaauccagugaacucuggccuuguucuauacugagauccggccauuccaccuaggcccccgcuauguacccuccuccagagcuguaccccacagcucucaagcacucaaggcuuauagucccugcucuucagggcucaaguggcuagagcuggucugagcccccagcccagcuuguaauuuuagaagggcaucaaaugggcauggcuuaugucaagguaacaugacagguaugcuaggggacaugcuagcucagauggugauguaacuguggcccucuugcuuaggacaaagccagagggagaccccucucccugccccacccagguccuguuuuugccugugaucuuggcgcccucugguggcuaauguuggguccuuggcugcugcccaaccccuauccuccuaccccugggguucauggcaaaguaaugaaagccagauccuguggucucugggggaagggcucacagaaacacugucaagagcugucaugagggucuuccccaguuauucacaaccgccuggaagcuuggcaugaguaucucggucuacaggaagagaaaccgggacuucguguugaaggagcuggauagaucaacaggaaaaaagccagugucacagccaugagaagcaucacgagcaacagcccugagccucaauuuggaggcaguccucaugcaguccaaggcacugacugccugacugguaaguagcuaguacucagcucacucacaccauaggauucuccaggaguguggcacaccacagaucagggcagacaucuccagaccuucugggaccucaggagacaguucaucugcuugccuaucaucauugggaccacuugucagacacccuuucauggaucauguguccuuaaggcaguucuuguuuccucaacuagagaaacugaggcuuggugagaaaugaagcagaauucccaucugaccucugaucucauguuagaguacagacacccaggccguacucaucgucugugccaggcagagcccagggaggaaaggacccauguuucauguaaccccucuucauguaacagugggcucuuggccagccuggaugugcucucagaccaguggcaccaaucuagcccuugguggaugggugguacccuagguucacucaugcccagcuuucuaagacaucauuggcugccaggugcuggguguggcauguggguggaucgagggaggaacacagccugcaguagguaagugccucuaacacucagcaccagcagcuacaugccaggaaucuggaaggaacgggcagguaagcucacaccagggucagcuugcauaggaguggggccagaaagucgcucaguccucugcugagaagguaggaagggcaagcaggagcuauguucuagccacauuucuaccucauguucuccaucagggauggcaucaugaggacaagucugccaugagcaagggaaagggcuacccauuguucgggagggucuggguggagggcaauccaaacugugagccucagacuuggagauuacaucagccgcagcaccuuggaaacucagcccaagcucaggggcugcaggagggagggguguagggguggggacccagcuccucauaguuguaucuacguccugcucugucagcaaugucaggucucuucaccaaggggaugaggggugccaugcuaauucaugcaugcagugaccuucuuaguuuuacccacauaucacuguaagcuggcacagagaguuuagggacaaguacguucaggaccccaggauuugggugccagaucugucgugcucugggcucuuccuaucuuaggggcggagaaguacauuuauuucaggcucuuucugugaccgucucagcuaguaagagccuccaaggucuccacugccuugggauuaagaaucuguuuuuugucuuucagaauucaggcauaggauaaugaucagggucauguagcuccccccacccccgcaaaaaaaccccaccaacaaaggggggcauuuuagaccuagacaccugcacaugcaaauccuauuugcaugccuucccucuuuguggccacauuugccuggugcuggcacaugcccaaaugccccuucaccucagccugguggggagagcaaggccuagugcuuccuggguguuucuuccaccuuccauggcauccaggagucuggaccauccauccagucuauacugaagcaaggcaaggugaucuggucuacagggucuaauccauuguccaugagugggggugcguuguugaacuccaucuugaaaggcacucucuagggccuagaccuuggaaaagaaaccuccagagacucaggagccccagaguacuccucccccagccaaaaugaaccuguccaugacuuucccacugggaacuaagugggaagaagaguaggaggucccauucccaguccaaagacugaggacaaacagcauggcucccauacuucaagccagagcacacauacagcuugaguuaccucucuuauugcagagcacaaguccagaugugacugggaacucucuucccaauagugagauuuacugcuagcagcauguuuuucacauugacccuaagacaguagcuuugucuagaaauggggucuuuguagaugagaugcagggaagguggggguccuguccuaguuaugagguucuuauaggaagaagaaaguacagacacacacaggcauaagucccugaccacagagguagggacugagcccacauagcucuaaacaaagggaugccuggaggcccugggaguugaaaguuguccucagagcccugggaaaggccccauagccuauccauuccuggauuuggguuuuugucccuaacacuucaggagugcaccucaguugggucaggccucccagcuuugguccguguuccagcacacagggacaugccugugacucuagccagauuccuacgggaaaaccaucagcuguuuauuccuguggcuggaggacuuuauucaaaucuugaccuccacaggcccugggugugaacuccuggugugggugaggugaauuuacaucucccacaacuggggcaggaugggcugcaggggacccaaguaaucaaagagcugagccuggcuauaagaaccagauacaagggagagggcuugccugugaccacacagugacccaugguggcuaccuucauauagggccauacacuggaaaaucagggugacaugacucucuuggucuggaggccaaggugaagcccagguguccuaggucugcuuucugccacugagauaaauaccauggccaaaagcaacuuggauaggaaaggguuaauuuucacuugcaccaugcaguccaucaugaagggaauccagggcaggggagaggcaggaauguggaggcagaaacgugcaggcaggaacugaagcaaaguccacaaaggcaugcugcguacuggcuugcacuucaugguuuccugacuugauugucuuauagaacucaggacagccuguccaggggugguacuguuuccagugagcuggaucuucccauagccaucauuaaucaauaaaaugucccuccucccaaaugaccuuagcuuaugucaagucgacagaaaaaacuaagcaguucaucggguaagggaagccacaaaaaaccaaaccaaaacaaaacaaaaaccccugucauagcguagcaccuagagcagaccccaagaagccccacaucuucccaagccagacaaggcacaaagaggagccuuccuaccucuucugccucugaggguccuaccugcaauucucccuuucuguccgcacaccugccucggguaaagagcauguccuacuccacccaauggcuuagcauaucccaguuacaccuacaucaaaugcaacaagacuuaguuuauacugagcuaaguaugagcaacuguauguagcuaaugagaccccaagggauguguugcacugugaccaugguuacaauaaccuuugcaacuuuuguugucacagaaaugauaacaguaagucaaggcauuuaucaaauacauuagugggauaaccagguuagguagguuacagcuaagggagcaauuucugcuauaggccucagaugcugucugaugacauuuuuggcauuugggcugguggaaggaaccuugagguuugcuaagaauacaggcuaaagguuuuugccuggaagauggauguucugacaauagaaguugguaauaaaugugugcugaagacagcccaagauaauuuagcuagagaaucuguaacauuucagcuuccauaacuaagacauucuaaugagccagucaucugcagaaccuucaucggagguaaacaucaguucacaucugcaaagccugaacuucuguagaaggucacaauguacaguaccaggagcuagggaucagguguaucuuuugagauacacugucuuugggagucacacuauaagcaugcuggcuccagcgguguguagggagaaccuugacucaacuucuguccagguuagccacaagaggcugagaauuaguccccucauaauuuauaccauccuauaccccuccuucucagcccccuaugugcacagguaucccacuguaaaaaguacagauucugaagugcuaucaugugggcaccccaaagcugggcacaugggacagccaugaagaccugggaagugguauauaaagugcucucccaugucaugucaggucucuaccuacaguggagccaagggagggccuucaguauguucuuccucccuggcuggacaccuacuuuaggauccaaggcauggugaaguaggaccacaaugaauaggaagggguuuugacauucaucaaagaaacacagggguuagggaacccagcugcauaccacacaggucccugaagugaaggguagggcugaggggccuagccugccugggugggugggagaggaccugagcucagccagggugagggaugcugcaggcagccucuucauccucuauuuaccacggugggaauguggagggaagagccugguggggucuuucucucccugcuuccaccuguucuucccccugcccucuucaccugcacccccaguggacuucccuuccuggacuuucuucuugccuucuguuccugcuuccccuuccuaaccuuuccuacccuggacuuccaguucuaccaggucccuccucuccugcacucuguccucugaacuagaucaacugccuucucaccuaacuacccaggcaaaaaacccugggacuuugucuggagcagucuaggguauagcucccauggguuggggaaaugaauucccuacugucuuuggagguuuccaggaacccccugcaaaagccucugagaacggugaugaguguguuagaauccagaugcccggaguuugguuaagugugggaaacagagacaggcagguggguuugcugugcccccacacccaguggagaaggagccugacuuuaguuauagcuacugagagggaggucgagcucagguggggccaggagaugggcagcugccucacaugccagaugggacaggucuuccuuaugaagaggagaagaggguggcuaguccauccuguggguuccaucauauauauguuucacaggaaagccaccaugcaaacaacccagagcuccugccccggcagccccccagauacugaggauggcugggagcccauccuaugcaggggagagaucaacuucggagggucugggaagaagcgaggcaagguaggggcaauacaugccugagugaaguccaccaugccuggaauccccaagucuuacuucguccuuaaagcccaguccuggggccugcucacucuguguccguuccuuaugagcugagugcagagacccugaccagauggacaaaagucgagaguugcuuccugcccuggugauaaugagaaccuugagguucaggacuccugccucacucuccacucacagggggaggauauauugcaaugacuauaccacacagaagccuugccccaaggagggaaugucuaaagccugccuccuguggccugcccuguuccauaagcccagccuccucccccaugaucagagucccacaacccagugcugucuaccaccuggaacccaccagccccuuacccugcaguuugugaaggugccaagcaguguggcccccuccgugcuuuuugaacuccugcucaccgaguggcaccugccagcccccaaccugguggugucccuggugggugaggaacgaccuuuggcuaugaagucguggcuucgggauguccugcgcaaggggcuggugaaagcagcucagagcacagguaaggcuggcucccccugcccucagugggugaggucuucccacaucacuuuacgaccaagacaauccaucacagacacacccacuggcucaucugaucgaggcuaagauucccuucccaggugauucuggguuguuucaaguugauggaacuaagcaucagagagaugcucaaaagcaagcaugugcugcccuugcagggaucugcaggucuguucucagcacccacgccaggcagcuggaagcugcuuguaacuccugcuccagggagacucaacaccucugaucuccucaggcagcuucacccaugcauauacugacauacacuuaaauaauuuuacaaagaaauuaaaacuaaccaacauagugagauaacucaauggcuaaagacaagagucccaguucccagcacccacacaggaaguuggacauggaggcaugugcuuguagucccagugcuaggggaaaacaggcaagucccuguagcauaugacaguggccuuccagaguugcccaaccaguaagcuucagguucaucagaaaccaucuuacagagacaaggugaauggcaccucuggccuccacauacacccguccccugacacaggugugcugcacacaugaacauacacccacaagggggucagaaguucugagucucucucauugcagaagugguuauaauaaaggaauaguuuacaguuggaugcagaugagaccuuugucauuuagauccuugcccagaacaagcugcaggacagcaucuaggauaaaucuuggaaaaggucacugucugccacacauauauccccccugagccuuacuauucccgucagucugaaaguguucccuguagcugggcacggugguacauacuguauuuccaguucacggaacacauggaaugacuuaaguugacgaauagccugcauuguagaaaccugucuggaggaaagaaaaaaaaaguauuuuccacuacuugauucccuggucagccagcugugaggacuccaggacccuucucucccccucccauaggugccuggauccugaccagugcccuccacgugggccuggcccgccauguuggacaagcuguacgugaucacucucuggcuagcacauccaccaagauccguguaguggccaucggaauggccucucuggaucgaauccuucaccgucaacuucuagaugguguccaccaaaagguuagugacagguucacaggaccacagcugauaggguuuagugagcuuggguggguagaggaagccauaggcaggccgaagaauugugccacuccgagaggcccugaaacuauugagaggugagaggugggaggaugggcugcagugggaagauguggguuccaugggcccaaaacuucccaccagguggcagcaucucucaggaauaagaguggcaaccugcuguacucccuauggaaagccagaccuauaacgcucuaggcccagccuggcuggacggcuguccucaagucccagaaagcccuggccagguggcuuuggcucucugguauucauacacaccccccccacccuguggucuguguaaggcagaaccaaugagaagcccaggaggccccacugaggugaagucuggaccccagcccagaagagucuggaagguggagcuugcaaagcccuggccccagcuguuuccaugguucacucauuccagggaggcccccuggcccagcgguccagccucccucugccugaggggugggaacucugaggccuugcugaagccucucccagggccccagcauggcgugcacagcacagcaaggcccagcccaagcugcuccugaggucucugccucccccucucuccuuggcacaggaggauacucccauccacuacccagcagaugagggcaacauucagggaccccucugcccccuggacagcaaucucucccacuucauccuuguggagucaggcgcccuugggagugggaacgacgggcugacagagcugcagcugagccuggagaagcacaucucucagcagaggacagguuauggggguaaggcuugcucuagcugcccaucuacagcaucuuggggauguagacauggagauguggcacacaccaguaagaacuuuauagagagagcgggaaaaggccuuccaggaagugggggaggguccugcaugccugaguguacaaggccagggaagaagagcuguuggugugggauggaagagugacacagcugggcagugugaccuuggcuaggcagcagcuaccuccugggcagacgacagggcaguugccacuguuuuaaauggugcugcucuggcugcagacucugauagccaauagucuucccagaggugcaguccccuuuacugccaccagggagcagaauugccugagggaauggguauaucuguggcuaauggugggugugaaagagagauacuaggacaauauuaagggacaaaaaaauauuuauaagcuacaaugucauugcuuagaaauuuuugguaaagccagugcacuuuaacaguggaaacagaucuguguuugauaccacaaaggucucaauagaaccacugcagauugggucugaucccaccagcuuuugaccguuuguuggccuggugugucucuuacaaugcagagcaacucuguccuaugcuuauagagugacuaccuagccacaguguaucugcuuuugggcuguggcagguacaacuaggcuucuuuucucuuaaguuacuuuguguuuaaugccagcucuggacagugcagauguaaggugugggcccacagcucagggauuugauacacuauuuggguuuggguucacccuugggggggaaaagccacugugggcuggggauguagcucaguuaguagagugcuugccuuuugugcacaaugcucugggauuaauccccagcacagaauaaaccaggcucuguggcacaugccuguaacucuagcacucuagagaugcaagcaggggaucacccuaaacuauauuucaaaauuaagacuagacuuggggcaggggagauggcucagcgguuaagagcacugacugcucuucuagagguccugaguucaauucccagcaaccacaugguggcucacaaccaucuguaacaggaucugaugcccucuucuggugugucugaagacagcuacaguguacucauauacauuaaauaaauaaauaaauaaauaaaauuuguuuuuaaagacuagauuaggggaaaaaaaagcuuuugccaggccaggccagggcgugcagaaacauggcacccaaggaugccugaaguuggaguuggagaugguccugaguucucacauucugagcaucaaauggccucauggcugcucugcccacaggcaccagcugcauccagauaccuguccuuugccuguuggucaauggugaccccaacacccuagagguaagggcagaaagaaaagaacucccccuccccuggcuggagcccugaaggauaugguaguuucucagggcaucuacagggugguguggagggcuaaggcaccuccuaagcauucaucugggugucaccuucuuugccucccccagaggauuuccagggcaguggagcaggcugccccauggcugauccuggcagguucugguggcauugcugauguacucgcugcccuggugagccagccucaucuccuggugccccagguggcugagaagcaguucagagagaaauuccccagcgaguguuucucuugggaagccauuguacacuggacagagcugguaugugcugcuggggcugccucuguccucccagccuccccuggguggggaugcucuuucugaaaguccugugggccuagccuaugaccucucuuccuauauaccucagaauuauccagguccuuguguagcagagagaccagacaacuagccugguaggcaguucugagcuagguuugugggucagcaggggcaaagugguccaucugaggacucuuccaggacauauucagaucucaaggcuucuuccuggucuuaguuacagaacauugcugcacacccccaccugcucacaguauaugacuucgagcaggaggguucggaggaccuggacacugucauccucaaggcacuugugaaaggugagccaaguagaccugcccucagaggcugcagacuuagcaguguucacaggggauaccugucagcccuucccagguaggagagaugacuuacaaauucaugaaguguucaguucaguagcuuauaaucuagccucagggcauuguaaccauccccaguucuggaaauuuucuauuaaccccacccccaccccaccccacacacauccaauugccuuagcaauaacuucaccuuguccucagguaauaguccccuguuuucugucuaagaaugugggcuuuagggccaguuuacauaaauggaauuacaguccauguuauuuguacccagcuuccuucuugaagcacucugcccacagacccauccccuuggaagucugugcccggaaguccucccuuuuuauggcugaguucugaugucuacuguguagauguuccauaggucuguacauucauccacugguggauauguuggauugucacccaggcuuguccauguggcagggcagaccuggagcacgugugcacaggcuggaaucugggagagaccaugcuggggaagggauggggacauaccugaggaaggggccacucuaagagagccuggggcaucgggggcugcggauguggcucauuugguaaaauguuugugugccauauacaaagcccuggguucaaugucaaugccacauaaaccagaugucauagcuucuaccuguuagacaggaggauuggcugcucaagcaaaucggcuacauaguaaucucacagucagcccagacuauaaaggggcagcucuggauuuggucauuccccugccugagauagugaggcccaggaagagauacaggaccacaugugguuuucagugagucacacucccauggaggcaaaagccugcuggucuucacucuggggcuuguugguaacuguggucuccagugaaagugucaggcauucccauggaagaagugugcuuguaugagaauguacagccuuguccugcucuugggcaagaagaugcuggccaaauugcuauauucccgagagcauguuucugccucuccagacuauguccaggggauucugggguguugccccugagcacucaguccuaugucacuugcugcuguuuagaggcagcugccaacccccaucaaguccucgcagaguucuagucccuccccuccagcucugugggacucacccccacccacagccugcaagagccacagccaagaagcccaagacuaccuagaugagcucaaguuagcaguggccugggaucgcguggacauugccaagagugaaaucuucaauggggacguggaauggaaggugcucuccccgcuccccuggcccaacuugggaacaccaggcagggaauacacugaagccugaaguaguaggauuucauggguagcaucuggguccauccugucucagauauugcccuggagggggucaagaugauacuagggaacacucaaagucccaaauggggcagagggaauccuaacacuccuaauguuaacucaccaaaccuuucuuaucccuggcaccugaggccagcaugcucugcugacccaugccugccccagcuucagggaauauguuggggguguccaggggaggauguucacccucucuuccucccucuuauuguccugaucuucucuacugggugaauccaguccugugacuuggaagaggugaugacagaugcccucgugagcaacaagccugacuuuguccgccucuuuguggacagcggugcugacauggccgaguucuugaccuaugggcggcugcagcagcuuuaccauucugugucccccaagagccuccucuuugaacugcugcagcguaagcaugaggaggguaggcugacacuggccggccugggugcccagcaggcucgggagcugcccauuggucugccugccuucucacuccacgaggucucccgcguacucaaagacuuccugcaugacgccugccguggcuucuaccaggacgggcgcaggauggaggugaguagagccagguuaggccagggcguacuggauaggcugaauguugaugcccuguucugcaggagagagggccaccuaagcggcccgcaggccagaaguggcugccagaccucaguaggaagagugaagacccuuggagggaccuguuccucugggcugugcugcagaaucguuaugagauggccacauacuucugggccauggugagcagccaccucaguccacggcuuccuugagcaucucaagaggcagacuggggaaugucgggaugguccggccaccuccuaaaacccugucucuccaucuuccagggccgggaggguguggcugcugcucuggcugccugcaagaucauaaaggaaaugucccaccuggagaaagaggcagagguggcccgcaccaugcgugaggccaaguaugagcagcuggcccugggugagucacaggcagagggcgucugccucugguccccugcagauaucucugauaaccacguggcccaggguaacccccauggccuccugugcagaacagaacacagagcacuuccuccugggauggaaauuguucaggaaguccugaccgggagguagagucccucacaaucccaagggagaaggggaagggccagaggucaaagguugggaagggcucuaaggucagugggacucucaguggccuuguagcaugggaggccuggcuaaacccuaggaaguugauucagggcauacacugcagauggcacggggggaggggggcaguagggggagagggguuccagggacuggacaucagcacuccaucccagcagcugauuuuguuuacagaucuuuucucagagugcuacggcaacagugaggaccgugccuuugcccugcuggugcgaaggaaccacagcuggagcaggaccacgugccugcaccuggccacugaagcugaugccaaggccuucuuugcccaugacggugugcaaguaaguaguugaccagccuaagaauggccaggggcaaagaggguuggcagggcccaggcuacccacauaggauacugaggucacuccaugaaugucccagccugaagcucuuagcccauguugcagcuacacaggggagggaccagaagaguggcugaauuucagcuuccuccaucaagaauacuuuccuagcuugguucuugggcccagcaacaccuggucucaguuugguuggcuguaacuccaauccauaauccuguuauugaaagguuacaacagggcuggggguguggcucauuuaaugguguguccagcaugcuugaagaccuggguucaauacccagcacucuauaaggcagguguaguggcacaugccagcaaucuuaucacuauggugguagaaacagaaggcucaggaguuccaggccaucuuuggguaugaaguugauagugauaguuuuucuggguuacaggagacuuccucaaagaaaaaagaagaaaagcaggcaggcugcaagacaaucaaccacauucuccuauaaagaggaugcuucugccagagcgggugcuccaggagggggcuugagaagggucugggaaggguaucucaggcacacaucccuacaugagauaaaguguggugacaggcagccacaacauaugacuuuauuccaggcauuccugaccaagaucugguggggagacauggccacaggcacacccauccuacggcuucugggugccuucaccugcccagcccucaucuacacaaaccucaucuccuucagguagguggacacaggcggcagcagguaccagucucgauguucucaugucucacggccuuaugucugauugauuggcuaugugagcccccucucccccauguuggacuuucuuccgucuacgugcuugggauauucuucucuguguugcagugaggaugccccgcagaggauggaccuagaagaucugcaggagccagacagcuuggauauggaaaagagcuuccuaugcagccgggguggccaguaaggaguagcuggggggggugaaggggauaaaggggggcaggaaggaugcaagaaauagggaaggagggaaggaacuagaaaacagaaagauagagugggccuggaaagauagagcacagacaaaauggaggagacugagcuagaagggauagcgcagggcuaagaagguaggggagggugacgguuaggaagaauggagaaugcugggauggauggagagagucagggcuaccacuaggcaguggccagcuccuagacacacgguagacagagucaggcucccauggaguaccaugguuugguaucuccucaccauggugaccucugcacucacacagauuggagaagcuaacagaggcaccaagggcuccaggcgaucuaggcccacaagcugccuuccugcucacacgguggaggaaguucuggggcgcuccugugacuguguuccuggggaauguggucauguacuucgcauuccucuuccuguucaccuauguccugcugguggacuucaggccaccaccccaggggccgucuggauccgagguuacccucuauuucuggguguucacacuggugcuggaggaaauccgacaggucaguggccggcauggccuucuccugggcucugcaacucaggcuguguucuaugugccucaggugggaccuguuccgggggagguaggacuuuuuaauccauuagaacaagaccacuguguggccuuucugucaacccacucuacugaguccugguccuggucacagagugagccccaaucccagauccagaccaagccccaaucuuaaucagacuaaguccugauccuagucacaauccuagagccaaccugagcugauuucagcaccaucuugaccucugaucucugcuccagauugaucuugauucugauacccuagucagagucugaacccugaccugagucacugacuaaguccagacucugaguuuuagucacagacaguccugacccuaaguuuggauugaccucauuuuuuuuguccccagacuuaucccugaaauaucuucaguugauaucuccauuccuagccauacagagagugcuagucaucaauugauucugauaaacuuggaaacugaguucugauucaugcagauuccacccuggucucagcaagaaagacacggugcugcaaccaggcuuucucccucugccagggcuucuucacagaugaggacacgcaccuggugaagaaauucacucuguauguggaagacaacuggaacaagugugacaugguggccaucuuccuguucauugugggagucaccuguagguaugugggcaggcucuagggguccuacuuaucccucugaaacccaagugugguccuggaaccugguuuuuggccagcugacuagcauacuuugugucuugggggaaaccuccuguccuacaugggcaccagcagccuuacccagccuccgucccucuccagaauggugcccucgguguuugaggcuggcaggaccguucuggccauugacuucaugguguucacacuucggcucauccacaucuuugcuauucacaagcaguuggguccuaagaucaucauuguagagcgaaugguggguccuugggacccugacccuugagggggcugagguaccgggaaccccacccuggauagauggggaaccuagauuauucaguggauggugacccuaauccuguugugggggggggugagcccuuugggaucccagcucuggauagcugcagaguccaaaggaaaacugacucauagaugggaagggcacugagcuuugacucuagauggggaugaggaguauccagcuuuggauaggugguagcccaugggacccuagcccugggugagaugagcuccccagaacccuaaccuggguuaggggugagcccuauuggaccuugaccuugggugguggugagccccguggugucucaaccccggguagcagugagaauccugggaccuccgacccuggauagggguaaguacuaaaaccccaaccaagguaauggugaagacccuaacaccucaggccugggaggggaugacuccccugggacccuaacccuagguugagguaaaaacccuagaacuccaacccuaagugaggguaaacucucugaacuccacccugggguagagugagcccuucugugacccuugagggcaaguucccaccuaggccaugcccugugacccucccucugcagaugaaggaugucuucuuuuuccucuucuuccugagcguauggcuuguggccuauggugugaccacucaggcccugcugcauccccaugauggccguuuggaguggauuuuccgccgugugcuauacaggccuuaccugcagaucuuugggcaaaucccucuggaugaaauugaugguuugugcugagccaggaagggugggcugaugggcgggugggcucuagaauaugugcuccacugggacuucugggucaccaggucccuggcugaaaauggcugacacaacagcacccuaagucuaggccacaggccuugcauaccuccuaggcugagguccagaguaggguaagacacagccagccguggagcccucaaccauucucuggcugggaaguaggccauggagauccugaauaugcaggccuggcuuucuucuuagggaagucaagugaugcaaugggcuucaacuuguguguguugccuguugaugucagugguaugaggcuugucuguagacaugaguguccccucaagcuaggcccuaaaccuaguuagggcugauggagauucuagggacuucaugacaaguggacacagcucuguacuuacugcaggggucuuguggguaguggaggaagaaaaacccuggagacagaguggggacccaggcagaccuaagguggcuaagauugggcaaacauagagauucagcucauuaggccggaaagaggccuagagagugggggaucagaacagaggcuccauauguccauauguguaggcuuagagauaggaugcagauucaggcacugggggaggugucaguauucuggcuagugucaagggacuuaguguuauacagcuuggauggucaauagagaccugaccccagccauucugggggaggccaguaaugaggccaggucagcaauuacaacacuggaugaauauuugucaacagaugacagugagauuggagcaagcccaggccuccagggacagacgggcuggaaauuaacuucuaauuggggugcucccaagccauacccugggcuguuuucuucuccccaccacauugcuuuugguguuugcucaacugagccaucacuuuucuaggccauuagcuuaaacagacauugcccgcuucucccuuccccugagccauauggccucauggccucagucccuggggccaggaagaggaaggugaguaccccagccagggcagcucuggggucugaguuccauaguaacuauaauucugguuucuucuccacaggaauuggggaacaagcucaggccaccuggcaguuuagaaggguagcagggugguccuuagucuagguauggaggccacugcagggucagcagaaccacuauagauguggcaggcagagugagcagugaaauagcauugccagucccuacacugugucuacuaugcugggagugggcugguauucucuaacaugccugugcucagagggaaacugggacuggagagauggcucagugguuaagagcacuaacugcucuuccagagguccugaguucaauucccagcaacuacauaaccauuuguggcucacaaccaucuguagugggauccgaugcccucuucuggugugucuuaagauagcuacaguguacucagagggaaacugaggccuggguaguucuggcccagucugcaggguaguccucaccucuccuccacauuucacgcacuucccccuuuucccaccaggcucugggcuucagggccaaacuuguguucaaccaggucaggcaggccuucucaggccucaggcaggauuuaugcuuuuucaaggccuccuugcuucuaaggggcuuggccacccucuggggcaccuagagaagggaagagagcuggagaaacagaaccuggagcagauucauaggguggggaauggagugacugcuaaagcagccuuggagggggcaaggcaggaucuggcacucccagaugacugauugcaucccuccauaugauagaacacucuacaucucacauggguugacuggucauaauaacucacuggguaaacaaggcagggauuugagaaacaaggcaggucagaagaaugccaguacauauacuagacuugaaagucaaauaucccaaaauuguaccucaaggcagccucgccuagagcaucacccauaauucugagagccggaagaacagaaucaauaauaacucacugaaguguacaggugguacagcugcaugcauacaugcauauaugcccacaccuacuuauacagacaguuaugugccagcauacagccuggagaagacaggggauggagccaggaggagggauagcaaucucagccuaugcuucccugcaggcuuggcaggguaaagcccugcaggcaggggagaagcagaaauaaaggggaugacauuuauaaggggcuagcauugugacucagaguccuugggggaugcccagggaucuggguacucccauuaugggcagagguacccagaaagcugcagguuugcaucccaucugagagcacuaggugagaaaggcauggacaggagaucuaaagggcucuauggcucuuguucucacuuccucacauggacugggcuugccuccauggaaucccagcagaggaggcagaagaugaacuuguuggcuugguguaacuagggcugguacuuuuggugcuuaaacuagcuagccccauguuaaccaggccccuggccaccuaccuggcacccacagccugucggccucagcuuggaaccacacucccagucugaaggugucuguuugccuuacagaggcucgugugaacuguucucuucacccucugcugcuggaaagcucggcuuccugcccuaaucucuaugccaacuggcuggucauucuccugcugguuaccuuccugcuugucacuaaugugcugcucaugaaccuucugaucgccauguucagguacccuccugcuuccacuucugcccaucugcccucgccaauccaugcuccaucuuaguagggcugguuucagggugcugacagagacaggacccauguccugguauuuugcugcuguguccagugggcuggaccugcaguagagagccaacacuacagguauggacacacugugagcacaccccugcuguuuauccuguuaggaaggaagaugggucuacaggguuggggacucagagcuguguaaauaccccacugaggaagcuccacugcaguauaccugagaauguguuugaggggugccagacccccauccaagccuccuuucuguggcucugauaaaacuaauugaaaacaauguaggacaagaaaaggcuuauuucaucuuauacuccuggaucacagucugccacugagggaagucagggcaggagcucaaggcaggaaccacagaggagugcuguuugcuaacuccucaggcucauguuuaccuagacuucuuacacaacucaagaccucuugcacagggaauggugcagcccauaguggacuaaucccccagagacacgcccacaggucacuaugaucuugacagucccucuauugugguucccuucucaggugacucuaggcugugucaaguugagaguuaaagcuaacuauuagccucuaucuuucugaaagggcucccagcacagccaagcuaccaacuggaugcaaugggggaugacauauaaggagugggagguggaggggugagaugaaagaugggaaaugggauacaggggcguugugugugggguggaagguagaugcuggguugagguagggugcuuucauggcagguagagcagcuuauaaggcaagggcuuggcuauguguccuguagcuacacauuccagguggugcaaggcaaugcagacauguucuggaaguuucaacgcuaccaccucaucguugaauaccauggaagaccagcucuggccccgcccuucauccugcucagccaccugagccuggugcucaagcaggucuucaggaaggaagcccagcauaagcgacaacaucugggugaggccccaggcuggaugccacugcucccgaggggagggucccaauugacagaggagaccauagaagggacugggguuccuugucuaggcccuguccagguuaaccaaagcuccagguagacuugagacuagacagccacaaggccagccugucuccuugcagccugaaaucccugcauagggcuuauuucugucaucuaccuugugcccugccugguggcaucugcccucagucucccuugcaucagccugggccuagacuuucccuagagguccacaccacucuccaaagcuugcugcugucucccacauugccagagagagacuugccugaccccuuggaccagaagaucauuaccugggaaacgguucaaaaggagaacuuccugaguaccauggagaaacggaggagggacagcgagggggaggugcugaggaaaacggcacacagguggggcagccugugggacagcaggcauaugaggcucaggcuggcaggugucauuccuguucaugagcugcccagagauguagaaagggcucugacaggagggagguaaacucagaugcagcagggcugggcugaccuugaucagcuggguguuaugaggggcaguaagucuaggaggggcuccccauugugaacauguggaaauggggggauaucuagccuuuucaguaauaggugggguuuucugaaccaccuuaaggcugggugagaccaucuagugccaauaacaggaccucugagcuggggaaacauggcugggucacaagacccagcccucuugcccuaggaguguguguauauguguggguugagagcauaaguccauaauuaggcaucucucuccaaugggacucuuuuccuccucucucaggucugaagauccacgcccaguuggugcuagaugguggaggggcuguucuugaaugcuuauagggaugaccuaguguucauccuauugcuugguggccuauuccaagcagggaggggaucucaaucucuuugaggguacagcagugcuccauauccauagacaggccccagauaaagacuggaagggcaguaaagcaagaggccaacaguuaacugaggcccugagaaagcaguuaggacaaaaagcucccccuuguggagugacauggaagugucacaacugaggcugacccugcuuucuacagaguggacuugauugccaaauacaucggggggcugagagagcaagaaaagaggaucaagugucuggaaucacaggcaagcuagcaacucacuauccaucuuucuuccuggggugggggcauccuucugguuccaugggaacuaccacagcccuguaccagcauccugguggguagcauuagggccuggauagaguggccugccccugccccaacucacuuucgagacucauuguuguucuagagcugguccaacaaaaccuagguucagcaccacauccggucacuaucccuuaucaugcacuaugggaggaccugguccagaguguggagucccagggcagcaguagcccuggcaggagggcaaucacaugggaggaaaccaacccgguccccccaguccccaccgaagucucaguaccucccuuggcucucuccaggccaacuacuguaugcuccucuuguccucuaugacggauacacuggcuccaggaggcaccuacucaaguaaguauggguucaggccaugggaaugagauggguaugggcuccucccuucagccacuagauuagggcaagagcaaagcugcgggcuguguauuguauuagguccugccuucuccaccugugcuagaggucgguuacccucggcaggccacuguuccuuagugucccaaggcucugccuagcacuggccuugcuagccuugccacuuuccauguccuggcccuugccucacuccugcccugccccagcugaggcucuccagcugaggguccuuucucccuuucuugcucccaggcucucagaacugugguugcaggagucagccagccucugcuagagacagggaguaccuagagucuggcuugccacccucugacaccugaaauggagaaaccacuugcucuagagccccagaccuggccacaucgaguuuuuggggcacaucaaccuucccccacucccagcagccccaagaaauggucuucaaggccuugcuacagaucacuucuuggacaucccuuccuaagagaaugaaacucaugucuuuggcaucuauucgggagccucagaaguauccucuccagcagggcaagauuuuucaugucccacuaaagcuuucacuggcuuggacuggacagcuggaucuggccaaguccuacauaggacaccaucugccuggauggggcuauuuaggucuaaccccugucuuacccugaguuccuaagaagccaaccucuuaaacacuagguuucuuucugaccccugacccacucauuagcugaccagcuccuagagggcaggacucagaucuauuguaauuaccucccaucuuucaccccccacagcauuaucugucugaucauucuggcagaaaccccaagauauugcucaaggguacccaaugcuacuuuacuuucuauaaagccuguagaccaccucaaaucagcuaaacugggccacaaugguggcuaaacgggacauuucaaacacccggggaauauggaggauugucugaccuagugaaaggcaucuccguuccuuccacugcuccucaaauuaaaugaccauccagguccuuuuuagaggaacucagagaauggggacuacagaggcuggggcagaccugggucuuagcaggucuagcuaacuugguccaagucccuggccuccacaggaaacauucgcucaugcauccucccugcauccuucucuucuucucuggcucagcuucaguggaaugacccagcaucagcugugucuuacacacacaaguccuggagacacagccagacaccaaccauaugcugcuucacaacucauccucuuccuauaaccuguggucuguacaggcccagugcuggggcugcauugguuucuggggguggggguggggguggguugugcagauuaugcucauucacuaccaucaggggcacaaggcugaacacagcuaagagcccagucccucuggguaguuucaucagugacaaauguaaaugaccauggcaaaccuucacggcaguccucacuggaguggggaaggcaaggugaggcugccagagaugcaguccuguaguuggcugcccaggacuguuuggacagaacucuuugaguggggcccggaaaaagccacacaauucaagaaauauuccaaacguuuauuauucauccuaaacacuggggcacaaaggccuucgagguccccugacccacaauucccacagucucugccagagcggcugcacacaucccccuaccacagacagcccacaccuucccacuuggacuagcaggugagggguagagugauagcacugcagucaaacugaggguccucucucagaccccggccccccaggguuaccgucccuguuccggaaguggucucugcuccgcuucuugcugccauggaaaccaacagccuucacaccuauggggccugaugaggacucaggaugggcagcuucugaagguaccaccaccucuggcugucccugguggccacuccauuccucagccucagguccagcgagaugggcuagcuccacagcggccucaccccccgcaccugacccaacccccuucuuuaggacccucuuccucucagcccuagccucacugucccucacugguuuggugaagaccacucuucccuccccacagcuagagggguccugguugaaagaaggcacauagucugugugggacaccuggcuucgagagcucaggaaggccagggcagcaucacgauugcucugcucacuggcuucagacacauccuccagacuguauuugguccaacgcucagggugugacacauagucagggacugggaguacccuagucgggccaguguucccaugcacucugcucaggccccuugcuggagucugacuugggggagucacgggccgccugaagcugccauugucacucacacugguuuggggagcagagcacggugccugccgggcugcacucuccagacaaucaaagaugcuguggcugcgcugggagaagguagaacucaugccucggagguggaauggcugcacugcaguggugagggugcccguggggggcgauggaggguccucagggccggaguccuccuggcccuccuccgaaagccucucuggggacaacacuuggaccuccacaccacuagguaagcuaagguccgaguccgagucgcugagggagacggugucagaaggcagggugucauccucgguggguucaucagccuccaggccagccucugucuccgccauacgaccugacacccgucccaccuguagcgaagcagucccaguuccgccgugagggguguauuuaaggccucaucccuccccguccucccaggcucccgucuuucaccuccacuaugugucaagugccucuacucacagccggacgggaggccucgcgaagcugggugguuaaaggguauccuagcgcgcacagauacaggagcugcagguuaggugggguuaaggagagagucaaccaugagaucauaacaguguggacauacaauagaugagcacugggagaugcuggugacaggagaucuccaucagcugcuugucccaucacgggcucucaguaaagcgcagccucucuagguacaagcgccacccggguccggacgaagggcuggcagaaacaggcacgggaaugcccuggccgcggccuuagggaggccagugcucaccguuccagcguccguacacgccucaauacccugccgccuuucucgcagcgucccgccaguuccccgggauucgguccuguccagucucgcucggguuccugggaaaccgagucucgggcgaucagauuuucguggcuucagcgcccgagaaacuacaacucccagaaggcaauggguucccgccuaaugucagccgggacuuguaaccuuaacaagcgugccaacccggagcgcacacggaaacccacccagaaaugacgaaaaaggaaaaggcggagccacgguucccacaauacuccagggcuaacugccaaucgcaaaggguugaggccugcagcuucgccugucggaagccgucccggccggguccgacacaaggaggaagugcgucaccacgcacugugagcgccaaccaguuuccuagacauuuccggcccugggcggaaguggugugggucuugugcuuuguuggcuuucuggagugaggcggggccaagguccugguuggcucuuggcaugaagagacguaguggucccugggguggguugguuggggcuucagagauucgaagccgcuauccugggcucugccugucugugcuuccugacgcaggaacggacacuuuaguugcaggacgccgccccuacuagucaaggccacacauaauccuccuccaggcguggggcuguuuucuuguauccuuagggaucagagucugagacaccauggggcugcugcaugcgccucuccuuuccuauguuucugaagcugugcagcaggccuccaacagcuuuggccuggugcccauggaccucauaacauaggauauaaagggcuccucagaccagaaaccaaccaagcacggaacagguugcauaggcgugggagguagagguggcggagaccuagaauguccuaguacaagcuugggguucaccgacaaauaagccuacugggaggcugcuagaagcugggccaugaaucuuggcuagggcgucucuccucuaguggccaauuaacuaugccagcagccugggggaggggcgcagacaggagacaaagggaaagagacaguggugguugccccuggcguccgggagguugcuuagccugauccucaguucacagggguaagugaacugccaucuugccuuuuacuuauugagacacaagccagagccacccagcuccguggaaucuuuucuugagauggaugggguaaugggcuaaccuuuacugucuugucccugaaaaggaggguguucuugcagcuuaucuccaucauucugugcugaauuucccugcuuagguggcuccuccuacccgacucagccugaccugucauguccaacagaugaguggaaaugaggucaaggcuggcguaaagucagcauugagcucccaguauaaggagguacaaaugagggaggacccauauggagugcucccagggucccagcccuccccacccacuguguuccacagccucuauuggaccugcucacccugugccuggcaaaguucagagcugaugagccaggucucugacaccgcuagcacaggaagaggucuggcagucccauuagcaugccugauuuuuuuccuccuuuauuaaaugacuguuucaagauuuaauuacaguugaaggugacacguuagaaagaauaagugcauugaaggcauaagagggcuuacaaacccagcucuugaaauggaggcaggaaaggaacaaagauuaaaaagaugugagcaaugugacccacaguggguugagugggugggcauggcccucuagcuaggcuacaaagccucugggcaaguagcuguagaggagguuuggcucagcaggcagaacucuccaggggucccagacguacagggcccugcaagccagggccagcuccaccccuacaucccacauaugccacccaugugugaugucagcucccaaaagguaacaggaaaaguucaggacaaaaaaaaaaacuaaaacaaaaacaaaacaaaacaaaacaaaaaacucaaaaguaaaaagacuaaguguagcagagugauacagaaauauuauauacacaggccaugucccccaagguggccucuggucacuccagggauccucuggugcaaugcaaagggccucaguacacggagcuguuccggaugccacagcacagcaccaugcucagaaucaucucaaagaucugcaggagggaggggcauagucagcaccuaaggcccugggaaggaucccacccacccaccagagacccugugcuuaccauaaugacagcuaccacaauggcugcaauuccaaugagguacagcuucccagagaagagcucaucgauuuucugaugacaaucuugcugcagggauggcaagagcgugguuaaccaucaguggcuaagucacagccaccacccuacucagugacaggaccuauguaucacagcuuaucuuccaccccaaaacaaauuuaagacacacggaccugcugccugcagccuuuugucacaggggaguguuuuuuuaccucacuagcacccuagggucaccaggguaugagggaccacucaagagaacaguuuucugggauguugcagggguuaacucaagcugugaggacccgguaccccaguaauagagauggucuaugggacuucugaggucuugcucaaagugcugaucuuccugauuggccacaccacccuaccgaccaccaccaccaccucauccccacuccaugcuaccugcaguaagggggugaguauguugccgccugagggacacaggcuguuccucaguauggugguagucaguguggucagugcguuggagccacaacaguugagcugcagggaccaagaacaacacugucagcuuuggagcuucaggagacaagggaaagaucaggcacacagcacaccgucaccccaaaauacacuugggaguuguccuucugcccuguuugucacccugcacaggagcccuguuccuucaaaccccugggaaaaugaggcccauuagauuccuaccugaggacccacaaaucauagaggagacccuuuccuaggcccuguuguguuggaaagaaaggagacccaugcccucacacacuaggaaccccacagccuccccuccugcuugagccuagcuauaccgucucauggaaagucuucaccacagccuuggcauuguuggcaucaucauccaucacagcuugcugaagggccuggucauagaacugcuucacauccuuggcgaucugggggagaaucauagucacauacagugucggggcuacgcccaagagcacucaacuucccgaugggcucagccugaugccaccucuuccacugagcucccaagacccugcccccacccaagcagcagguccaagaaauucaaaaagcacccuauaacuaugggcucagagcaacccacaucuguuggagggcagagggcauaucucccacucggugaaccuaggcuuaccuggucuuuguuuacgaagccccagaugccugcagccaccucacaggcaaacaggaucacaaggcaggugaagaacuaggggaaagaagaggucagagccuugaccagcaagcccaggccuagcccacaugaccaacagcuaugugccaaggggguuggccauauccaccaaccauguccugauuaagcaugagccacacagagccauugagagacaagagccugauacaguccugcacugagauguucaaguucucauagccucaccuugcauccuacuuugcaggauguggcugguguagaaaugcaguugacaaaguguccacagccuucacugaggcacaugcagcaagacacuccccaacccuaaccucaguuuccucaccuccuuuauccuacauucuaugacgugugcugccuuuccccagcuucugauacuggcagcgccucccucccaggcuggccagauucuggcaaaucugggauucagcuucaccagcagcuaguguggccaggagcacuaagguuggcuuuaggggugagacacccuucuggaguuuaugcuuuuuuaaacagaaacccccuuuuccaacauguauauucauacucagauucaauggaaaucaagccccuaggaaaaccaaaaccuuggggaagacauauaaguugcuaggaacccugcuccccagcccuucagcccuuucuacuuaccguccccagcagacacugggacuccuggauggccccauagcaccccaggaagccuacaaacaucaucacagcucccacagcaaugagaauguagaugccuggggaagggaagaccugagugagcaggcugcaugaaucacacaggaaggccuaacucacaaccacagcaggcagaguuuagcaaugugcgccguuuaugccuccgugugcugcuggaggagcugccacugccaccaggggacaaagcagcaauucagugaccagagaacauggguggucuccauuucacagguaugcucugcucuggagccagucucccaccaccugcaucugagaacaggaacccucagcacgcacuguaaagggcugagacggacuauccguuucaguuaggggaaguggcuugggugucaggagccaaugcccaagacucccaauacucggugagugugaaaucaaggguaagcuauggcaguaaccaacuccaggcaccucaucucaggaacacugguguauaacuguuuggcucaccuaacucuaaggacgggauccuguguguggguggauggcuaagagaaugguaggggaagcuuaagcagagcacccaaugucugucacaguuuacaggggagcacuguagcccaugagguaccaacugggccaugucccugccucagugcccacaauacccccuucugccccugggaaagcccacugugucuuugaugagcguuccaucucuuggucccucggcagaagccguccaucccccagucuccacggcaacacuguagggcaguccaagcuuccuugcacaaagucaggcccauuguucccugccuggccagaccagaggagaaggcaccauggccuggaccugcugccagacuuaaaaauaggccaaauccuuuggccucacuaaacacgucugguccggggaaggccucccaccagggcugccuagaaacuguuuucccccuugccucccaacuggcagagcaccccaguugucaggcccuaaaaccccaaccucacucugucucaacaggaggcucugucucaacaggaggauacauacagggcacccaacacacaggcacugucccaggacuuucuaggcccuaggcacccuccuaugucuagcacaugucucaucugaagccccugugguguugucugggauguuuagcaagcucugaaugaacucuccuaagcacuaaauaagacaccuuuuucagggccacaucugcuccuagagggacucaguacaggggcagcauggggcuccagaaagccaauucagauuggccagggacauggcagccagaguagcuucuacccauagguagaagaaccugcuacaggguccagucccuaagacuauuuccccaguacccaggaggccauaaccagacaggcagguggcugagccgcucuggaacuggagccugguauagacuauuaugagaacauuaggauagagacuugcuuccuaaccacccuaucugggcucugcaggguagccagccucuccugccauaccugugcagagugggagcacagccuuccccuuguggagggcccaccggccaguucuaccccugucugucucugauucccagauuucccuugugaagaugccuaccaguugccacaauccaguuucuaugagcuggagggcauccuccuucucugaagguaccagauagaaggagggauagcuagugugggcccuucccuacuaacaaccaaaccugaaaacugcuaccccucauggcuuuccucaaaggagaccagguucugccccugcccauauugccuggacuccacugcuguccauuuuacccaugcuaaggcuguggacagaguauagggaggaaggaaacagagcgagccaugggguaaccaaaagcccugucugcucugaggcaauugggcagaaagggagaauauuucagaccuccuggucccccacucagccucaagcaugccucccaagccucuucuaggcuccacaggaggagaaggaagauccacaucagagcccugaugaagguaggagcuuuggaaggguaaagacaucuccaaauacuucuucaguucucaggacaccaggucccucuuccagggaggaaagaggaaaguuuucuccuucagcacaguguaguggaccagagcauaggaccacacagcacaacagccaucaucuuacuuaggagggaggguguucagccccuacaggcagccaaauaaggcagguguaacagucugggcugugugcugguggggguggggugggguggggugucugagucauucacugucggcccagucuccagcccuucccaacucaggacuccuggagccucagcuguugcuagcccaggcauccugccccacccugcccagggagguucacuagaaaugcccauguuaaaauaagcaagguccuacaaggccccugccccaccccguugcuuccuuucugccuagucuagucucagaucuguggggucaccagcagcaccacagccaacucauucuccucuuauaggcagccucccuacccagcucauacuaggccuaggccacucccagcucuaacgccucacccaccagauuuggaccaucagccucuucuuggaagcccucccugacuguucugcacugugacuggaacccgucuccuugguacucacccacguagaagguguugggugccgguuuguuucccaguuccagguacagcaggcugguggucuguggaucaugacgcaaccacagagcuacaccuaggaucacgccuccagccagcuagaaaaaaaaaaaaaaaagaaagaaagaaaugaaaaccaggaacagugucauauagaggccagaguacuggggccaauggaagccuacaaugcuuaucauguagagcccucacuuccaguuguggagccagaugccaagcaguugucugagccacugccacugagcccugggucccaccagcuccucuugguuguaacuccagaacagaauucaaguguaccuccaauagcgcaagacacauacaagaaguuuggucugaaaaauauggcucaguugauaagaguacuugggcauguagggagcccuggguucaauccccaguaccacguaggguuugguggcaauuguuugucaucccagcacuugagagguagaggcaggaggaucaggaauucaaggucaugugaguuugagacuagccugggcuauaugaaaccuugucuccaaaaucagcaggaaacauccccccccccuacuguuccagauugaccaacuaugcaacauuuuuaccguagaaauggccacagugaggcccagccacucaggaugcuggugggcucuccucagguacccugucccaacaguccugggauugauuagagacugcuucaggcaggauacugggaacucugugguggagacaccaaguccucaggggugaccaugugaugccaccaggccccgcagagagaagcaggu

SEQ ID NO: 29 - RNA, 339789 nt, Mus musculus
guguguguguguguguguguaugcgugcagaugcaugcaugccauaugucaucccuugccuugcccuguuugagacagggucucuucuuugccaucacauacacuagacuuucuggaacuugugcuuccugggauucucuugccuucaccucccaacuuauuguaggaguauuaagaucacagauacacacuauguauaguuuuaucuggguuccaggacucugaacuugucuguaugcuuguguagcaaauguuuuaucacugagccacugucccuguuccuaugaaggcaucuaacugacacccaccaccuucuuucugccuaugucccuacccagccaagccuccagacacauuaaucuguguaucaucauccauccaucuaagaguucagcagccuucuccagaggagcagaacucauagaauauauacauauuaaugagauuuauaggguugcuuacaugauagguaccaaguagucuaacaaugaccaucuacaugcugcagaacuaagacccagugucugcagagcccaggaagucagucagccaccucaguaagcccagucugguuccaaucagucuuagaagaucccuggagaaucacugcuguucaguucauguuggaaaaccaaaguagcuggagucugaagucaacagaggacagcaacagcagugauggacacacuugcucaggaggaagaagcaagggaaaguggccauugcucuuuccuugggaccucuuuagaccaggauuacuuucugguguggauccuccccaaucuuaauccucucagacaugcccagagacaguucuccuaaagcgauucuaaaucuugucaaguugacaaucaagacuaaucaggccauucacucacugaucaauuaaucgauccauccauccguccguccaccuacugauccauccaccgauuuacccauucaucuaccauccaucuaucuugcuauacaucugacuuaguuaggguuucuauugcugugaagagacacuaugaccauggaaacucuuauaaaggaaaacguuuaauuggggcuuccuuacagauucaaagguuuaguucauuauugucaugauagaaugcaugguggcaugcaggcagccauaaugcuggagaaggauauuugggucagcaggcaucagcaucaggaagugacagagacacugggcuuggcuugaacuucugaaacaucaaaacccacccucagugacauacuuccuccaacaagaccauaccuccuaauagugcuaauuucuaugagccuauaggggcuauuuucauucuaucuacguaucaacucuacuacuugucaccauccaucauccaucuaauuauccaucuauccuuaugucuaccaacucaugccucuaucucauuauuaccauccaucuauccauucauccuccuguccacuagcuauucauccauuuacccauuuauacaucuaucuacccagauaacaccauccauucauccaucccuccauccauccaaucagcugacuacccauccauucauccacucauucaucuauacaaguucccaccuacuacccacuucccaucaccauccaagcaacccacccaccuauaaagccacccacucauuucucuccaguuauucacucauagucaggagccucugugccuagacucauagaggugaaucaacucccuguuacacgaugcccacacaugggaaugucggcagcugcuucucaggcucugggucacauaagggcuggggcuggucagagcacaugaguggcaugugagguuuucaugugcuuccucccuccaucuguacaucucacagaugugaucuguaucuccugaauuggggccuuucugucuauuguuccagccuuccccacaguguaacuagaagcagugggugccuagaaaauucugccagcaacugagucguuccugccuucucuucuguuccucaguugcccugccccuguucugggcuucagccuuguguggggucauggugguuuggcauggugagcccuccagcuguguugcccauuugauaucauggauacggacaaaaauucugacugggacugcucaccauggcauuggauuuggcuagaaauacccaauacauuucuauccaccaaguggaggcuucguggcuuagcaaaugucuaagauggaguacuguugggcuagaggugucagggaugcuaccagcuaagggauccugaguguagugggcugugcuuuugagcaggcuauuaccucaugcucugguggaggucugagaccuuugaggucccggggcugcuccuaggauaccacuugguaggagaggagugaauucuguggcagauggugguagcucccuggaagggggcccuucaguauuugcuagaacugaaucuaucagcauaagccaagugccaacagcccuccugccuagaagugcuuuucaugcuuagauggggccucagggguauguguggcuuucuagagaccugagcaagaucuuaggcagcuuuaccacaggucucaacuucagacuaaaguaagcacuauguaagacuaaaguaaguucugauaccucacuagcacuggcuuggugcuggugagggaaugacaggguaucauuugcagagacagccuggucaccaguuaacccucacacaacuuuguuaaauuguguauaacuguggccccauggggugguuccuggugccuuauugggcugcuggucuccccucugaacacauccuucccacuguguucuuaagagacuguccuuggagcagucacaaaagggagcucacaaaaggcuguuugaaugugucugacauacaugcacacugcacacacuugcacacaacccucaguauucucagccgguuaccagcuuggcaucuuggaagaggagaguguggguggguguggccuauggguaaggaguggcggaaugacagcaugccuagcuccuucuauucugcauauggacuggcucagaaggaaacuuucuucacaaaugacuguccagccuucucccacagagcagagcacaguggguucuuggugcaccuagugagaugacuucagauacagugugcgugggagggaggauaagauaucagggccaaaggaugcuggacaagcccaauuguuuuuguccuaccgacucuggggucccuucaugggagggaauagcaacaccaccccaguguuugcauagagaaggcacuagaugccccuucccaggcuggagagcaagcugauugagaggacagaucuuuaugugcccagaugaggagaggacaccccagcaucugccuguaagaugcaggagagauggaaguacagccuuacugcugccuguuccauccacaaggauagacaauagucaccagugggggggaggggcuacagagagauaucagugguucacagugggaagcuccauuccucauacccccucccuccugccuccuccaccacccagcuguuuaagauugagugacuacugcaugaagagagcuuugccagcaaauucucccccaggcuauguaggcauagauucuuugcaaccuacuuuuaauaagaguucaacgucuccucuagucuaccacccagaagagguaguggaagagaaaaguuauuaggaugugggggaaguggagcugcucagcaacaguucucugggggugagccugaucuucuuuggcagccguucuguccuguagccaacaccaaauaugacucagcagcugcagacaaguccucuaggcaggaagauaccacacacaaacccauuagcuucaguccaguccuuucggcaggcagacaucaggcacgaacuagcagcuauagugcaauccugaaggaacugcaaggcucaccaaccagcccaaggagaggccaugaaggcagcaagcuguggcaagaaccccaugagcagcucuugggcgaguuucucucaauggcagcguuaucacaaguugaguucaauaaugcuauauaaggcaaaccaaugcaugugugucauuagagaagaagagugaugcagagcuucuccuccacugucuguggggccaaauacauacuccuucaccaaagguccuuucauguguuugcuauaucaaaaacauccuuucaccugugugccccagcaaaacaucauuugacauaacuaacuuuccaaagacuagaaguuuccacaucagggcuaacugaagcgacucuguggagacacuuugagcccuuaauugaguguucuaguuugauuuauguuucugugauuuaacacugaccagaagcaacuuaagggaggaaaaagguuuauuucaccuuccagguccaucauugagguaacucagggcauuugaagcagaaaucacagaggaacagagcuugcugguucacucagacucaugauuaacaggcuuucuuacacaguccaggaccaucugcccaggggauggugccacuacccugagcuaguucuuuccaaaucuauuaacaaucaagacaaucccuaauagacaugcuaaaaggccagucuggucuaggcaauucaucaauugguguuuuguaucucagguaauucuagguugugccauguugaugguuaacauugucuaggauagugggcaccuccagucugcucacuauuuuugcucaacucuaccuaauggcuccauggcagugcauacaagauuuuaggauugaaugaacuaauuaauuaugggaaauuaaucagaaaaaaagaugacaucugggaaaccuuugggagucagacugcuccaacaggccucuuggcugguagacucugguccuuauagaagacaucagcccuaguuuuaccgucaugauagucucaaacgcaccccccccauuguuacccucugacuucaccagaugaacgaggaguaagugggcaagggggugcagaugaauuggcaaagaguccuuagagagucagcauguaaaagggcaggcaccagauuucuagaacauuccaaggcuuggagacagguagugagagggugaucuuccaggaggcagccugaugggaugugugcacccacucaaugacuguggaagugggaggugcuuccuugauaaagcaggaguccggcagagagcagguggcaccccagagucccauacccagaguaacagaccuccauggccuaagcaaucuacucagacucuaccacaagagaguuuucucuucuuggcugaugugccccucaaggauccuuacccacuuccacagucgucauggguuuggucucuucaugauacccacccauaugcaggacuuuuuguguuuccugcuucggagccacuagauuuuauuuccucagcuucaacuucagucccacccugagcccagccccucuuaguuccgugcucaacaguauaccuagaauaccuagagucccucucuuugguucccacccuguucuguuccccccaacacacacacacacacacacacacacacacacacacacacacacacacacacagagacauucucuguccagcuuuuuggagagggcaaggaccucauagcagccccuugcccagccuccucucugccucaguguccuucagaacagauuccuuguccaggguagggcaggcauccccaagagcccuaaaccaaccaaaccaaaccaaaccaaaccacacaacaacaaaaaccccuuuauuuguuguauguaaaugcuuguaccauggcauguguguggaggucagaggacaaguuaggguugucuguucucuccuuccauacgaaucccagggaauacaaccuggacugucagacuugguggcaagcaacuucacccauugagccacaucucaaagguccuaggagagcauucuucuucuuaucuucccccaggacagaccuggacaguuaugaguauauuuaaaaaaaauggaaacacacaugaaaguaaauagcucaguauaauucgugcauucacuauaguuccaacaauuccuaauucagaggcaguaugguuuaaucugcaccugacucccauccucuuccuguugaugguuucaaaacaucagacuucuauccacacguucuucuguguguaaccuuuggcaggcauggccuccucacacccugaagcuggugcagagaaggcaaggcaggccacaucuuacccuacccccucucauuuucagaacaaagagccaagcaacaguccaagggcaacgaggacuuugcaagucuuauuaugaacaaacuggguuuuaggauauuaggcaugcuucaauugauauauuuguuuguuuuuggagauaggagcucacucuguaaaccuugaacucauggcaauccuccugccucagcgucuuggauucagggauuacagauucgagucucucugugcagcugugcugcuugaauucugcucuugcucagacuuuuccaaguguguguguuugggggguggaguuuacacaagcauggguauauauuuguaugugguggaguauguguggugcacaagggugugugucuguguguacaugugugugaaaaccagaagacaaauuuuugguguuguuccucgguggcaguccaucuugauuuuugagacaaggucucucuacaucucugacuguccuggaacucacuguguagaagaggcugaccuugcacucacagagauccaccugccucugucucccaagugcugggauuaaaggcacgggcuacuaugccugguauaugucccacauuuuuauguggguucugggacugaacucagucuucaugcuuguccaagcaagcaauucaccaaccaggccauccucacccugaucuuuccaaaguuuuuagucggauauagcuguaaaguaaucuugaaaggaaacaacagaggagauuaugguaauauuuuaaacucacauuaaagauuuguuuuuacuucuuugauuuuacaucuguaucuuuuauaucuugguuccuaagagacucaaaaggauugcuuauuugauauguaaacauauauguuugauuuguucagacagcuggugcugcaaaucuccagguucugcaacccacaccagauggaagauauuugaaaaacaaauuacuucuggauuggacuagcacagcucuuauucuuuccccaacaauauaauguagacuacuccaccuaacauucccauugugcucgguauuuugaggaaucuagagauggguugagcuacacuggaggaugcacauaguuucuaaacacagacuccccuacuuuacgugaaagacuugagcacugagaauuuuagccugggggucaucuggaguaggaaccuaccaauauuauuaccuaugguucaauuauuuuuuuccuuuggauauuagugauaaugacugucaugaaccuuuauuguguggcucuguuagaguauaagucaaccaacagaaccgcaauguguuugucuuugugugugugugugugugugugugugugugugauggacucacaggugugugaacaugcgcuugugagcauuugcagaaggcagcagagggucucugguguccuauuauaucacucuuugccuuggcagggucccuuguucaaccuuagaguuugaguuuuucaguuaggcuggagccagaagucccagagucuuugccccccgccccacacacaagcaugcagagggucacacuuggcauuuauaugagugauggauucuuaacacuagucuucaugcuugagaggcaaguucucuuaaccacugagccaucauuucagcugcuuaucuuuugcuaauauaagccacguugcaguaagcacacagguuuauaugcuuauguauucucucucucucucucucucucucucucucucucucucuccuuacauagcccagguuggccuugaacuuacuaugucggugaggauggccuugaauuccuaauacucuuguaaacuccuaccucucaaguacucagauuacaggugugcuccaccaugcccaccuucaucuucuguuuuucucguuugucuuuggguuggcuauuaguggugggauuuccaggucaaaaggcacauacgcucuugcuaaggcugccaagaugcccuucccacgggugauuaggaaagcaccugccacccuggccucucccaaagauugugccgucaaacaucuggaguuuugccaaucagauagugggccgcugguaucagaguguacuuuuaauuugcauuuucuuauuaugagugaggcugagaauguuuucccccugaggcaccaaggcugcaugccucuuucccuguguucggauccuguuuucagcccacucucccacagcacuggcugcggcagucugcccaggcuuuagaugguccuuauguaugaaugauuauuauuaauccuuugccugugguggugaaaacggccuugucuccuaucuccuacuuccccugcggcaacuuucugcuuuaucugccgcuuccggauuucacagcacaguuggaaauguuuuccuuagugacaguuucuugaggcaggugcucuucccccacauccucaucagaccuagguccuugcauacaccaggcacacacucuaccucugguuauagcaauggccccucaccuuuguucuuucugcacagcuuucaccaaagccuuugauccaccuguucucguauccuuccaucacugcgauaaacaccaggaccaagagcagcuugggugaggaaaggguuuauuucagcuuaccaauuacagcccaucuucaaaggggggccagagaaggaccucaaccaggaaccuggaggcaggccugcucaauauucuacauagcaccaacucccaucaaagaacucauucacaaccaaggaaguugagcagaaaacccagaggagcgcugcuugcuuguuuguuuguucucaggcucaugcccagcuaccuuucuuauauagcuuaggcccaccugcccaggaaacagacacggcccacagugggcugugucuucccacaucaacuaagacaaucaagacaaucuuccucagacacacccacagucuaauccaauuuaggcaguccuccuacugauucccuucucagaugacccuaggcugugucaaguugacaacugaagcuaacaggacgguaucugaaaguuauucuugugaguggugugagagguggguguggcggaucacaggagaaugggauuuuggaauuguccugggaugcaggugcccuuccaucccacacaaaggccaguguagcaagagccagcugcacaaaccuucugacuauccucacaccaccacgggacauaaagcuccuucugugucacucuggagagguacaaacuuaaagggaguguaaacauguaaacgcucaggcagccccgcgggcggugucuaccuguaaaacccgcaaucuagcacuugccuuugaccccacucuuagugagcaccacucuuggucuguucccaucuccuccaucccgcugucuuaugggcugcgauuaacuacugggaagagauuuucgcauucuccgccgccaacagaggcuucuggacacccaagggugcucaguguccgcugggcuaacacuuccucauucugugccggaaaguguccaugcguggccugggaugcccuuuucugccucccgcucccucucuaggguagguucagauagcgagaaaaagggugcuugugauucgugguggugguaucugcuggucccagguuggaggacccuagagccaagcaggcgggcgguccucggggugcggggaagcacgugcgcccagcaggugcgcccagcccggaacgcggagauagccugacuuggcuuggcggagcagguaacccgcuggcugagcaaggccgcagguaggcgcgcgguggcgcccaggggcggggcguccugggggcgggacaugccauccccggggaccaaccccgcccccgcccccaggcggagcagacagcggccccccguggcugggcuggcagcaguggcuacccgcgcugcgcccugcgcucugcgcugccuucaccucagcuccgaggagcagcggggucagggguccugucuggccauggacacggccucguccccgcccagugcugaaaggaagcgcgcggguuggagccgccugcuaggcgcccggcggggcagcgcgguggucaagaagugucccuucucacuggagcuggccgaagguggcccugagggcagcacggucuaugcgcccaucgcgccaaccggagcccccgggcucgcgccccccaugucgaccccagugucgcccgccccggccccugcagaccucggcccacguccgcgggugagccuugacccgcgggucuccaucuacagugcgcgccgcccgcugcuggcgcgcacccacauccagggccgagucuacaacuuccucgagcgccccacggguuggaaguguuucguguaccacuucaccgugugaguaaccucccugcacgcacgacucuuagggcuggugccacuaugacccuaggggaggcaaggaagggcuaaucacagaaagcagaaaccagacugagagucggucccuuaaacucagggacucugcuguggcuuguggagggggacacuugcaguacaccaaccuaggagaucccccagggcauucacuugggauagagggacagcgcuuagauguuagucucuacaggaggaguaagcaagcuggaagccgaccuuuuggugugggucaguugugacaagagagacucaggagccuccaggagugacuggugucugugugcaagcccauccaggccuuggcuggugucugugucuuaggcacucagagcaacaggauagauuagcaggugcacugguguugcccaagauguccacagggagugcccacagcuucaauaacccaggcugaugaaagcaggcuugaugcccugagcgagcccaguagacauuguccgagaacagcaccugcuuuagggaacaggagagggagcugagcugcaccuggcccucacugcuaccagguggcucuuauucucacaggcugccugagaggggcagggcacuucauuuuucaagggcagggucacagaaagucaucuccaggaaugggcuggcugcccuccuugcugccuccccuggccaccucgaggcagcacuuccuggcugccuaguuucuuggugcccugccagccucuggcucaggauucuacucaaccgaccccgcagcuaauugcuuuagauguuccacuaggugaccuccuuguggcuagucuugccaccugggcaggggaggaccuccacugguuguccagaggucuguuuaugccucugaggcacagcaagaaccaggcucacaaaagugaauucggauggcuguuugccuugcaaagggagacgauugcccaggguauccagggcaagucucuggacacccuguccccacuggcauucuugguauguccuuaaggccacccaacccccugccuuaccucccaaagugccaggaccccugaggcuucauugcuggucuuucgaggauggaggcacugcauguguuugcagcaggagugggcuuuucucagggcauaaagaccccaaagggccuuaaccuuaaccacuguaggaaugucuagcaaacauggcuugcugcuuucuauaacuugccugcuggauccuaagaucccugagaugaaaggugcuggagaagccgcuacucuguuaccuuuuugugcaggagccccauuugccaaggugggcagccuucagacacuugcauggaauccuccuggggaugcaggucauuagaaugagcguuguuaaguuccugacucugguggccuggaccugguggaggaagagggcuuguccugccccagaggaagucugugcuuacacugugcuuucuuccugaauuggauuguucagcccucgggaaguuugcucagcagagcuugccuuugcccagccuccucaggagccaggagccaggagccaggagccaggagccacugagcccugguggcuucuagauugguggucuaagaucuucuuugucaaggagagggagagagaugcuagcuccugagugguggucggugaaucuugcccagcccuggcugcccauggaguuuaguuacaaagagggagggguaaguaagcugggaggacccugcuggguacagcaugugguuugcucagacacuagggggagggaucucaucuccaucaccuucaggaggugggcaggacccucugggucaggcaguuuccagaaaagagucauggccagcaguugggagccuaacaucuuuauaaaauguguggucaugcugguugucccuggugauguucuaagaagcaaauguggcuggcaaacugugagcuccgcacuugguaagauggacccuuaaaacauacagggaugguucuguggcccaaaggacaagccugcuuuugaaaagcagggcaugaauguguggggguggaggggguggaggggugagagccaguguccugcagucucugggguaugcuuucccacaugcguauggggaaacagacccggacauccuggccccuccuugggggaccccugccuuggcccaaguagagcggcucuuccugugucugugcugaccuccccugcuugacagggucaggacacugguccccaggcacugcccucugcugcuuggguucccaccccacccccucacccuaauccuaucuuguggcucuuugaguucccauagagagcagcccccuuccuagccaaggucacagggguccagcugccuugcuguugggccuuggccaggguugggggcagauguuccaaacuaucuacucugacugucaagcugcuuggagacccugguugugaccaacagagggguuuaagagauacuacccaccucccucacuuuugaaccugaacuugaucauccugucucuauccucucacaguucuggcuugcucaguucccugagaacuuuuugguggcuuuugcuaguaccucagggaguugaucgugaguggagcuuacagcuacuccugguagucaaaugggcuggccuuuuugauugcaggggcugcaguguauugguuaugacucucauggaguggccagugggcaauuaguuagcagaccuaggaagauggcugucaggaugauggggacagagcagugagggcuguguagaugaccaagucuuuccuucugguuacuauaaacaccucuaccuauucuucaacccuagauaaaauuugaagcuucuccacaugccaucuccucuggggccuggucccuuggugucaucagcuaacucucuuggcaucuugacuuuccagguacacauaaccccucaaccuguccucagacccagccuggcauuucuguguacacugugugccuguguguggagcacuucaucuugguuuguucugaguuggguggccauaaacaucccuuguggcaaggcucccagcuggguaguaggaagagacaaucccauggaacuccgaccugaggaagagccucccuacccuggacaugagggcauggggaccuaugccaggcuaagguaguacugggagcugcugaggcagggaagaagcccauggugucacaaggacagggcauugucaggccagcugcuauggccucuguuucucagggaguuugguguuuagagcccucugguggcaaagguaguguccagagcucaugcuuccugggugugguguccccuuugcaaacagugcuuacuuaacaaagcacagugcaggguggcauccacagcaggucugccuagcagugaggagagcugcagcugucucuaucaaguggcuccugaguaauaagaugcacaguucuggucauggccaguguaagggccccugcuccucccacccucucucuucugcacccuuaucuaggaaguggacccugauuagccccauggucccuccuggcucugacauuccaguccagcuguugccuccuauguaccuugcugugauucauuucccucuucaugagauugacaggcuggggcagacaccagggcauguuccaggaccaaaaggaguccaggugguauggggauggguggucugucccaaugaaagguuguagagaagcuucuagaagcucuuaugccucugguagggagaaugaaggaaauuaagugcuggccacaggggccacuuggaugcugaaacuaaggaauaguugcagagggaaggugcaggcccuuuugacacuguggggaagcauaagaaguaauagguagagcaggagguaggcuguggcccugcagggccuuagggccaaagaguaaguggugcuacuuaauagauuaugccaucuaagcucugcucauccuaccugaggcacucagggauguauccuccuugcucuuccucaugggaaucccuuuucauaaccccuuggagcaugcagagccccagauuucugcaagccucagagaggagccagugguugcucuaucagcagggugacuguggccaucacaagaccugacuuuucaugaggcuucagagcccgugaaaggacugccucugugaacacguuaucuucugcuguguggcccagccccguucccuggcccugcccagaggccucuugagagguggaggggacuguagcaguggcucugucaagggccugucaaauauggcuacuugcugugugcaucugggaacccuggaacuuggagacaguagcuuaucugccuaaggucacacaguuggcuaugcccaagaauccaggagcucccuccucauaaaccacacgcugaucaaaccaaguaaggaguggauugcuauucuucugggaguagagucucugaauggaaggaucuuguccugugggaaugaguuggagucugacaugacaaaugucagacgcaauacacacucugucaaauguucagaagcugcuuccuccaggaagccuucccaggcacauaugugcucagugccucugucuuuguccccuugccuugccuugccuucaagcacauaaagaauccauugguaaaacugucugucugucugucugucugucugucugucugucugucucucucucucucucucucucucucucucucugugugugugugugugugugugugugugugugguguuagcaaguaucuugauguuccugagugcuaagaggccauacaggcagggccaccuagagcugucuggcuccuuucaaaggcuuucuucaccuuuuacuuuaccccacccucacagccugggcuguggcaacugcugccuggaaaacucuaagccccacgacaggccagacugaugacaucugccugcaguauuuuuauccaguggcauuccugagcuugagaaagugguggguagaugcaaaggcugccagagggcuuuucaguggccuggggauaguccugagguuccuacccauuaauguucuaauaaagccagggcuucugucuuagcuacugcccugacugagcacaggcagaucugagguagaagcacucacauggugcuugcccacuuucuggcuacuucuuggaaaguccccaggucugguugugggaacugagcagaacacaccuggaugugguuccagaaagauccaggcaaaggcauuguguccuggaaaagagaccauuuguaaaauugcccaccccauccgucuguagcaggagugagugaaugaguguguguguguguguuguguguguguaugcacgcgugcaccugaguaugcucacuccaauuaccuuagaaguaauaagaggguuucagaucucugggaacuggaguuacaggcaguugaguuaccaugaggguguugagaacugaacccuaguccuaaccaagaacaacagguggauuuaacuacugggucaucucuucagccucauauugugucuauuucuaugcuagguucaugcuguuuugguuguucaagcuaugaagcauuguuuguuuuuaaaacagggucuaauguaauguaagcugaccucagacucagacuauguagccaaggaugaccuuagacucuugauucucccuucacuacaucccaacugcugggauuacagaugugcacuaaacacccuguaauagauacuaucccaucuguuuuaaacccuagccucuccuuucugccucagauugaacccagaaucuugugcaugcuaggcaagcauucugucagcugagccacguccccagccugaggauauuuucaaguugucuauuaugcuaucuucagcauugcucuuugggaaugcaauuuccugauccauuuggguucuucuguggccccauaccaaucuucggacuuauuuuuaguccugugaaaaugccacugauauucuguuaguagcugcauugaaucuguacauugcuuugugccgugauggacauuuaaacauuuuccuuuggagccacaaacaugcuaugaccaucuucugcacacucuucaauuucuugucauuguaauguucacuguagagauaucugccuuuuuaguuacccauaucuguccuuuuguaucuaauaugagcaggcucuaucaugauuuuaguccuagcaaguuaguggucagauauggagcucuaugaaguuuuaaacaugcauuuuguucguacaucuuuguuaacuucaaugaccaguucuaacucucucucucucucucucucucucucucucucugugugugugugugugugugugugugugugugugugugugugugugagacuuuguggucucccauguggucuauacuguaggccauucccugugcuggugagaagguauuuugugaacaacuuguagauccuuuuagucuauaguguauuuuaacuccagcauuuuugcacugacauuuuccuggacuacuuguccauugauacaguuuguccuuaacugucauucuguuagauaauguuucuccuuugagaucuaaugggugcaggaauucaccuguugacuccaucccuuggccaggcuucccugucucuauuuagucuuugacugacaguugacuuuccugauguaagugugccuacugcuugcuuuugcuuucauuugccugaguuguguuucccaucccugaacuuucagucuccguguuaguuauuuuuaucacugcaaugauauaaucccugacagaagcaauuuaagaaagaauuuauuuuggcuuacaguuugagcuaggaaaagaccagagacaauauuuguuuuuucugagcacuacuugaagccuuucuuauaggacuaaucuauugaugaguucuuuuaguuuugcuugcuuuagaaagacuuuuuuuuuucuguaggauaguuuugcuggguaucauauuccugguugauggguauucauucauucauucauuuccuuuuaaaacucuggugguaucauccuauucuuuccuggcuuaaaaggcuucucacuguuaguauacugaagauucccuuuuauguaacuuggcacuucucucuuacuauguuuggaauucuuugccuuguauuuuugguaguuugaugauaauguuccuuguaaaguaucuuuaauuuuuuuuuacuuuauguguauggauauauuuugccagcauguguguuuguguauaacaugugugcagugccugcagaguccagaagagggugcuagauccauagaacugaugcacauucugauguggauacuggaaaucaaacccaggcucucuagaagagcaggcagugcuuucaaccacuaaacagucuguccaucccuguagugcuuuugguuguaucuauagggguccuuagagcuuccuucacuggcuuaaaugucuguauuucacccaaaaauugugagguuuuucaguaauuacuuuguaaacaauuuuauuucugcuucuuccugucucuccuuauccugaaacauccacaauguaucuguuuacucacuuucugcucuccuauaggucuugaaguuuuccuuuccuuuugcauaucuuuggucugacuuuccuuuuuguuagacuuguauucaggcucagaaacucuucugucugaucuguucugcaucaagacuccuaauuguauacuuuacuucauauaucuugcucuuucaguccagauccccuaccccaaucuggccuucugcuaaauuucucauucauaucacaaaacaaaaauuuccuaauuucuuuauauuaucuugcuauaaucuguuuuaucauauuaaguuucuuuuaaaaaacacuaguuugaauucuuugucaggcaggcuaucuuuuuucucuucuuugggauguacugcuagagaauuacuaguuccuuugggcuccuucgauuugcccagaggacuuuacgauguaguguucuccagcaaggagaugcucugcucucaaccucagguguaccauguucccacaggcacccucucucugccuggccucuauccauaagccccaaggaagcacugcugauggcuguuccuuucccaauacuaggugcuaccuuauaucuggccaccucaucuauaaggagagaccuuuagguuuguccucuaugcuucuugcugguggaugccuuucucuguacccucuuuaaacuauguucuugggcaaaucgaaaaaccacucagaguaacucuccagacaccuccucauggaacuugcaauuagaaagccacagucagugcuggagcaguggcucagucauuaagagcacugacuguggauccuauggacucugguucaaaucccaguaaccguuugaugacuuauagcugucugaaguaucauuuugcugggcaagcgguggugcaugccuuuaauccuagcacuugggaggcagaggcaggaggauuucugaguucaagcccagccuggucuacagagugaguuccaggauagccagggcuauacagaaaaauccugucuugaaaauaaaauaaaacaaacaaacaaaaaagaaagccacagucagauuuccucagcugccuagaggcccaagccaccuccaacuuucuucagguuuuaccuuuauagagaacccccuccagcagcccagggaccccccacuuuaucuugggccagaguacaauuuuuuccauguugguugcagcuucccaagaaagagagacccuuauucccauguuuccuucaccaagauuccccauccaccugacaggggagaaccuggggcccagaggaaguccauuugugccuaagcacucccaagaagugaugugcuuagagcuugguagccaaggcaacugagccuuaaaaauccauauuaggaaaugcagcaucucaaaccagauguccccaucaucagauggcuaaagcacaaaauagucagauggggcucacuggucacgcagcaugcugagaucacuuccuagugggccggagaaacaguuauguggggagugccacauggacacgugccacaagggaccacacccagguuuagggugagucuuuagugaaaacaucaucauggcgccaggcuuguaggaacacaucugcaaucccaaugcgugggaggcugaggcaggaggcuuuccacaaguugaggccagcccuggcuacauaucaagacauugucucaaacaaagcaaaacaaauaaaaauugccuaaaagacccaggagaggagaaaugaucaaauccuuguuugcucccucuacuggggauugucuaaauauaacauauuguaagaaaggaaaaaagaccugcuaaaagcugcaaauuuguugugguguugauguguaugggggcuguuuguuuugcuugcuuguuuuuugagacaaagacuuccucuggcuugccuggcucuagauagguaagaccaggcuggccucaaagucagagagagucagcugccucuguuuccugagugcuuggauuaaagauguacuaccauacugagaaugauucucaacuagaaaauaaaaaagaacagccccuuuggauccaaacaaagcaaguguaccaagaggcaaauguggacucucacaucuacacagucacuucuucaggacaaaugcaaggcucccagaguccaugccaugggguggcauuguuucucucguugcucugaggcuauuuacuguuugugaguugugggugagggcuagugcauaguuaucaugacaacaguuagagggcauugaucccgaaucggcuggcauaugaaugacaguuaucaguauucguucacuaugauuggacuuuucuguuuucuggaauggcaguaaacaaggucuccucagaagcugugagccuaccuauccccaaauucccuuaacucuagagaucuaacuccuagggaauggcugagccuacagccacagcaggugcccaagucauuccuggagcaggaggugaggaaauggccaguggaugccagggcacagcacaggacuggagaagacuugaaggugugucuuguuggaguggguccgaaugcauugcagaaacucagauccccaguuguccuagugacuaagggacaggaccuuccaucucuuucagagaugaauaggugauagcccacaacucacccagcauacaccugucuugcuucccacuguaacaguaacggggaaaccaaagcacugaagaggucccagcuuugggugggggguuggggggagguuccuugccaaauccugcuaaugucaaaagccccucagggcugaucuacaccaucauggguccuggugaaaucacagauucggccuugagggucucaguuaccaacuuguccaaaaucuagaugggugggacagcagguauuggguagaauuguucaaccaggaccuacauuggcaucacuacuggaggaguaaaugagcugaguacagccuccugaucaagcuuuugggaaauacuguggcaagaggagcaugcuuuggugcucaugguggaauugaggugugcaaguuaagauggaggggaccuguaggccuaaggaccgaaauaugcaggggaggagagauggguagaaggacugggagaguguguagcaugugcccucucuuggguccugauuaaacaaauugcaaaacccaguuugagauuaccuugcucgaggguaugcuccauucugcagugggugucaccuguugggucuaugucugcugugugaacuggcucugcccagugagagagggugagguggcuaugauccuucuguggucaguucccuugcucccugaggacaggaugccaggaaaaugcagggauggagcagauagacugaggcuuaugcccagugcucuagugcuccuucaugccagcccuguaauauuggcagggagaugggaaggccaggcuucugggaauacuugaagggaccuaaccagaauggcccaucguaucugugcuuacaaaguuguuauguggcgaugagcauaggagcugagugcugccuggaauuggcccuguucaugugaccuggaacucuggaggacuaacauuggggagcuaaccagugcucaggagcaguagcaugcccaccuggcucagagaguugugaggagacaggagggauguagaaauguuagggcaagagucaggggaggaaaaccagagggcuguuggugaaccuuggaagauguacaagcuuacagcuuacuuacagcugcccuggcccugcuggaggcccccaggaauguggggguggggguggagaucacauuucuaagucagagaagccaccugacuuuggcugaagccacuuacauaucuccuauggucuggugucuaucuugcacuucuugcuuuuuugagacaggguuucucuguauagcucuggcuguccuggaacucacuuuguagaccaggguggccucgaacucagaaauccgccugccucugccucccgagugcugggauuaaaggcgcgugugccaccaccccuggcucuaucuuauacuucuugaaagggaagaaaugccuaguguuuuucaacuuuccauacagcaagucugugguccuaucuguagacagccaaggcuugcagcugccuucagugcugaccugaaguccagcgaucguugucuggaaagugggcaaggauuccccaccccuucaacuccuccucuccugucaugcuuuuacuuccucuauuucuccccuucuccucccaccuuccauuuccuccuucuccccuucccaucccccuccucuccucuuccuuccuuuccuacuucccucccccucccuaacccuucccccaccucccuuuaccuucccuacuuccuccuccucccucuucucuccuccuccccccugccugaaguuuuucacuugguaacuggccaggcccuucccaguuuccaaguaaugaggcaugcauaaaagucuuugaggugguuuuuguucuguagggucacuccuacagagucccucucucccucucuggggacgggcuauaauaucauggugcuuggcccaggcacagugaguuugcuguuuacuccacagguccucuagaggacagccuggaguggauugcuaccuguugucacccacaugguucugccccuccuugagcagugagacugccugcuuucagacaguucccucuaugcaggcgagagucucaggaaagccuguguucuuguucuguacccuggcuaggugauucagggcugacagaauccaauauggcuugccuuccuuccauggcucagcgggggagcuguagucuacacaccacaucuggguccuagaauugcuuuagccagaugggcgugguuauucuuugugagaaccugaaggccagggauguguacaaaaccacacaggaaauuuggugucuuugagucagaccagauugaacaccuggcuaccaaugacuggcagcacuagcuucauaguucaggagcccugccugguacucucacaaagcucucugaucccaggaaggcugggauucacugagcacccagacaaguuguggguucaccuucuaggguucuguaugcaguacacaguggagguuuccagagaaaccauaaaacccagauccucccagccaaguagaaagcaggaaauggcgagugacccucaagugaccuagucccugggaagacgauagacaaaagacaggcccaggcagcaaaggcaacaugguuugccuguguuucucugagcagacagauacaauggccaucuuucuggggggacucuguggaagggaaucagugguacagcuguggaacuuggucucucaggugacacuggagaacaggaagucuucauguacacagagcuggccucucgccuuugcuggauugcagaauguccucuccugagcaaguaguaguggcaggcggcaguugagauggguguggcaccaucccagagacuucguacugggguuguguggccugggaggucaccuugcuuuggggcuguuuccccacauguggauagggucugggccucuaucucagggaugcuaacaggucaugugaucaugcguuugggcuccucaucuugcuauguaugaccauuuaaaggcccccaaggcuacccucucacugcccaacaccucugugucucuggcauuggagggaguuauuucuaaguggacauaugaacuagucaucuccuuguaaauguugagaauauucuggaaauaaggucuguagagaggcaguucuccagagcuuagaggagauaagcuauggcaaccauauaagcugaucuggaguagggcugagacacgcuugccucuaacucuguccagauagcuuccaugacacucacugaguaggagaggcccagaugggaguccauauuuccaugugugcacauguguguugggugggcaguguggcaguccacaaauacuaaauggcuauuucuauguggccccugcucccaaguccggcuucuagggcucaggaaguuggaguguuagacuaucacaggaugcauggguggaugcaugucuggaucaguggguguguugguugauuggaugugguguuccugugaagaggaaaagauggacaaggguauggguguguaugucaggggcaggggugucaugucaggguuacuaucuuucuuguaccccuccccugacauuuacacuugccugggagugagugccugggggagagcucuggguuucuagaaaggcuguuccuggugaccaaaagcagugagcagccucucaggcucucacugugaucugcaggcagcuguuguaucccaccauguccucagaaaacccuuuccaugagagagaaauaugaguuucuagggcaccaguggaccagucucacaagagaacucugggcguggguggccuggcaggugagagccuagcaggccaaagaccaggguagugcaauaguaacagcaagcugagagguaaaaugaagggaagaacuggccagugguucacaggaacacaaaggagacucuccaccaauggcaugggugacgggugcuguaaagagagggcagaaacucuguccuugcaguugggccagacccgacacccagaauccuuccuaguuagcugagcagcuaugaagugucuuaguuggugaggguugcaaccgacuuuaaaucuguagcacugccggugucacugccggugugacagcugugcaccagagagcuaagggcagcagaaccaaugcaagggccacagggaaccuccaggaaaugucucaaccgccacagagaaagcacgggagugguggugggguuccaggggcccaggugugcauuuugacagaacaguggggcuggcacucugucccaggcccaucccaugaucuugggugaccuggugacaccccgcuuuguuccugggacaccugauccccaccucacuuggccaggagguaaaacacaagacagguauacaaagggccuuugagaagucccugccaaccugugcaguaaugaugguuucccgcuaaguguaaacuugcccucucugucccagaccaaggucccuggguuagcauuuuugagguguggcaccuccccaggcuagugagaauguucuggcuguccuuggcacaagggcugggguggggaguuaggggggagacugggggcucugcggcuucccagcuuugguucccaggacggccccaccucuacugugcuuaucaaggcuucccuggcuggcugccuguggccucaaagucauaccgcccugggcggguguccuugggcaagccagccucuuccaggguuggggacaaauggcugucaugugugggguaugcuuaagugccaggcaccuauugaacaggacacagacaggcucacagaaguucagggguaccaggcucacacaggcaccuaagugugcucucacugugucuccuggagggccucagcuggaggcuggggcaggaacuagccacugcaggggccuguggagguaucaacuucauccuuggucagcauauacuccuagcuaagcaacuuuucaguguaugagcagcaccuggggcuccugacaaagugaacuggcugcaagauuaacccaaagccgcagguucugucugcagggcacugugaauacugugcucagacaagggacucagggucaggucagggcaugugaaagaaacaguuagggcuggguuugacacucauggaaaagugucccucacuuugguaagugacaggaugcuuacccuggggucaggauacauggucaucuaacauggaaagagccagaaagggacauuaaagaaucccuguuguguuacaaaaaaaaaaaaaaaaacaaaaaaaacaaaacaaaacaaaaacaaaacccaaaacaaaaacaaacagagguauuucuguauuuuggauaauuaacagcucaccauuaaaaaaaaaaaaaaaagcuaauaagacaccugccccacccccauggugguggggaguguuuccugauauuuuagguggaaaacucuugacugaaugagcuuugauccuugagagguguugggguagggauagauagaugcuugaaggaggggucccauaggcuccuggccccaaagcacugucucucuuugggcucugggccugaguccuagguccuauccuuagggaagucugggguuagcaugaugugcgugggcagagcuguggucugaagaaagccagcuuuucuuugggacuaacuaguacaugcuucauaccaggaggaccaagugaucucuggggaucuggaagccugggggcaguugaggaacagccuaggcaggguggggcagguagcucacaaguaggcuugaaacuaaagggcagguaccauucuaaaggcuugcccagagauacaggguuugggaccccaccucuuaccuucucuuugucacaagggacagaaagagcagugcacccucccaggcagugauaggaucgcuuuauccagaggcuucaaaggaaagaaaguguucugaaccuaaauacuagacuugugcuguuguguggcccucuccugaguggccagccagggucacaagucccucaucuggauagaaggccugagguucccugugcagccaaaugcugcucucugcccagcauguagcaggccaucugaggguaugagccauaagggacuuuggcccccaccagggccccuugccucuauggcuugucuuagugagggacccagggcaguggcagaagcuguggccuuagggccuacuggguggcccuuugucugauacagcuuggguagcuuugugcagccccacccuguccccacucacugcucaggagaguacauugcacaagcaccuguuuugggcagacugcugccccgguggcuuguccagcuaagacuaaagcagguuuucuucacaacccagggagccucauccucugugggugaccucagcagagccgggcucaagccagaggcauuucccuacacuggggaaacuggccaggccugugugaggaugagggaguggauucuacuagccucucuuccaggacagggcagcccuguguuucccagagcuucaggugaaugcaggguagccuagagccucucacuggucugcuuugcauccugaugcuggcuggguaggcugggaccacgccauggcuggucacaccccugaaaauagggcuggcagcauuccugagagccugcagggagcugggcucuaccagauggcuccagaucgugaccugcuggcuguaaccugauccacccccuccccuggagcucugcagcuacuggguugggccaccucuuuggaaagucagacccucuuggggaagugcagaggcugaacggaagaaagccugauggaaccugcccacuuauagcuggcccagggggacucgaaucuuucuggagccucuugcuuaaggcaugucaauucacagcguggcggccggccgugguugcuggaggccacacagacaagcucaggcccagaugucccauuuuauagcugucaagacugagguccagaguagaagccuucaaagaagaggugacucuuugucgaggguucugcuuucguggguauuguguccauguggaggugguugauuccccugccuaggccagagaggucuccucucggcaggaaagucugggggcucagaagcagaauguggugaugggccugaaaucaggguaagagugagggccuggcuaggguuaccauggagacagcggcaggcuuucugcugucaucccuagcugguccuggagugugaacagguggcagcuggcccuucuaccuggccugggaauaucugggcugggucaccuucccccaggagaaacuaccccuauggaucuagagcuccuucggugagcauggggccagcagcccgcuggguugugagaaugcuggccaguaucauuucaggccagguagcagaggggcugggcucugugccuagcaguuacuuagccucuguggaacucagcuauuaaugggaucuggcuucaugauggucuaguucauagaggcagcuucuucacugccaaauggugacauugucuauugugaugagaguccaguguggaguuaugcacccaucccugguagaaaccaauaacagcccuccccacugugaccauaaaacgugguagaugagacuccagcacuacugggugaaguugcuucuggagccccuguccauggggcacucaugggaagauuuaaaagugaauacaggagccaagauccauggcaguuagaagcacuugcugcacaagccugaugacugaguuugaucccugggacccacguaagggagaaagagagaaccacacgguuggaagcauaggcuagcccuguggacagcagagcugggauuagcaguccccacuaaggaucugauuacaggacaggauccauucaacuucauacaugcuagucagccugcuuccucauccauauuguguuucucucucucucucucucucucucucucucucucucucucucucugugugugugugugugugugugugcacacgugcgcacauccucacuuucagguacagaccuguggggugcagagcccccagaaaggucuguguauauugggaucagcuaccugcacuugggcaaaggccacagcucagcugcuuuguaagcugagcugguuccugaccucucuccucauuagauccugauuuggaggauagagggcuguguugagaguuucuggcucaacaagcacugugagcguuggguggggacuaugggaugggaugcugcugugugacucaggcucccugcuugugucaaccuaacuaggcugcuguccuuugcuggggcccuucaucauucagaguguacggggaccauaccugcccuguaccuccacuugccugaguagugauuguccuuguuuugaacucagcgugguggcauucugcuuucaggagcaucgugugcacugagcauggaugacucuauggcuccuaccucuaucucagcuucagggcugccauccugacacucagggaccucaauaccuucacacagggaugacacaagcagacagugacucgugaugcugagccauggacuggagucuucccaaaggccuuuccaucaucauccccuaauccuggccuuccaagaugggcaccuuccaggcagagaggcacaaguucucacauacccugagauccccuccccagugaaauccaaggcuccuccucacagagcugccgcagagccuucagaaagcucuaccuggggcugaggugcccagguaugcacaagcaguggacauggguguccagccuaguccuaucacaauagugcuggauuugggacaccaaggugcaauuguauagggacaaccucaggagguagggaagguggggcuacacagaugcucagucauuacacaagguuccaauugaagguguaagagcuugagaggugguccaaggaggacagacagauggcucucagccuuugaaacauuucuguuuugcuguguuagcucucuaggugcuuuccccacccaaacaauagagcauugagucagaauaucccgacucacauauuagcugguggagggauccagaggagcucugaggacagugggcauugaggaugcagguagguguauugacugaguaucuugccuucauggggcagcuuacuguaguuucugggaccuggguagguaccaagaagguagauaugacuugucuagaugauuccagcucuuggaaguaugaugagcacugaaucacaugcuucaugcaguguugcucaugggaaugucaccacagccucccuuucacagaugaggaaacugaggcaugugugcucagcuaguauuagccaaaacugguggaaacuuaguuguuuagcauugaagauuguguguguguguauggaagaagccaauaucagcugucuucuucaacccuauccuccauagauuuugaaacagaaaucccucacugauccuagaguuuacccauuaggcuagacucucugaccaacaaguuccagggguccacccaucucuaccuccccagugcugggauuauagacacaagccaugccuggcuuuuuacaggguucagaucugaacucaggucuuugggcuuguguggcaguacuuuaaccacugagcccaucuuucccauuggaaaaagaaauucacuuuuuauuuguguguguguguguguguguguguguguguguguguguggucagaggauugcuggcucacugggcaaucaguucucuucuucuaucuuaaugugggaucuggggaucaaacucagguugucagguuuacauggugagcauuuuuacccacugagccaucucaccagucccccgauauuccuguuuaggaugaaucaaauuuugugguguacuuuguaaauaaauuuaauacucuuguuugcaaaaacaaagcaaaacaaaacaaaaacucaaagcuauuguguggcuuccuguuucauuuucugguuucucaucuuacagguccuugggacguuuucuaggcuguugagagucacagagcuguggacaugugugugcaggucuuuacauuuauuuauuuauuuauuuauuuauuuauuuauuuauuuauuugucuaaugggcuuguaugcaugcaugcuacagugugugugugugucacaugacaacuuagagcugagaagcauucccccugccacagccuucucugccaggaugacugcacaucucaaaccuugaguuaaaauaaacuccuccuccauaaguugcuucuuggaagguauugauuggaugagggaguuaacuaaugcacacaucauaauuccagucuuauuccuaaaaaaaaaaaaaaaaaaaaaaaaaaaucaggcauuuagcuacagauguagaaaaaguuccaaguuugauuugguaagucauauuguaacaaacuuaaaagguuugcgacuuggugguuuccacacauuugauugauaagcuagagaaaggucauauaaccccugcaguuccuuuucugagccaaggaacagauaacaauugugucacugcccuagucagagcccaguggugaugccaccccugauguaucugaacaucucccugccaaaugggcacucaugguuuucuguuaguucuucugaucaaaaaaaaaaaaaaaaaaaauccagaaaugcucagcagagaacauuggggaauuucaaggaagacauuaacauuaauucguuguaagaaaagcuaucgaggcuaacuggagguccuuuggugauuuuuucuaugugacuuguuaauguaagugguugcacaauuuuuuucucuucuuuuuguguguguaugcacauacuugaggucuuguguauacacagggcacacucugauuuccuuucuuugcuuuaauuaucaacaugauacagccuagaaucaccuggggaggauaucuaauagagggauugcucagaccaguuuggcauguaggcaugucugugggggauugucuuuauuauugauguaggaggauccagcccauuccuuaggcaggugguccugggggucugaauaacaccauucccuggcagccuauauaagaaagcuagugagugugagccugugagagagccagcaaggugcacuccuccuuaguuccuaccuucaggccucugccuuggguuccugcccugacuacccucaaugaugaauugugaccuggaaaaauaagucaaauaaacccuuuccuccucuaagaugcucccagucaaaguguuuuaucacagccuuagagaaacgggaaugauguugaaccaggaggcaauuuuccaaaaacugcagcucuuuagcaucaucuuccugguugugucucaguuucuccugaggaacugugggaguccaugaccuguguuugagggugaggcaagugaacugagggacagcaggucaucagagcagcaggagacacucaucagcacuaggcacacuagcaaucugugucugaacauucaugcagacauuugaggaaaucucaaugcugggccuuugcuuugaccugcuuuuuaaaguuuuguuuacauuccugcaugguccuugccuuuccacuguggucuugauguagcuuguuugacucucuccuguggacaccuggaccacuuccucacugacuauuaaaaauagcacucugaugcaaauccucacaguucaacaggaacucaggauugcguccuugggcaucaucugcaggagacugauaggaucaaagacuucccacggcuuuaugacucuggaacccaaagucacacuggccugcaggaaaugcccugaccuaucuccacccaccuugugagacaucauugacgucuaccucuaaaacuggggaucaccaccuaacacuucauuaauuugaugaagacaaaauuagaaccucaggguuuggaaggaaagacucagucagcaaagugcuucugaggaccagaguuugauccucaauuuacauauaaugcuggauguaguggggaugcagaggcaggggaggauguuuggugcucaauggucaaucagccucaacaauagaugagcucugggcccaggagagacccugucucaaagucugugugcagcauuccugaggaugaaucuccagcuuguccucuggcuccaugcacacuugugcaguacaccccacacaccugaguaugcacacaugugcacaauuuuaaaauauagaaucucacugaauauaguggcagaggcaaguucuuugugagucugaggccagacuggucuacauagcaaguuccaggccagccaggcuacauagugcaaguuuuuuucucaacaaacauucagugaaggcacauugucgauaugcuucuguuucauguccuauucauuaccaucccacugcccucccauugggcccuuggaauugugggaaagcugagguaaugagacaagaaagugauacuccaaggaguagacacagaugcaaacagauaugcaggaagaggcaagacccccaagaaaccacauacagggcagagugggaggaaaccaagcauccuucuggaagguagccaggggagccaccaccucaaccggggucaauagaggaggugagccauucuuuuucuggaaaagcucaucaggugugcaaaggcccuguggauguaagcuugacaccugugggagcagcagggggacagggcuggaguagaugggcugagggagguaggguuaggagagaaaggugggcaguagagaugggccacuggcuguggcucagaccaccaggaaauaagugaagggucaaguaacaggugcuaagauuugguuucucagcauccguacagguuucuuguuuuuguuuuuuuuuguuuuuguguuuguuuguuugguugguugguugguugguuuuuuguuguuguuguuuguuuugguuuuuugagacaggauuucucuguauagcucuggcuguccuggaacucacucuguagaccaggcuagccucaaacucagaaauccaccugccucugccucccaagugcugggauaaaggcgugugccaccaccgcccagcuguuucuugcuuuuuauuucaagauaaaucuuggcuugagaauguuccaggguaguguagaguucuccagcugcucccauagucucagcaaauucuaucauuuggccaugugacuaaagccaggagacugucaccaguaagugacuuaugccaucccaccaaaaauauauuuuucucuuuugcgaucucuaccacagacagguuuuacaucugccuuguuuccuaccacucaugaaagcuccaucuuugucucucaugaccuuggcauuuugaggaaugccagcuguuggcgucccaugccuccaaucugauggacucugugaucagauagaaauugugaacuugcaggaaggucagcccaggagcugcaguuugggucccaggaguauagcugagcagggcugcuggacugugcuguccccucaugugucacauugacuuuggcuacccugugggggcuguugugccaacuauuuauccucagaaaccauccuggggcagacaccuucagacauacaagucagacugacacaggacuucuguagaucuccuauauuuuagauuuguuuuauguguauggauguuuugccugcaugcaugucuauguaccaccugugugucuggugccuauagaaacuauaaaaggacauuggaccuccuagaacuggaguuacaguugugagcugccgugugaguguucgguauugaauccaggucuacaagacaguugugcuuuaacuacugagcuauuucuccugucccgugugugggccuuaucugugauguucuuucuggaauguuugcugagcagggcaucuguuucccaguuuccuccugugucucagaauugagggucucccuaaaagcccuccagcuacuuucccuggauagauucagaucagugcaaccuaaggauauuuacuuuauggcaaacacuucaacugcuauuuaauguuuguucauuuguuuuguuucaauuuggguuuuguuauuugguuguggugugcugcguguguguguguguguguguguguguguguguguguguguguuauaauuaugugugguauauguauacacguguaaggucccaaagagggcauggggugagugcguccucuaucacucuccagcuuauuccuuuaagacagaaucucucaccuacccuggagcuaggcugguggguagcaagguccucugauccuccugcucccuuuauucccccauagcacugggugucacacucauguggguuuuggguaggcacugggaucugaagucagguccuuauguuuccacagcaagcacuccugcucaugaauucaucucuccagcccugugggucuuguuuuguuuugagacauaagagagugucucagguaucccaaguaggccucagaauaauuuguguugcccuccucucccuccuccaucucagaguccugggaugacgggguguaccaccaugcccagcucuguacucuuuauuucuguuguucaaauacuguggcuuuggcauccaggucucuuagguaacccuuuaagucacaugguggcccuguuuuaggguuucuguuuguuucuauuauuucuguuuuuguuuguuuuguuuuaacuuggauccugucucuuauuccuaaggcugcagacuccucugggauuuucccugucccaguccaaaauccagcucuucucccaguagagcuagguuccucguauuggaauccaguccccuaaagccgagcuugcaacccccuaccccugccuuguguuauuggugggaacacugcagugugccugccuucucugcucugugucccuuuccuggaugcaugaauacauguaugcccucguacugcuagcucaauuccaggcugucaagacaaacuguagcagcugcuucccacugugugaauggcuccuggcaugaagacuugcuuguugggucccaacacacacacacacgugauaguuccagguugccacuucucuuugagcauccaggagggugggcacccaaugucuguguguguacagccuucugccauuagccucaguguacccuggaucccugcuggcuacaguggcucugcucagguugggcuuccuguccccucccccccccacacacacuuggugugacccuauugggugcugcauuggcaugaggcuggugauucauccuggugccccauccugaguggguucagggcuugcugauuuaaggaugugaguaaaggaagugagacacuaauguugaaggugcucagaauucuauuucgccugccuuaguuacucuuuguuuauuccggauacuaagcucuuauuagauagaagauccgaaaaaucucccauuuugucgacauugccuuuugccacacaacauuuacauuuucaugaaguguaaugaaucuguuuucccuguaguggcccaggccuuuggugucauauaaaauaaaucauugcuaaauuuaauaucaugaagcauuugucccaggcuuucuucuaaggguuugguaguuuuagacuuuacaugcaggccuuugguuauggguaugaaguguaagagucugguguucuucuuuugcaugcagagucccaguuuguccggcaccaccugucaaggagccauacauaggcuuugcuuucugcucuucuugguuaguagauggcuugcauugguuaguugagaucuaccauauuauuuucaggucgccuagugguguagggcaugcauauucaccucugugugggcaauuagauuuuucuaguagcugccuuagaagauaaaguugcgggcuggcgagaugcucagccgguaagagcacugacugcucuuccaaagguccugacuucaaaucccagcaaccacaugguggcucacaaccacccuaaugagaucugaugcccucuucuggugcgucuaaagucagcuacaguguacuuauguacaauaagaaauaaaucuuugggacagagcaagcagggacugagcagaguuaaccagagugaacggggucgaucggagcaagcagaggucccaaaauucaauucccaacaaccacaugaaggcucacaaccaucuguacagcuacaguguacucacauacauaaaagaaauaaaucuuaaaaaaaaaaaagagaagguaaaguugcgaaguauaaucucauuaucuggaguauuuggacaggguuacaaaccacaacuguguagguauguaucaguacaguggcaaccuuguuacaaaauauagccuuacaggcacacaucugggagccugggcucuccaggauauccuugaagacuacacuggggaucugcggcagauuggaauugaguguuccacacaggaacagcaauggguccuggaauaagcauccuuuauguuagacagagaaugaagauugcaggggagguuaguaagcagacuccacagacugugacucgagucucauauagauagccuuacaggcccuagaggaugacccuccuccuggcuuccaguauagagacuauuguacaggugggcaggguguuuuuaaggagaaagaccaucauauuccuaguuccccacgagaucugugaagggcugaggaugguuacuuguucaguuucuaccccaauauauguccaguaaacacuuaaagucaucaaccaaggagacauaccugcaguggggagagagggucauggaggaagacacacgcaucaugacugugagucauguccccaaacagguuugagcaauggucugggaagcuucuaaauggggacuuggagguucccaaugagcagauaccacuguacuauaggaagcauggcuugaaggacagagaaaccaccaaagguuuuuauuuuuauuuuguuugcagcguaugugcguguacauagggcuguacacaugugugugcguggagaccagagguugaaaucaguguguuccucuaucacuccacaccuuauuuuuuugagacaggaugucuuaagaacugaaagcucguccauucaucuugaucagcggaccagggggcuccaggaucccaccugucuaugccuccccaguucuaggguuauaggcaugcauagccauaccugaauuuuuacauggguccucaggguuugaacuuagguccucauccuuguguagcaagugcuuuauauccugagccauggucuuaaccucaaagguuuuuauuuuaacagcauauguucauuaacuuggcuuggagaaugggguugaugagagcccaagguuccuaucccaguuguaugccuuccucuguuccauggucagggucagagucucugcugccuggcaaacacuguccucuggccaaaacuggucugcaacaggaaggcuggguccuugagccuggggaucaguggucuggagaggagacucaauccucagcccaaggaaagccaggucuugugcagaaggcuaucccagaccaaaggcagcaaaauagcaguucccacuuauauacaaggggguauuauggagagcucccacaugugguggacaugcuggcauuccugccucaucuucaugucuggacccuuuccuuugcuucagcgcaugccccauucuuguucugucaacuucuggcucuggguauucaagagacaggaagaaaaaaaaaugagggggcucccugaaggaaaggagcuugguggccauuggcugagcccaagguaacagguguaggcaggggugcuggaggggucugaggaauguggcauagggcaggccuuggggguucuaaaagacagccacugcaacaugcucuccaauguaucccaacaccccgcacacauaguggcugaugguacuucauuggacagcagccaucugcagugcccaccaaacuucucuguauuuuauuagccugugagaaucuccuuccuucugacucuguuaugaaaggguguccucacccaucacacuuguugcuacucuggucucuagauguccagggccuuggcacaugcaguuaauucuaccuggaucaccugucuccagcucuaaugacacagcuucaacauugcugccccaugaggcuuccuggcccaccacucacaugaccucccuuguugucucuggccuaucauucguggugaccuagcccuuccugagccacuagucacugugaccucaucuuguguuuuucccauuguguuauuuguuaguacaccccuucccccacaguauucggugucuauguugucgguuguugcaucuguagagccugcaugguacacacacaguugguacuuucuggguggagccauuuaggaugacagccgagguguaccaaaggcugaguuccuuaugggcccuugaaaagggguggagccaggucuggcaaguagcuuuaggcuaaugccuuuccuucuaaagccgcagcauuaccagaaggcacugugaagugaaaacaugauaccaauugccaccugucuccaaaagcuucccagagcuaguguagccuagccaggugcagcuguccucugugugcagggcaguguuuaguuagguccagggaauuccacagaagucugaguacugggugaguaucauuuaguccacuggcuauggggcccuguggccagagcccccauguaggaugaggacacucagccugaaggaacucugcccaugguaauuauuauugucacugccucacuccugcccugggagaacagucauucucuccacaccuaguacauuccucacuuugaaggcuugguggcuagggguaguggcccuauagaggguagggcuggcaagcuuuuggaaguccccagagccucagagucagggaggaggcacugauguguagcguggccucagccucagcucaacgccaggaaagagcucccaaaggauacuuggcuuucccaggggagggcacaggucagagcugagugugguagccgaggaagaggcucaggaaaugaaguguguccuggccaggcagaggcgggggaagugggauggcuuccugagaccgcucugggucuugccccacugugaugacagaaaacccaggguucagugucugucaugugccagcugggccaggguccuuccagggccaugacacucagugcuaucagccuuuccauacauaggcaugugggcuucagggccuuugaaguuuaugguucugccccaaggcagugaccccaaguacugcauauaucuugagccugcuggggugacaaaagggccuucagcuacucuuggccuuccucuagucccuaggaguuugugucugagggugucauuuggagccuaggcauuuggccacugacuucuagcaaguggccuaggcaugcccauugcugcuccuauuccuccuccugagggcucugccagguuccuucugucugcuuuagugccaccauaccagcugccauguucagcccuugagaguaagcugagauuaagggugggaaggaccuuacuuccucaguccagugaguucuuggucccccagaagcaacccugccagggcccuaguggaugagcuauggcugggguggguggcuggugagagcagaaggccugggaugaggcagcagccacggggugggggucuggcacaggacaguggcugauagcuagggagcccagcaaucccuagugacuaauagauuucacugggucuggccugugaguggaggggcaguagagcuguggguguggccugguuggcucccuaagguaucgguggcucugcagaguguggcuugggguuggacuugaaggauaguggcacauggguaguguuucugcgauggguggucagggaaacugugugucugguacaucuccuuugacaugugugacccucuacauccugucccuccccauccuugcccuucacacaccucucucucucucucucccucccuccccccaucccuguagccauauaugcaugucccucauccugugccuugcuuacuguacucucuuguacucuucuaaggaagccccauccaugugcguggucacaccguaaaacugacaaggacacugucccacaugauccugagguccucugucuuauggucgguggugcagacaucugucaagagaucgagacuugccugugacccagaagaacagucccauugaugggcacugccugaggcuguguguugcugaggcugcacugaagugaaugugaccaucuuguuuugucaucagaggcuuuucuugguccaagucacuugggcaacagcaguagaacuccggagggugccuggcacugaggcaggaucucaggaggcugagguuccugauucaggaagagaccuguggcugcucuggggucuccagccugacuggcucuuagugagagggagggguccucaagaagagaaccacagaguugaguggguuuugggccaucagaucuccugagccaugaaccauggcugcagggacccaggauauuccuucuuuguuccaguaugugacuccaggucacuucugaccagggcaccaagaucacucacacaacaucaaggucagggucugucaaguggacaggugacauguaggucucucaaugaaugaugccaggggaaguaagccaccugugcccagcacauguacuugauccucacagaggcccuuaccaggaagggcagaagcugcugagaugugacuguggucauuucauacucuggacuggcagcucuucucccugaaccugaggcuccuucuugucaggaagccagccuauccaucuccaacaguacagcucuacccuagugacccaggcugagguuuugagucaagaaucagagaccaugucuuuguugucaugacaacauguaggguagauccuauccuucucagaguucaguuucucuagguagggcaaagacuagacccugggcucugcauagucacacuaaguauacugucugcugcucaagggcuucuguggggccacuacuacuacuguguuguaccccuacccuaaggggacaucuauacaaaguagcuuuggggaccccgauaaucuguagcucaauugcucccugggugauuugggucuuuguggcugucucuauuugcaggcugucacuguuuggugucauuauuugcucucacuggugcccucugcugucagcauggcugaaugucacuuaggaauuccauucagcuggaaggaggucagggcacaggucaggagauccacucacccacccuguccuaaaagaccccauguccucuucaucagucuccacaucuuagaagccuucugccaccaccaugccuuacaagagagugugagagauggggacugaaccugccuaacuggaagcauugccuguuccagcccuaugauccacccauguggaggggauauuagggguuaccccacauuaucucagucaccauacagcugaucagagcauggcagugcccaaacccuacagagacaacugugggugccuauuccuggagcgggugguagguuaccccuggcuaccuugucaauucucugaacuugggucacccucauagccaaaagccagcuccccuuuguuauggccacacuguuggagucaccuuauugaagguuuguaccaaagaagacaguggaaccugagcagguuucugccagggaugcuggccaugugcccuugaaaccucuguugugucagaucccaggguguugauaccauuauuagaauaucaaugauaugguugggauugggcaccguggaacugucccgccuuuacugaacacagacagcugcugaacagucugauguguuccaguuccuccgugggggaaacggaggcucagagguugugcaauggcuugguggacagagauuccuuaaaaccucuggaauggggcccagaagacagcaagagagacuugagcuugauguaacgagggaauuucccaauaggacugaacugugagaacguagacauauacagguauauggcuggcugcagggauguaucagcccagugaguugccuaaguagucaauacccacuuucugagccagaugaggcugcugggccaacacuguccuggguagagacaucuccaagauacagaggccaugucccaaguggggaauauguauggggagcauguggcccccacaucacgcuggagaaccaugaaugccuucacugacaggucccaagcaugugucauacaagccuguccccaccacacauucuaaauauagucacuauggcaucuuaucauggagccugggggagcaaggcuggguguggccgacggccaagggacacaacacucuagaguacugacuggcccuggccuccucaggucccuagaagaauggcaugcuuccuuacucauaggcuguugguugucuuuggaguacucagccacccagcagugacagcucugagcccuggggugugggagagaucacgggccuuccaccaggccuacuaacuaccuuucuuccagagccuuuccuugaagggccagguguuugggagaugccuggcuccccuucugggguauggcuuuccuagagguuuugagauauuugggaggagaucuauccugugugcccugaucucacuaacuacugauugcugugggacuuugggaagggcauaaacccucucugagcuucucuuuucaauccuguaaauaaaagacaggccaucucuacguaccuccuaaauugacaggaagacauugguuccuagcugguucauuuccuuuuucccauaccugaggcuucugguucauauucuggggguggggggggugccauugugaccucguaagaggacucagaucuguuugcuaacugaauucuuuuuuucuuuuuuuuaguauagaauagaguuuauuuagggcauggggaggggaguuaagagaguagcagaggcagagaaaggcagagagagagggagagaguagagaaguagaggcuggccaugaccacgugaaguggggugggggauggagggggagcaagagggcaagaggcaagggagagaagcaggaauaagagagcgcuagcuaacugaauucuugagucuggcccuauguggugccauccagcugggguagccccaggggcucuuacaugucugaaaacuagcaguuccagggcaggugccagcugcuccagggcaggugcugcaguuucuguuccuugugggagucauguaugucuggcccuacaggcagauccuauuaggcugcagaucuucagacacaaacucucaaccugaguugcucugggauagaggucaacacacugaccaccacaggcucuccgagcugcagauacaaccacuagccacgaagcgcagcugugcucccagcucuucccucugacucuggcuaauguuccugccucccugcucugagcacauuaucugagcauaucuuccccccaaaucuguccuaucccucuaguguuccaaaaaggugugaagguguguguguguguguguguguguguguguguguguguguguguguguguguggugcaccagagguaaaccaaaagaaucccucuucaaggguugucagucuugguuuuugagauggggucuuuuuguuggcccaaggcuugcuaauuaggcuaaaccagcuggcuaccgagucccaggaaucugcuugccucucugucucuccagagcuggaauuauaagcacacaucaccaugccuuguuuuuucaaacaaagguuuugagggucagacucgggucaucaugcuauggaccaaguaccuugcugcucuccccagccuccaaaaaagguuucaaaugauagugcagauggcuugaaccccuugccaaggauggucuucaccuaucugaaugcuaaccuaggagaggaagacuaagacgcucccugagaggggguaacagugacaccauugccuauucuuggggacucugcugaaguaaaguuuggauucugagagcugggauaaauuacgagccaagcuguggacaugugugauuaaggugagacccaggcuuggggauguugccuugccugacaaguggcuugggaggggucaagcuucucugggucacacaugguggugcuacuaggaugggaugucuaaugcuaggugcugcucugaguguuaagggacaaggacacugaguucuuggaagguacuccaaaauggaaaucauguguucuaauuguuacuagcagucuagcugaauggagaguggcuauggaguuccauugacucagugaccugguggccucaaccucugcagccuuuagaaggaccuggcuuggucauguguaugacauaggauguacugccacccuuaaaccuguuaaucuggagacagccaccaaggacauucaucugcucaugaccagugcuaaugacuuggccagcaucaggucuggguuuuguccuguauccugcacugacccaguucagaggcugugaagagcuugccugagcuagagauucagagcaggugcacaaauggguuccguagaagaggaccagagacuuccucucagcuuaacaauugcucacucggucagcaaauacuagacacacacacacacacacacacacacacacacacacacacacacacacacacacacaguguuuuuggccuacugcuuggcuuucagaugugugccagccaaugggucccccuacugggccaagagcuucucugcuagaacagagguuuucaagcaaucagugggcuggaggacaccagacauagauaccugggaagguagggccacucauuucuuaggacucugugaugacugaggaugcugcccuagaauaagggcacaagaugcacuggguuucugcccuguagccuuggggggggugcauaggcacagagguuggggggcucugcagagccaggugaauguccugcuuuucugggguuucuaggccagaucaugggaacagugucagcuggugcuaugaggugaggcaggccucucagugcagggcugaggcuaaucuccugauagguuugcauuuccagaucagcacauuuaagggcucccaagacaauggauuaguacgcucacuuccucggugauaaagucaccacugcugguguuuccuaccagaacauuuuaaugaaaugaacuauggccagagccaggccuaaaaggguuuagagccaguguagucucagggaguaggcaguggcuggcccaggagaaucucaggccuagaagcucuagccauaggcaaaggcaccagccugaggccaggccccucagggaggcaggcaagggcugaccuuguauaggccuaaggugugugggaggcaaaacugguuugggucuccccuaacuuauguagcaccucccacccacaacuugcaggcuuuguguggcccaacacagcuaugaauguggcccucccacaaaucauaaacuuacuuaagauuuuaagauuucuuuuugcuuguuagucccacaguucuguguggacuuuauagaugacaauaugcugccauggagucaaaagguugagcacccguaagcuugugacagcaguaugugcuuuggaccaacugaucuugauguuuaagaauucgugauccucugagaaucacuguugaugggugguuugacguagguuacaugaugaacucaaaggccucaaagauauucuugaagccugugguguggccucauguagacaaagcucuugccacuaaggaugugaaaaccugggcuaucugguauaccccaacccaaggucaacugucccuucagaaggugcccaaugagaucugagugaacaggagguggccauucagauagaggaggugagguagccuagaauagcauguagaaugagguggcucuccuauucugagcauuguggucuguauagccagccugagcucacuguuuacguggcccugugugugcucuauacaauguuggaccuuauucgccccacaaguggcuauaucuuguugucccuaauccaggaacuucuaaauaugcauaaguggauugaaccugagaccaaccaucacuccccugugucuccccuggacuucuuccacccaaggcuuaguuaagggaaacugaucagucucuggcacaccuuggguuuucagcaugcacugaggugugucccuuuaggagguaacccuggccuaggcucuaccuugugcagcacauuggagagguuguguugugagcaaguggcuaccuugaagucuucuaacccugccaacucuauucaucugacaguugcuauugguaccauccuuccugggauaucccuaagccuauuguccccucuaaaaguccaguauccugggacaugucuauaucuaaccugaagccaggcagcugggaguccagguggccaugagggugggugauggcagugaguuaguagggucccccucuaggcuucccuuuccagguagcguaugugaggguuaguguggaaucuuuccaagucacucucuguggaacaauagcaaagucagcguuacacauacaauagcaaacacauggcucagggcucacacauaaggauuuaguccaugggugucgugcauacaaaggcucaugguaccuuagauuuuuuuaguugacuguuucuuggccuguggagagcugcccccaaggggccuuuggauguugauagcuucaauuauagcccauggccaguguacuuagccaacucaauucuauuaucaaauccauuugcuugguuuucuuucuuuuuuaauuuguuuguacacaugugcaugcauguaugagugaaccaaacugguugaugccaaacaagggcaucagagccucuggagcuggaggccacccaacagaggcauugggaacugaaccuuugaccaucugggagagaagcaagcacuuuuggccauggagucaugcccccagccccugguuuucuuucuuaaaucuauuuuaguuguggugagacacaaggccuggcugugucugugugcuuaugccaguagugugaagcucacccacagaauguguagcuagccauucucaccuccaccuccagaacuuucugucauuuuagacugaaacuguucccaaucccuggcaccccauccugccuucugucucugcagaccugguaaccccaggggucucugauccugaaauaugugucaucucaucccuggcuuaucuucccaaguauccucaaguucuacccuuuugugcacaguaccuccagccccagccuaacaacaguuuuagggaacuucacacuaugauuguauaugcagauacaaugguuugagaccucuugagauguuucacugccauguuuugagugcuggaaauuugaugguggcuaggcugaccccuuuaucuggggagacccuuugcuauuugcaugcauagaguacugcccuccucaauggcugugggaugggacaguaucaccaucaggccugugccugagcaggucugguugcccaugggucuagaaccagcucuggcuuuuuaaagaucaguuacuggucaagggccuaacauguauggaagagaucuccaaguuugccauagcuggccuguccguacucccgacacuguuccuugugcucccauaccuucugcugggcagccauacgggguuggcuggaugccaucuucuucuggguucccagggcaccugggcacagagauauugaagugauguccgauaaggcauuuggacgucccucagggcugggcugcggucacggccgaugaguuugauuuggugagagcggaacaagcaggguauuguucccgagaaccuucuguuucauacccugcacagugaacccucuuaggaacauguagucuguaaccagggacacuggcauuuccccgggccucaguuuccucugcugcugcugggggugggggauauggagagcaccuuaugauagccugaccuugcggcucuggguuauggagguacgguggagggauggcaacuguccuaaagaggcaggagugggugaccugggcaucuggcccacgagcuccccaaaggcagggacccuugguucggccucucugaggcucucagcccuauccagggcaggaacagauaaaguagcaaauaagauaaaacucauuuuaucaggaguagauaaaaaauaaacuaugcuauauaacccuuucucggacagcccaaugaguucaaauauuugaagaacuguuuagcuuucggaauacucgaggcuaaaaggcagccagcacaugggggcagauugccaccauuguccccaacuucaagguuccugggcagguuagcaugggcugucuuuggugguuguguugccuagccccugccagccuuguggagaacuaggugguuuccugucugcacuggggacuuaucugcucuguaccucuaccccaggauuggucugugcauccauggccuucccuacugccgugugggaguuacuggagaggcgggggcuucuacacagccuccuuguuuugauaccuuccuuccaagcaguuggaauuuuccacccgaaggcugcagcugcugcccugcuggggcccugaucccccugcagacaugggcaggguggccuaugacagccauuccucucccuguggccuauuugaagaucucuguuaccuugcuacacauaagcucucugguccucaggugcuggugcuauuauauuccauauuggagccgaggcucuggagggcuugaaagaccaaguugucacccuagcaguaaagaauugaaaguccauuaagagcuaucauuggcaccacugugauuccaccugagugaccucaagagcuccaggaaccucaaugucccccucugaaauaggagcuggguuuuagcacggugacacugugaccugucagauucuugagggacuagugcuauucugucaaacuguggccaggugaccggaccuggcuacauugugcccugggguguguguguguguguguguguguguguaagcuuuagggcacccagggaagcagcaggaaguuuucaccauaucuuugcaugugugcugaugccaggagcuugggggcuucucaaagaccuugggguaagucacucccucacuucuaggugcugagacacugagggcugugcacugugccacaacccacaguuccaagaggggguagaccuaagcugcuaauguuccaauugggaaucugaaguaggggcugccugacuaugucacuguggaggggcagccagaaaaggcugcguuucuucaugcuagucgcucucuggcuccauguguaacccauggucugggguggggcaucuacucucgauugccuagagaugagcccaacccuacuucccugccugcuggaaaucaaaacaacacacacccuggauuagugaggccccacucugugaagagucagucugaggagagagcagagccuagucagcgaggaacugagucucaaaaggccacaacggucucugaaagaaguugaggauacauggcuaaaguuagacuucucuagcaggcauggauggacaucuaaucuguggauggacagcagaggggcuccaaccuaaccuaguguuugcuguguccacauaagagccauggcuuccugaggaucugauguggcuuguucagcuuacaaggggcuuccauaugaucagcgccaggagauagaugugggccaacagucaguaugguuaccacuggucaggaggaacacuacugggggaccaaggaggaccugcauguccugucgugcuguucugggggaguccuuaaguccauguggagaguggacaugaggaaacaauacuguguagugcauugggugccaggguuagaggcuggcugcugucagagcucuaggccuaugaggaauucauggugguagagauggggaguggcaaggacugaagcccaccuggaggcucugcuggggccaaaucagaugugugcucuaugugagaauccugguguggguguuggccagggaucagugccaaauggagacguugccuacugugaugugagguuacuauagguguggugagugggguaagaguuugggauuaaauggagguauguauguggugggguaccaagaccucuguauaccaagcucuauauuagucaccuguucugaggaugcucacugccuggucguggcuguaggcacuaggacuuggcagagcuguuuggccauaaguguuguguuuaaggugucaugggggcaggguggguacuggagcaacuucugcagaugauaugggaccacacuguaggaaccugagucucugccuuuagacagggcaguaacaucagguccucaauaccaguaagagggggacaggguaccacuggaguaccacacugggcaugaugugggggaucuggaggugguagaguuggcaccugggccggggugaggaggaacaagaggaggaggcuggaacgugcugugcaucgcagagcaaaugggcaugacaaagagugucugucuugggggaggcauaguaagcuaugacuucaggcuuugaccuggcacagcagguaagagggggcaauggggggggcuuugccuguuggucuucugagccucuaacgguggcugcagaggccaggaauggaugaaaucaaucuuaagaggugugggagaucugaguugugccucucccaggaaaugguggcugagucaggcuacugcugcugugugcccucugggaggcugagccugaggcugguggucugggccuuacauacugggaaaaccugauauaggauugauggaguguguggguuccuuuguugaggacaggggucugugcuggggcccugaugacuuuguguauaccuucucugucugccccucuuguagcccugggacaaugcaucagcuccccacuucuauucugauccccaagaacaugccaggaggguacguagagucucugaagcuccccaaagcaucccccucucuaauaaucugcacccuccccaaaguggaagcaacuuugagggccaccuuggaugaugacacccagggauggagagcuuaguggaagggagacuuaucuucccagugcccuuggaaucagagcaggcagcaacugugcccucaguguaaaagcuaugacuucuggguguccucagggcacagguucaggcugugcuuggccuuccuuucuugugucucccccuuggcuaagggacucuaucccccugcacuccuggggaugaaggcuccuguuuuguaaaaauaguacuucugaacuucaauuguacaccaagguucuuggauauacuggggguuauacugaauaauuggauauacugacccauugucccuaaggccauggccaccaggcuguguaccgucccugaguauuggcugcuuuugagauggcacaguguggcauguucaaggucaguguguauugagacaccaaucuggggucaguccuaacaugguaaaugguucccaucccauggaucccauguuugagugcauuagcuaaggaauaccuggaaaugccagcacuaaagaucuugcaugugggguguugggugagagggagguggcagggaagcuggaucaggcauugaccguauguccccugucucacagcuuccucauuguucuggucugccucaucuucaguguccuguccacuauugagcaguaugccgcucuggccaccgggacccucuucuggaugguauguaggcacccggggccaucaguaaaugucaucacugcaacuggaagagguggaggagggcugggaaggguagaaccacccacuccuggucucuaccacccugcuacugggcuaucagacagggcaauuccccugcauccaugccuaucaggccccugggccguguguugaagaugcaggaagaauagaaagggucccuuuguauggggaauuucugaccuaggcccagagagaggacaggaggacauggguacaguggcacugagggguggggugguucuugugugugccauugcugacugacucaugggcccugcugguguccuagcccaauucuaacucagucacuggggugggccuuucagcucaggggacuuucauguaucauuucuggcaaggccaucguggcaguccuaguggguaccacaacuaccuuuguacauagcucucugcaggccagacaugagugugugcccugucccaguauagagcaauuugaggaauggaauuuccaaauaccagguuccagcuacacuccgaggagcuuggggacugucuugugggacccauguacugugagaggcuuagaugucuuuuaggauuccacacucugugaagggcaugaggacugucucaugugacccugaacucugugaagagccaacugugucuucagggugcccuguugugugugaacucaaaugcuuugaggggcugagguacuguugaucugguagauaugagucccugaaacagggcuaggauccacugaagcaacugaggcagacccuguucugugagggcaaucaagagccaugaggguagacaccccauguaucaccauucucugcugggccagauguggccuuuagaagcaaugcugauggaucuaugaugcuucugggaagauggguggaggccagcauggcugggacuauggggacaagauagcaacaggugguaaagcccagaauggugcagccuagugucuuucugcuugggugcacuuguguuugcuuucugugaugggauguucccuacccuuacagggaacaagggccacauuuagcugcccuucaccuucugcacagggggucuuagguguuucucaguguuaucuauauacagccucugucagcugggcagcuuguccugcuaagucuugaagcacagugguggcugcucagccacacccuuuuaucuuguguccacuuuaucuuuccuuuauggcuucuagagacugagccacaggaaagauccuuuuccuggauuauagagcucucugguccuggccugaguguggugggugccuucuuccucaaguuugaguauucacgugugauacugucaauggcuuuuaggagucuccagggaagcaugaggcaggcacugcucuguuccaucccugcugcucaucccaacggcccccuuucccaaaacuccauaggacacguguuuucacuguagaccaaaucaaacaugaggcuugccugguaguaccuaguucucuacaggccacuggaggguucauacccuacagugagcucuguagcaaaauucaggggcaccuggcaaauuucuuguuccuuacucccaucccaaaagucaaugcauucaauccagggcacaccugguaccaaguauuaacuaugauggcuguggugccagccagcagugugccuaccucugggguugggaugucacugugguuuaggcacaugugguuuaggcagcugcuaacagacaguaacaagcugugauuggaaguuguggucacuagagggcgacuucucuucugaaguuuucugggacuuuucaaugugggccuuagccuaugauguccccacacuuaacagaggugccaauuccuguaccuaugguuccugggcuucaagucggggucagggccucaaguuuuuccagaagcaacauccagccagucugccuauucccuaguugguuccauguggcuggaaagaugccaccaaaucuuagcuggcaucucucugugauguguuagcugauuagccucaguuuccuggaugacaccccuuagucccagaguauaaucuuucaagaccugucugauggagcucuuagauaugguuggggaauuucacauggcccuuguauucccuuauagaaccaagguggggaagagggcccuggguuccuuaguuuuaugugugaugcuauccccacagguuccugucagaauuguucccuugcccaguacagagguggcugcuacacggaugaggucaagucucuggauauguuaugagaggacauagcuccugguuacugcugaggggaauggcccagguucuuuuccagagaacuagguuucuguaguucuuaguuugggacuuggucuggagagccugggccaaaauggcuccuaugcugagaagggccugugugucagaacauuccccugggaggccucccaaguacaagucuauauaugcacuuacgugaauguauucacauaugcacagacccauguauucaaauggacacauuccuauauauagcugugucuucagguaaguguguguuuugucugagcaugugugagaguguaaguggacauuuacauguguaauauccauauuaggccuugugcuugguuuuguguauucuugugcacuugugaaugaaugcauuguauuguguaucuucauguguagcuauguucaugccuacguguagaugguacuguauguucaugugucaacacauguucacaugugugugggccugugaaugcaccuacuccauuucucaucugguagcuccagacuuggggugguuaccccaguaauuuuuggcuuaggcucccuuuccugguggcuucugcugccucccucaggccaggcucuuucuggggccugcuugccaucuuguggcuacuuuuggaauugugaacacagauccaacaacccuaaagcaaaggcaggcgugggugggacccaccccuccuccauucccucagugugagcggguccccacucccaaggcagccccuccccagucuguucugcuucccagaaguggcucuuuguccaccacugugagggcagugaccucauuaccucuuuuguccccuucucguucccuggacccucccugccccacaacagcuaagaagagauuuuauaggacaaaaaccugagugucccagacgcucccugggugguuugggauaauuuccaauuucucccucauggucuucagagugucacacauuuaagcauacacccccccccaucuccaaaccucccuucccuccccaucucucccucccaacugccucaggaccuuugcacaaacacuauauauauccagcaggguugcuuuccuacuauuaggacugaccuccggucaacgcugcacacucccuucuggaacuccccucugcucuuuucugggcaaccuggaugugaugaugggcuucuuugaguaggcucacaucucuuucacacuuuucuacuaugcagagggaggcucaacaccccggcugcucagaguguauauauggaguaggauacagaacccccuucuuuuuaagucuuguucccaggcaugcccccuaaggauacaaugauaccccugaaccucagugucuccaacuguaaaguauagggaugaaaguauaguuggcuuuagucuuaaccuccccauuuggcuuugccacauuauuuuaaagccucucucucccugccgccuccugugugugugugugcucgaaaugcccacagaauccagaagauaauguggcagauccccuagagauggaguaacagacgauugugaacagcccaacaugcguacccaaccaaacuuagaaccucugccagcguagcaagggaucuuaacugcugagccauugucuguccccaacuuugccauguucguaagcuguauccucacaugcuagccuuuagaggccauaccuuccaggauuugagcuggcugugucuaguggcuuacuucagagucaugaccaugguguuggggaagcagaugugaggcuggcguguguccagccuggacauauggaccagugaagaaguguauggcucaaaggaccuuguauauaggguggugauauuuuccuagaagacaugaugauuggucaaaggguuagguaaggaggaguugugugcuguugcagauggcucauggccuccgaaaggugcauguguccuaggcccacgcagauaucaugguuguggauuccaggccucuagggugagaauggcuguuggagccucaggcugggggacauaguguagaaugcagcugcuacaugcuguggacgggaguugggugaaaaacaaagauguuuauuucagccuuugagcuaaggacagggcagccucugacgagcuguggagacaccagguggcgcucuuguaacacacauuccagcagcccuugggccgagcccagagugccgagcgcgggagcccaaaccacagcccgcggugccccacgggggcccagggcaagggagcucugugagggauucugggagcacauuggguaaaugguggagaagaagucacgcgaggcuguguuccccaaccccagcgccgguacuccugccucagcgccuggcuuucguggugccagagcccuguuaucucagccagggccaaggaagccaggcggccuccgagggauuaagcauucugcugagccaggcauauucugugggucugaaaagcuguucuuggagaaaacugggcccugccaggccagggucuggcuagaacuuugaucagggguguuauaggugugcuuggccuugaaacuuguuuguggccccaaggaggacacccccccucccgccgcccagcccccaauccggccucugaaucuagagcaagcuguauguacaucuguagacguggcgcacaugugugugcacgccguguacgugcaagucugcugaaugugcaugcacgccgccaaacccacccaccccuccuugcaauaggagacccuggccaggcccaggugcagggcuguuuuuugucucucaaaccccagcuuguuuucaaaucccacacaaagacagcugcauugaaaaaguccuagcacacacuccagcuccgugagccccacagcccgcauaccagggaacugucccgccaugccugcgguuaaaacccgugagccgcgcggccggaggccugggggaugaggucaucucuccaguuuccucccuuacugugaggcucccuggccccgcaggggcgacccaccucccugcagcuggacccuuccuggcccgcccuugcuuucuguaacucucuuggcaggccucaguuucccaggggcaaaaugagauccggugggcucucugagcccuuaaaacagcccuugcuggguccuacuuucaaguggaacagggucagcuccccaggucccagacccucguucacacucagcagggccucacauguucuugcauucguuuucacacccuuuccugccaguggagacuuuauuggcguuaaauucagcgccuagcuucaugucuuggugcugugucuagguuuugcuuugguuuaguuuguuuucacggucuaucuguuguagagcuugcucuuagcucuccaucuucuguugcuuggagucacagcggguguucuguuuuuuuggcugagacacgccuuggguuguaccuaguguaccguugcugcuugcacuguauuuggccaugugucccacugccuggucuguuguucugucugagaucucuuaugggggcauuaauaucacaccuguuagcugcacucgugagagucaguaugcuuacucuaucccugucccugaagacuaguuugcagccgagggaagaagacuucugcagguugagucacugcugcagcagcacaaggucaggagaccagcagggagcuugaguuuuccaccaccaagcccaagaucugacuuccuguggggccccagcccccugcuuggagagaucuaguucucagggcucuuuagagaugcuguccagcuaaccguguacccaguaguguugccagcucucuccugggcuccuggguccucugaggaaacauugugucccucucaggacuagaacuuacuuucuuucuuucuuuuuuuuuuuuuuuuuuguuuuuuguuuuuuguuuuuuguuuuucgagacaggguuucucuguauagccccggcuguccuggaacucacuuuguagaccaggcuggccucaaacucagaaauucgccugccucugccucccaagugcugggauuaaaggugugcuccaucacugcccagcuggaccagaacuuucuacguccucagcacacaagguuccuauugccccagcugucauuuugccacuuuaaaagauauuccccacgagaugcccaccuuuuuugauugaguuguuuucuccuacauucauugaggaagagaguagcugugaagcuccaacuguguuucaggcugugugcuaaugggacaagggcuucaaguuccuacccagaacucacaccuugggguccuguagacauggaagccacaugccaucugcguguagucccuggagggcuguuggggauaauggaacagacaugggcucagcucugcuuguagcccccagggcauccagaggcuugggggacuuggggguacucucccgaacuguuggugccucucuccaggaagacagcugcucuguggcuuagucuaggugggaggaugucacaccuagucuggggaugggugggugacaugggugaauggauggggcugggcugcuucuaaggaccucaagaucuccaagcugugcaaaaaaagucccacugguugggcacagagcuuauauguccugcuggauugcuagaaaugccugcuauguuggggcgcagcaaagccuuuugccuccuaccugcccagcaucuuucacaugcuguuauggugcccaugagcuggggcaggaacggugggcggaucccaauaucuucuccauuucagcugcuagagaauguagggguuggcuggagugcugaaacccugccugcuaggggcuaagaagggcaugguagcacauagccagcaggcuuguggacuccucugugguuugguugguuguuuuccaaaccaggauagagacuguguggcccuuaaaaccuacagcacguguuuuauggccuucgagaaaguuguccaauccucauucuguucagaaggagaaugugcagaauggugguugcugguaugcuuuauuuuauuguuguuguugucguucugagacaacaccuuguguaguucagaguggcuccaaacucaaagagcucuaccugccccugccucccuagugcugagauuggaggcaugugccaccacaucuggcaacuuugaauggccuugaacuccugacccucuugguuucuaaugauccauggacacuaaaauggcacuuaaguugcaaaugugucuggaccacaugggugugcugcacugucccacacuggucuuugcggcucaggauggcuuguggauacuuugguuucacagugucuuucuucuguauuuccauguugacacacacgacacuuguucuuaguucaugccacuucagaugacucugccuggggccacuaggugguuuucucuacuccaucugugucacuuuucucucucuuuaaauacaucuuguggggcuuuccaaagaugcugggacuaugucccugucccuuaucuuuagaaagucaguguaugcuccuagaagaaggcgcucucccucguuacuguaauaguuggcuuuaauggucaacucaacaaaccuaggauugcuuggaaagacucccagugggggauggucugcauugggcugaucuguggguguguuugugggguaauugucuuaacuaaguuaauugaugugggaagcccacuguggaugguaggaccucuuggucugacugguaggggagaacugaagcugagcacaagcaagcaagcaagcaaguaugcauucuuugcacucugcucucgacucugacugaaguucccacuuggacuuccccgcaacaauggacuguaacuuggaauuguaaacugaaauacagcuuuucucuuccuuuccuuuuauugcuuuuauuuuugaaaguaggaugcaugggacauaucugggaggguggaaauggcaggucaggccuucucuaucacaguggacacaguuuaggagccauggauccuagguccucagguuuaugggguuuaaacuggccaucacccugcccuggaggcagcggcuuccuuuuacaaggccugcacacuguaagagcaggaaagccagcauccucagcugccaccagauuuccugagccuccuaggccuuagcguggagggucuugcaggacauagcucuggugucugcauccucugugaaaccagagcgagccgugugcaguggcaagaaucgucacguagcacauuuguucagaaccggauaaaauccugaggagccuggggcagaaggagaggacaguaagacauggugggaaccuucuagaaggaugccacccauuccucgcuaccuggcauguggggauuaguuggaggcuuccaggcaggguggcgcgaaugcaggcagggccugccugugguuggcucuguaggugcaaagccauggccuaccuggguuugcagggccugcuuccuguuucucucccuccaggcucuucuccacacccuuuccuggugacucugagcccaaaggggaagagaagcaugugcuuggcagcagggucucauggccucaagaagaccccuuggcacuagcucucacuguucccuugugggcguguggucaguuuccacuccuguacuacaucuugucauggggacagaaucaaugggagcgacccucucaccccccccccccgccgccuccaccccaccccaaaucuacaguucuguuuuagccccaagaucuaccuuccugggagcuuaccauucccuguaccauucaguuaggagaucugcaaggggagacugagacagcaucaggauaaugcucucucucucucucucucucucucucucucucucucucucugugcgcgagcacacacacacacacacacacacacacacacacacgcgcgcgcgcgugacucauguguaguguguacauaguuuccuggcccccucccagggccuccagguaucuggguggucuuauacuccccucucuucacccccuacucccccugcccuuuucuaacaauugugcugacucagcuccagguugguaaguagugauaaaucagccuggguggccaaguguggggcucccagggguuauuugaggguccuggcuuauggcaggguuacauggggcucccgugucgguaggaaaggucuuucuguggcaggagccuccuguccuucuaaaggaggacaaccguucaggagccaaggaccccaaggcaggcugguuccuauucagacuccaggaacuagggguguguguuggggugaggguaagggggguacugucaucaggcacugugcuuucagugaccuggaucuggcuggggcccaaggaggcuuccauuccugagaucagaggguuuccuucuccaccauccuuccuuuaggcccagcacaaaagucagaccuggggugggagcugccugcugggggugguucuccacucggguuuagugggauuagagugugccggccagggacagguguuuccuuuaugcucugcccaaggcuggacagagucuccucagugagugcugcaugcggugggggucuccaguucagaguagcuggggggggggguggccggguuuuguuaggcccuuguuuuuacaucugacccuggccagcuggagcacuucgcuuuaagugcaggcuaacagcugacauaauauaguggggugggcugaguaggcugcccuggcacccccucugcaguggggcaccugggggcugcuugggggcugcguuggggguaagaggaugagccgcagggccucauggcugaggggcacagcucgguggaguccgccagcugucugccuggaggagcgggcugccuaaguggcgagggcugggggccugagugucccccagggcaucacacucagacgggucucccaucacguucuuggccucccagggucacucagaacgaaaaccagaggcccgggcugugugcuauugaagcaugucauugugugacuucgcaggugggagggagggagggggcugggggcagccucucagggucgagaggcacacuugagcacccaggccccuuggccccuugcuuuuuugagcugaccggugagggaaggcuccagcagcagcuuccuguagacugucugucuccuggugacaaggcugcauggcgacuggggucucuggguggagcaagugguguuuuuggacuggggguugggggccaagggcuggggcuggggcuggggcugggcuauggcagccucuucaauagcugugggaggugcucugacccagaggccaucucagugugucuggacugcugggcuugagaaauggaguauguccucaaguaccuucagggucguggcaaccaggggccgugcucuccuccccuaugugggcgaugcuugagaaagcaagcccuggccucuggugucaaagcuuuguguucucguggguauuuauaacacagacucuucucgggagauguggcucugggggcugagugcagguggacccagcacuuguggucugcaaaagaggcugggaacugugaguaguaacaauggcuuccacacuugcucaggaguguuaaauagcagguuggaagaaaaggcagccgagcacagcugggacgcugaguugugauaugcacguucagggggguaggggguggggcauacacauccacacauacaugcacagaugugugagaaggcacacaugugcaugaccugugugcacuucucuuaucugcacauacuuuggagucacgcacuuaugcaguuugaaugcugugcuuggauccgagccugccgggagugggacaccccugcccuuggggcccguuccauuugcacauugaauucaggaacuaucagcacgaggagccuggaugagaacugucacacguggauuaggagccuaauucugcagagugggagcuggucagugucugagugcuguggagcucucuggaggccugggggguucuuucacauuaaagguagccauccauccuuccauccauccauccauccauccauccauccauccauccauccuuccauccauccauccuuccauccauccauccauccuuccuuccauccauccauccuuccauccauccauccauccauccauccauccauccauccauccuuccuuccauccauccuuccuuccuuccuuccuuccuuccuuccuuccuuccuuccuuccauccauccuuccauccuuccuuccuuccuuccuuccuuccuuccuuccucacuucaucucuuccccucucuuucauuucuuaacgugguucuauucccuagcucccucugaggcugaaaaugaucuugaguugaucccccugcccucagcucaucagugcugggauuacagcccuacuuugccacauccaguuuaugugcuguuggagauuaaacccagggccuccuacaagcuaggcagacacacuaucaacugaacuacauugcguucuuuaccauggcugugucucuuccugcucacggaugaggcuugaucccugcucauugcuucauauugacaacagacaguucccuggacguagcgguuguucccagagccuggagcugaagccaggccugaccuuagaaauuuccaccuucuuccauacuguggcuugccuucucauuuauuuaacagugugguuuaaaaacaaacaacaaacaaaaaaacaauguuugggucuuggagugugacccaguucuagagcacuugccuacugugcacaaggccucagauuucauuccuaucacccccaaaaagaaauuuucaauuuugugaggucaaauuuauaucuucuguuguuuuaauuaccuuuuaauucauacuuaguaaucauauauauauaaagugugacauaaauauuuucuuauugucguucuauaguuuuagauuugugaugugacgugagugugugugugcaugugagugugugcuuguguguguguguguguguguguguguguguguguguguguguguacacgugaugggguacucacccauucugguguuuguggagccagagguagacagauguuagaacccucccccauuguucucuauguucugucucucauugcacguggagcuaaacaguccaccuagagggccacuggauccaccagucuguuaguccuggggucagaguucacauguagccaugccugggagcuggggaccugaacuugaacuuagccccucaugcuugcauaggcacuagaacuccagaguccuuuccauguccuuguacuaaauguggcuggcagucuaugugucuuuauguagaagcugaauugguugaguagcauuuucuggaacgaauauucuuuacuuccugagucuccugccaucccuuuuaaaguccagugugccacaagaaugaaucugccagacuguucugagucacugaccugucauccugaaaugccaaacucugugcuuacuagcauugagacagggcugcaaaaacagucauucgugacguucaguuuuauucuuuaaguguuuuggcuauuucugggucuuuugccuguucauauaacuuuuaggaauagcuugcucauuuuuaugaaagagcagagugaguuuuauuggggauacaaaucuggaggucagcuugggggaaauuagcaucuugguaauacaugaacacaucuugaucuuuaauuucuuuauuuacuaaaaauuuagauuuauuucuuuaguguguguucaugcacaugcccuaccuugugugugguugucauaggauaauuuucuuguauuuagugagcuuuauccugaugccaucugcacccaacuacucuccaugagaaaguuguaaguagaauuuaaguggcauggcacagguuuuuuuuuuuuuuuugauuguuuguuuauuuuaugaacaucacugucccgaaggucacugccuacaugcaucaugcaggcacacaccuggaccaggcuggacucaagggauccagagaaggcuugcacugauucugacagguuuacauucgccaucagaaccaaauuuggcuguguggaggaaaucagagauggagugggacacaugcauacauaaaucugucauguaaccgacugcauucuuauacuuacucagaccaucacaggucaaacaaagaaaauuccuaaguaaccaaaaugucucuggaacugcuuggauucucauucuuuuuaagacuuguagauguaguugggguaccccaaggggacacauuugccaauggccaggcgcuggaagacaucuucagaguucgccaauaccuuggggaaauuuuuucuuaaucagaguuugcagguauaugaaggaggagccuggauacaaugauccccuugaagggggagugucucauuccaucacucuuugacucugugugugugugugugugugugugugugugugugugugugugugugugugugagagagagagagagagagagaggagaagagauugcuugcacacacauaagagcucugggcucuggacauaggcuaaugaacuugggauguacacacaugugaacacauacagagagacagggauggggagggaggggagagggagagagagcuggcccaccugauguggaagugccacucucaacuugggguaaagugaggacauauuuggagggaacaaaggggcucuguuccuugcccauaccccaacuccugugagcuguuauggcucaaacaccagcacuuuggaggauguuccgugacagguacuggguacccagaaagaacuagguguccuaaucgcagggcugucuccaggcuaggugucagagcuccucucccaaggaagggcugauuccagcagccauauucauuuugaaccccuuggucuuccacauuguagugaccauuaucgagcccuggcaucuuguuggguaccgugagccuguggugucagaucacagggaggcagauugcuuucguguugagauguugucuccacgauagguguccguagccuggacaccuggugguuggccaccuggaucucuuguuggcuggaucuguuuuucagucugccaucuuuuuucuacucuugccugccuuugggagcacuuuggaguccugguuuuccaccugaaaauuugaggugaucuaugacccuuggggcucacagagacaggauggaggcaaagugccuaccagucuaaguccggaggucuugggauacuuccaguaaccaugccaaugugacugccaggagggugggccuccaucucaguacuuggggagaaaaaagaggcccugugugcacugcugcauuccagcugccuggggccugauaggccuuggggugucuuauggggcauggauguaaguagcugcauauggugccauauacccaugugacccugugcauccuaccauguagaauguggaaccaugugggcugguggccugacacccaguguaugcucugcagagucacagggacucugguguucccaagcagagcccuaggauagucacugggagguauugagcccacagauauuagggaaggcagugggcaugccugggugggacagaccuuagaagugaggaggagucaugguuccugauacccucagcaauguuagaguaggggccacccuauguaagcuaucaagguucagagguaucaggcugggacacagcuggcagugaagcuagcuuuacccuguacccugguuggcucuggauuuuggccuccaagcagcccuguccuacaggaggacagacuuccuggcccagcuugacuucaacaagggaggaaccacaacacagguuguaguuuuugcauuuuguggguucuccacucuugcuaucaccuccuggucuccauuucagugucacuggaggauuaacuagaagggccuaggagaggccaaagcagcagauaccagagugucggaacucuuugugauccuuauugagcucuuuuggcugcuguacagcuugcauagugcauagugcauacucagcuggggaccaaaauacagauacagggugauauucacccccuuuagucugcggcacccaugucuuggguaccaggcccagagacaugacuguggcccagcugcacuugagaguuugugacaagugcagagaccaguaaaguuagcccaacauaaaaugucauuuggcugucuccuccaaggaaaauggcugaaggagucacagcugggcuggauucgcagaggcugagggagggggcuggaggaagguuaguggccaugcuggggacagcacugacagugcucacgagcugugacagaugagugucuacagccaaccuaaugugguggugguggugggguuccuuuuaaagucuccaguauguuagcuuguuucucuuuuuaagcacuuaaacucuaggcauuuuaaagaauuuuacuuacuauuauugugugugccugucuaugcauacauaugggcaugcgugccauguuguacccacagagauuagaggaagacuuuguagaauugguuuucuccuucuaccuuuuaauggaauucaaggauccaacucggggucccaggccugugcgacaaaugucuuuacccaccgagccaucuugccagcuccucuuucaacauuuuaaaaguaaccagugaugcacccaucuccuaggcuucucuuauuuauuuucuguuuucuugucuuagguuuuagcuuuguaggguuuaaguuaugugcagcaaaacucucucucaugugagauguccgguucagugaguucuggcaaauuccuaggccaaguugaguuccuucacacgcucuguacgcccuguaccacagcccaucccugcaccugcaccugggaacuguccugucccccugagaacgcaguucugcagcaugaagcccggggucuggcucucaucacuuugcagacucacuugaggcccgucugcuucuggucuguguucugguugauucuucucucauuuggaaaggauaaaguguacugcagcuuguuuacccguccacaggcugauggacaucugagccgucucuagggcuugguuauuaugauuaaagcugccacaagcacugcacacaggcucuggaguuguuacuugccucuauugcucgcugguuauucccugccugucccugagugggaguacugcaugcucagaagcugccaagcccuuuggcaagauggcugcuccugacugcuaucaccauccuaggugccagcaugguaacuguggguucucacuagcacugagaauugucugcuuugggugcuggacagauggcucagugguuaagagcacuggaugcucuugcagaggaccguagcuuuucuguugguuuguuuguuuuaaugauucuaugucucuucugugcuaauugaggagaugguguccaugacucugucuuucacggggaucuguguugcucaggucuuuccuccccuggucucgucuuugauucuucuuagcaagaucguucagaaagcaguuuuuaauuuugaugaacucauuucaucaggguguuuuccaugcccccuuuuccuguaagauucauguguuuuguguccugucuaagaaauauuugccuaaugugagcuuacaaagccuuucuccuguuuucuguagaaacuuuaucguuucauguuucuuguuuagauuuguaauuccuuccaaguuuaaucuuaugccuggagacagguacgaaucgggacuaagucucuuuugcaugugguuacccucaugucccugugacuuuuuuuuuuuuuucaugagaugacuuuggcgccuuugaugaaaaucaguuggccaugcacuggcuccaauuucuggacuuuguaagcuguugugccagcacagccuugauugcugugacuucuacucuaagccuugaagucaggccuuguuaauccuccaauuugguucauuuucaaagugugaugcucugcugggcccuucacaaucucaggaaaaaucagagaaucuggcugucaguuuuuaacaacaaucccaaaucaaaaccaauacccagcccucuuggcauuuugacuggcauugugggagggagggguaaagaugcauggguuucauguccaucugaacugcacugugcuuucucucucuaccuggugaagaaucuucagugcagguugugagugccaugcaaucuccagggccccaccccauuaggcugcuucuuuauccuuugugguuuuaagcuccuuacaggacacugcuguccucaauguauuuuggggguuguuguucggcuauaggauagcgguuguuucuuguguucaccuuacuuaugacuaggagaggggaagcuacuacacacuugcuuuguuugcucgcuguagguucuuuaggguucucuauggagaugucuggucaaccuaaauaaaaccauugacacuuuuccuuuuugguccacaucucuuuuauuucuugguuuugccucauggcaccaguuggggaccuugcaccagacauucaguuuggcagagaggggccaagugguccuuagggcuggugucugauagcacaaaaacugacgggugugagguugcuggugaugguaaucaggguguguucuuuguuuuuuacuagucuccagggccuggggacuguaucaguuacuguugggcgguacccaaugccuuuccuguugagauaguugaaccuuuuccucucuaagacuaugaguugugcucauugaucuguaaagaacaaaacaaccccucgcauuugucacacaaagccauguccaucacaaugccuauaaacauacaucaccgagauucuaagucaaguauuuacgucuaugcucacguuggagcaguccuaauuguccugccgugugcucugcuuugguacccgagggugagucggugagggagguacccccugcuccuucacucagguuuguauaaaaugucuucuauuucucuuuuccacauuagacagacccacgaauuaauuucaucugcauuuuuuuccuagcaggaaagguuuugcuuuuuguuuuuuuuuuuuuuuguuuuuuuuuugacauaaauuaguaaacauuggacccaugaauuuugaauuucuccuuggccaaauuuuggccacucucauccuggaaugcaucgaauccccaaagagcaaaggaacuucauccugaguuuaaagacaaggccaucuugaagcugggugugguagcacauaguucuuaggagacugagucaggaagacagccauggguucuaggccaagcugggcuuuauaccgacugagaggccagccagggcuauauauaacaauaccccaucuuaaaaacacaaaaaguccaucuuggggguguuucuaagcuuaacuuugguguguguguguguguguguguguguguguacaugacauccucuucagagucccacccacagagcucugagaggacucaggcuuaacuauggcaucagaguugcuccuuuccuauccccaugcucucugcugucuaccauccaagagucuugcaggcacccuguuuggcaggacacgggggaaagggcagagaguggaccuuugcuggacucuccaggaagucgccccuucuccaaggaaugaaacucaaggaugaaaagaugagcacucagaauccuugguaggucacuuuuacaucucccaggaacuguguaaacauaugcccugaaguaguauacuucccccgaaguuguugacuuaccaucuccuaaaacagcaaauucgugcacaauuuccucagucccuuaaaacauucaugacaggaagaagaaguacuguuuaaauucuccccucauuaagaugucuaaauuugcacaaugacuaugugcaaaucaacggacaaugaauaagccagguacaagcacuguguccccaccacaugcucaaaaagccaaagaacaaccuguggucaggugguccacucauccccaugcccugugggucucaggccugccugaauagguucagucccuagacacccacaaagauagaauucaggcaguggcucaacuggcuugccuaggcccacagcuauggugaagggugcucacccugagggucucagcuucacuaaacuccuaguccuguggaaauucuugaucgagguaguuuuagaagugugggcucccuacacaugaaaaugcauccaagacucaguuaaggcacgcaucuuuggaugucucuccauggggguuggcagccauugguagugaagucaggaucuaagaguaaaaccccacguaacuggguuagagaugggcauaacuuuccuggcagagguagagaccugcuuuaaauucaugugaagaugacuaggaguucagguaugagcaauauugggccacugcccgcaaauuagcacagauuucaggguggacaacugggguugauccuauaugcaaaggcauucucaggggucuaugcagagugggacuggauagggguuaagagcuccccuucugucuggacagagcaguacaccuggggccuugcuagccuucagugccuuggguuuguucuucaaagcccacauuucacuguggugugaggaagcagugggccaauaugccuacaaggagaaagaugauuuggugucauuucuggccugauggaagagacaucucuagagauacagcuucugagauggucugagugacagcuuacaucugauuaggggccacucuuucuagcaugcaagucaaagauaaggguagguuccuuccagccgugagaagaacccauuccauucccggacuggucucuggaagauggcaauccuugauguucuguuacaaaaacauuguaaaaaacacaucugcccucauacgcacuugguuucccuucucccauuguuuuuggauuuuacugucccuuugcuguaaagcugucagucauguugggugaggagcacacugcaugcuauuguugcuucaucauaaauuacaucugcaaaagacccuguuucuaaauacggucacauacugacauccugagggugggauauugacaggaauuuguguugauggcauuuaccugauaacgcucacccaccagaagaugaggaaccgggaagucugugaacuuggcccucucugccuguaugucuauacaaaucagguuuuaugaguacauagcauaaauucuuguggauguacugucucuugucgcuuccacuucaggguggaggccaugagagccacagagccuuaggcaucaauugccuggccuuugucaagacguucuuuuuuuuuuuuuuaaauauuuuuuauuauuacauauuuuccucaauuacauuuagaaugcuaucccaaaagucccccauacccucccccccacacacacuucccuacccacccauucccauuuuuuggcccuggcauuccccuguacuggggcauauaaaguuugccuguccaaugggccucucuuuccagugauggccgacuaggccaucuuuugauacauaugcagcuagaguuaagagcucugggguacugguuaguucauaauguuguugcaccuacaggguugcagaucucuuuagcuccuuggauacuuucucuagcuccuccugugcuccauccaguagcugacugugagcaucuacuuauguguuugcuaggccccggccuagucucacaagagacaucuauaucaggguccuuucagcaaaaucuugcuaguauaugcaauggugucaucguuuggaggcauauuaugggauggaucucuggauauggcagucucuagaugguccauccuuuuuugacaagauguuuuaaacugugccuuucuccacagagcccuugaugauggaggucaaaagaaauagagccauacacagauugcuggcuugccagagaaaaucucaagaaaucagugcuauggaaaguuuuuuuagauaagagauguauuuaagggucugguagaauggaagagaacaguaaaauguccucuuccaugagauaaggagggaggguggugcugaccaacguagcagcucccaggaaagggggucaaggaaagaaaccauaugacaagugaggauggaaauguagucagguguauucaauuuuauauuaaauauuaauguccuaaauucaucuuccaaaagaagauaugcaaaaucucacaaaaaguagaggacuaauauauaggguuuuauucuuuuaaaaagaauuaauuuugugguaguagggauauaacucaaggccuugugcaugccagauaagcauauuacuggugacccuauggccccacuaugauuuuuuuuuuuaacaaaaagcagguguguccaguacauuuaguaaagaagacauaauggacaguugaaaaaaaaaaaggauagccaaaacuaugcaaagaaauugcacgcaaaaauagagaacaagacuugcaggccacagcagguugaguuuguguggacgaagccuaguuauuaauaugaagacagcauacaucauaacacuugugaaaaaucacaugguauguggaaaagaggguuaaccauggugacuaugagggauuagcuuuuccuguuguuaugauuaaacacccugacaaaggagaaaggguuuaucuugccucacagguccauugagguaggcaagucaaggcagcaggagccugaaacauccgaucacacuaugucacaucagaagaagcaaacaaugaagaaguacuugcuauuguccugcucgcuguucccaccuagacaaccuaggucucuccacaucaacaaacauaaucaagagaggcccccacagguauacucugagcccagacucuaaggugauucuagauuuugucaggcugacaacccuaagcaucacagaugccauuaggcaauucuuucagaauagucuuugaguuagaugcagggucagagaacauaggcagguaagugguucagaaucuguaacaggaccuugaaacgacuguugcuauuaucccuagccaugcuaccccaacaaaaacccaccuacaaacccagagcacagcuucuaagccuguaggcugcacagcucugggacuggcaccucucuacuuagcacaggggcaacaguguggggaaacccuccucuagggcuguuaugccuguuggguugcucuacuuuagaaaugaacauuccagaaagggaaaaaaauguccacaagaucagggguggagcaauuguguaguguauguaggggggcuggguuagagagagagagaaagagagagagagagagagagagagagagagagagagagagagagagagacugagacugacucucuuaaucuuaaagcccagauuccaggacaggaguggcaagguguauggggagcagguuuucaagcuaucauugugauuuuggagccugauaguggguauucucugucucuuuagaggacccauggaagacuucugaagccgaucacccauggagcuccuauuaaaagaaaggacaugcaugccuuacacuauugagacagauguggguguucucugauccgaacuuacugcaagggcugcuaguguuugccuggcauacaugaaucccuggguucaaucuccagucuguauaaacugugcacaguguacacaccugugauccuagugcugggagaugaagagagagaggagcacuggaaggucaagguuauccuuggcuacauagaguuugaggucagcccaggcuccaugagacucugccccagcaauagcaacaacaacaauaacaaaaauaaauaaauuaauuaauuuuaaaaaggggagaaaagaaugaauaaaacucgaaacauggaaacaaaugguuaaaauauugagagggaaaaagaagucuuagcaggaauagagagguacucuccuaaauagcuggggaaacucaacagggugagggaagacagggcagcugugaacagcuauguagagcugacuucuguuaaugaaaagacacuauccguccugcccccagugaggcucugacugcccccuuuccccaguguugcagauacuucauuuccaccccugccugucaccaugcuucucaguugcuggcugguguuugugaccuccaccuaguuugaaauucaugaaauaaaaaaucauagcccccuguccuaugcaggcacacacuuacagagcacccaggcugccuucucucugucaggcacuggcucacaacuggaggcgucuaagggauagcaugaauuugcuugguuugaaucugcugaugaggcaauucugggcagggauuuccugggcuggucuaugugcauauccuggcgccaucugcccagcccccuaccaggcauugggaggccacugaacccccauguucaccuccugaccucuagaacacccaggcagggaggaagggagugggcaggguaugaagacccccaccuugccagcuugcagcaagcugggucucagagcuggaggcagcucauuaaaccaccggaaccgcauguaacucuagucaguaccacacagcccugcaccagcgaaacauguaaauuaaagugaccacagggccugcucuccucccacuguggguggguagccuuuauuccaagguugaggccuagaagccuccaaucugaggaggauuuuuccuaaugauaaugggcccaagaaugggcuagcccacuagugugggccaagccuccuugcuuuauccucacucugccccaucugccuccuguuuagaccuagugucaguaagugauuaguagggcuuugggaauuugguuggggcagaaggucuugagccuugaccugggggcacagugugcucaagagguaccuccugggcaacccgauuauacuuuuauuguuuccuaagauuguuggacaucccagcuuguuaggaagcucucagagacagucugucgggauguccaacauccuguugugguagccucuauaccuguaacaugauaaugugagggucagggaugauaccagggaacccuauguggcugagcuuuggccugaagguggccucuagaucauauaggaaagggagacaugggccuuagcacccuuuaggagucuuacauggggcaguauggauuuagaacaugaucaggagaaacaauuagucuucaaggcacucccucugcuuuugguccccuguaaacuucagcaguggacacugggccucaugccaccugcugaaguagggucuaugauuagaggaccaggugacaguuguugcccacuuucagagccuggcuacccgguggaugggaaagcuuguccccauggugacugagcaagccucaucgccucuucugcccacuguggagaauggcugccuggacagcuggcaguugggauggguucucaggggaaagcaacccugcaucuccuaaaguugcccccaaauugggucuacccuaauaaguguggacauagcagcugcugaucugugcccagugccauuaggaacuggcuauugaagaaggcgugugugggacucugcugcccacucccaggacuggggcuucugccucuagcucuaucuuauagcucacuaacuuucaugguggcugguggaaaugcccugcuuccuggcuguguugugcugugugcccccagaaccccaccaguaguagguacccaugacuccuaggacauuuggagaagaguggacuguuauagaaaggaucaugucucuacaggguccugguucugucuacugccauuaggcccugacucugugccuccuuagagucucugaaggcuuugugucaccugggacuagcugguggccuaugggagcugacaauccccagggugggcagugagcauggccuaaggguuccagcugugcccagcacaugucacugggggggcccaugggcucucagcauaggcuggcggcugggagcagcuggccacaggcaggaccugaacaaagggugcuuugagcagcuuacaugccggcaccgagccuccggccagcugccccucccgagaaugcaaggcuggcccucucuauggcuuauuggggcccguguagagucagaacagcuggccccaaagucugcuggcugucugugugcugagaaggcacuguccucccacaggaagcccccuggcucaggaaauggccaucuuacagguuuccuaguuaugagaggagggaagggucugagcccuagcuucccaaggcaccccuaugcugauugguagccuacaggaggccuagagguaucuaacucucuagaaacugcccuguccaguguuuagagggccucagggagaccagccgggcccuuuggccugauggccuggauuugccggcucucuugcagggccccuauucccaugggccaacccuucaucugaaauaguuaaaucuuccagucagauuucaaauuauucuuuuauuaagaagauuauaaaauaguaacaucagagacacugaauacucacgauaagcaucuuugagcucccuugauuguuaaacaaaaagaaacagagggggaaaaaaaauaagugucuuucaucugaggauccaaggcagucugcccugcccuggcuuugcugugggccacagguggauuguaguaagcugaacccccacccuuccagaaaugggauucaccagcugauaaaaagaaagaauagauaagacacccacagccuucaaggaagggccucggaggcugugaacucugcacuggccuuuccucuguugacagauagagcaucucccuuacuuguaucucggcccuuuagguucacauacgggcagaucucugcuuugcugugcuuacccccaagcaccugaggcacauguguaguagguaugcaugugugauagguguucccggccagucagagauucugucaugccaagcuuuugucuucugcauccccugaaucacuuggguucaguuuggggguacugaguccaccugucaaaugagaaaacuuucaguucccacugugaaguuuucagaggcagcgugucucuucccagaugucccugccaggauccagagcccaggaugccaccgagccugugccucagugaguuccagcauugccauagugagaugagaugacaaaggaccuaauuagaccuuggaugcuuccugucuuugcucuaccaccgucuuucuuaucuuuacaaugggagccacagugaggguccacuugguccuuugcaggccguagauccugugagccuugugacuccaugucaucuucccccuccugucucuuucuucuuuuauuacaaguauucccuuauuucucagguacgugugugugugugugugugugugugugucugugugugcacgugguagucagaaaacaauuugcauuggucaguuuuguucuuccaucgugugggguuggggaucaaacuugagccaauaggcuugacaauagcaggugccuuuccuugcugagccaucuuguccccacuccccuuccugaaauauguaugagguaaggugucucaccuuggcuaugucugagugcucagcugaguggcaugaagcucauucacacuguaguaguccuuaccacguaccuugagaacuuuccaucuucacagaugacucuggucuuguuaaacacucacccccaccccgccacccccaugcccugccaccucaucuugcuuugugucccuguggcuuugguaacuuggggcccugcaguuauacuaugagggggaucuuucaggacuuuugucucaacagaagguucccaaggucuguccaugcuguguuguguuggagcauacauccuucugaaggaauauuaugugcccucuaguaucuggagccuguuuucucuguccucuugauggacauugccuuuagcuauuguguacuuugccaaaguaaacacgguggacagauagcuucucaaaacccugccucucuuucaggauguaguagaauugcugggcucuguggaaguucuuuuuguuuuuagaaaaauaaaugaucuuucuguuuuuauugauguauuucuguguaaugcuggggguuaaacagggccucaggcacaccagacaagugcucuacaguugugggacuggggauauacuuuauauacuuuauauccccagucccacaacuguacuuuuuuuuuuuuaaagauagauccuuguuuagagcagaauugaguggaugguaacuccauucuucaugacuuagggaaccauugaaccaugcuuccaggaucaugggucuggugucucccucaggcagccauguauaauagcccugccucucugccuccuuggccacuguagucauugccuguguuuugcuagagggauacagcagccucuguuuugauuuguauuuccacaguuaguggcauagaauaacuguuucugugggcaucuuuucucaguuguaugucuucuccaaauugcugccuauucagguucucuaccuuucuaaaacauuuguccuccuccuccucuuccucuccuccuccccuccucuuccuccuccucuccuccucuuccuccuucuucgguauuuuuauuuuaaaacagggucucauuaaucuaggcuggauucaaauuuucuacauagccagggaugacccugaacuucugaucuuccugucucuauccuccuagugcugggaguccagguaucuaguaccacaccugguuuauacaguucugagaauauaacccagggcuucaugcaugcuaggcaagcacauuaucaacugagccucagugccagcagcuuugcuuuuuaaaauaguuuuuaaaaaagacuuauuuauuuauuuuauguaugugaguauauuguagcuguacagaugguugugagccuucaugugguuguugggaauugaauuuuuuaggaccccugcuuguuccagccaaccccgcucacuccggucaacucugcucauuuagucccugcuugcuccagcccaaagauuuauuucuuauuauacauaaguacacuguagcuggcuucagaugcaccagaagaggguggcagaucucauuaugaaugguugugagccaccaugugguugcuuggauucgaacacaggaccuucggaagaguggucagugcucuuacccacugagccaccucgccagcccuuaaaauuguuuucaauuaugggacucucacuccauugagauacaacucucaacauuuacugcauaggaaauaagcagagugugucagagaguauaucauguggguugggaccagcacaugggcaaagugacaggcuacaggaugcugcaagggguacacucuagagauuguugcuuucagagccuguccgaaccucuuguucauggcucuggcacucguaugccauuagacaagccccucuuuuuuucucugacagcuucaggaggaguggccagcacucagacucuggccccucugcucuccuccagcucuucaaggaccuagaggagacaagcacacguauguuagagccaggauuauuguaucuccccagggcucuucacacccacuauaaucccagacucaccugcauaaaugcuagcucuccugccaugcacagaaguucaccaggaugggguaccaggaccugcacaugguccaggcucaucuuuuguccuuacccuggacacuucgugucacagcuggccugguaaauggcucuuaugccucuaggucacccuccauccuaggccauuuccuuuuacaccuugguuucugucccugaucacucaagacccugucucaucuauacaaccccuacucacagccauuccccaaaccucuucuguccucauguucccagauguacccacguaucaguagucagcccuccaagaggcaacuagccucacuugccagaguccacucccaaaccugagagccugugugauccucugccuugugcccaugucagucuauuccucccaugaauccuugggcagguauucuccuauucucaugggcuuuccucccuguguauagaaagaggcacaggguuccugccuugguggauacaggaaaagcugcaggcucugugcucgcuguuuaucccugacgcaggagucucagccacaaagcccucugcagccaggauuuagccuaacucuaguacagggaacaauggucauggugggaggggccacuguguucucuugccuuuugucucagcccaagcucauuggcccaaggacagcccuuucuuuuauaucucugggacagagcucagggccacacuccaucaauguccccuggccuugaguccuugguucuggcagcagcauguggauuucucagggaggcccuuuagggagcuggacaauacuggugcauuaggcugguacuuuuauugguggggggagcaugcuagcuuuuuagguggcuguuacaaggucugggggaugcugggauggucuaaauaggcaagggguuggaaggugggggugagaguacaccccacacacuaagccucugaggacauggagaacccagaggaugcaaugugucuggggucuagggaggcuuuugggugcacugggccaugagacccuuugggugauagcccauaaccuuugaccucaaguggacagcaggagcaggcaugggggugagggagggguaacagguauuuauguguucuguugagaaauuugaggccuaucauucaacacugggguugcauuuggauuaugucuauaagacaggugagcuucaggccuggcccugacugagcaggggugacuaugcuggaacaacagcugguaucaacccuguggucuguuauacaagggcuaagcucgccccacuaacccugcuauggacuaggguguuguuaccugaauuaaacugucccccacagugugucuccuacagacucacacuacugcuaaaugcuaauucuucacuggaguuccagugugaccuuuggucugagggcuacuccuccuagguccaguauaugugcaaagcuggugaaaaccauuuuaucucugucuaaacacuagauauggcuacauucuaccuaggacaggguuguuuuccuaugucucuuuccuagaagccccugagccuuacugauuaacucagccuggccugcccuggacauaacuagccagacauuuucaggggaugaaggggcucaaguccgcugaauccaggcuucacacuguguucacaugcugaauuggagaucuguguaaggggaucuugcuguuucacauagccaauuccaaaauggguuucccuccaaguacuaggucagggggcaccuguagccaucagaagccauugcuaaggagauauuugaauaaugacaaacaucugcaaaugagagaaacucacuagaugaucagccagcugggugauguauggccaugaaauuggaacagaggccuucugccugggcuagcacuguaacuaaauauugggacuucucauggucaggcaugcugucucccaugaagucauauccugugcuggggauugggaguauguuuuucauguuggccaaagauacacacaguacuuugggcaacagcccuacagacccagauucucaagaaacaaagaugaaucaauaucccugcaagccagcugcucagagauuguucauuugcccguucauucauucacucaucauucauucauucaacaggccaauauugagcucugacuggagugaacgagacuauggcuccucccugguaugcucagccaaacugggcccaucauugccagcacucucucgcucucccacacauagccaccccccccccauucccaaugaguucacuucaugggccaaaugcuuuucucacaaggaaggagcuaugaucucccaagcucacuccuuccaucagucacugcucaugcccaaaacacaagccaggugguguacuauuuugucuuaauuaaaagcauuuauauaugaugugcaguauucagcccucacucaugguggacucuccagcagccgacaggugggggcagggccagcaugugucacccuucaaagaggaaguucccuccagggccaggcuccugagggaggccaggcagggagccagcuggaagcaggccugagcagcacaaugcuuuguggcuucucggguuuguggcuuugcacaguccccuaacauaugugggagugguuucaccuccucaccccaggccuuccccaagggccucauaccaaagaaggcuggcugggagcuggggaacaggucugggacagggcuggagaccuggaggccaccauaggcuguaguucgcauggaauguauacuuauuucaaauccucccaucacccacuuguggugcggcuacucacauuuucacgccauagcaggacugaggaucagaccugagcugcccagggguggaacaagcaggaaggggauucucacucagggcagccagucccugacaaugacccuguggcaagagcugggagagaacggaaacuggcagcagaguauggguaucccagaccagaccuucugacaucacuaugccauagcaagccagccaaugccucacccuccagauacugugcaugugacaggucuuuggguguuucauugaagaggcagauagugaaggcuagggaaggagaggcuauucaccaaucaaaggcaaggccccaggcuuaccuugacuucucucauggugauugccaggccgccagcgaccgucccuucaguuugugucaaggcugugugaacacaaagcaguacaguugcucucacccagugcugucacagacugggaaggccccaagauugcugcuagcugaauuauaaaucauggucagaggcugagucuguuuuuauugagagagcuaauggauccacuuuguuuuuuuuuuuuuuaacuugguucucacaccagucaccugcaauuauuuauuuaccuuccuauucaucuacucaaccaaccaucgacacacccauccaucuauccauccguccauccauccauccauccauccauccauccauccaucuguccaucuauccaucuguccaucucuccacuuucccauccucccaccuucucauucauccauccaucuaccuauccauccauucuuccauucauccaucuauccauccacucacaugccuauccauuuguccacucacccaucuccucuucuauccauccaccuuuguguugaucuguccauccacugcaguaaguaaccuggaugacagccuggguuucucuagcuuguaaagccucccuuucagugcacucugacuucagaguguauguggauacauugggagaggucuggucugugugaauugaccuaggagaguuauuucacauccguugcugcccgugcccuugcuugauuccucuacugccucuggauggauuggggggacuuuuguacccaaaccucaauagaggcuauggaugguggguacggugucuccagugugaggcagagcugugagcuaugcucuaagggagacaguccucaaaagacacauguccuugaacccucauuuucagauauagaacuugagcucuguugauuccaugaagcuagacaacacaaaugucagcacuauguuaccagaccagaucauuaaaccccaacccugguguggagucuuccccagcaaauaacagcugacacugucuacucuuagcaucccugggcucaguguguuaaccucucuggacaguuguuauagguacuaugaguuaccacagauggauaccugagccugcuagucacgguugugucucagcagaggcuccuggcaugguagcuugguguaggugcucuagccugaguggucauagccucuaacacaggcuuauugcuuucuuucucaggagauuguccuugugguguucuuugggacagaauaugugguccgccucuggucugcaggcugccgcagcaaguacgugggcaucuggggccggcuacguuuugcccggaagcccauuuccaucauuggugaguccugccuacacauccugcagacauuccauuccacacauucauggguccagaaggacauucccauuacagucauccccagagaaucuccauggauggagaccccuagauuauuccugugcccuugguuauugggucccaucuugcuuuaguggcauaacccucaggugugggugguagccuacccuccccagauuccugguuaccagaagucaugacccccugccccucccacagaccucaucgugguuguagccucuaugguuguccucugcguggguuccaaaggacaaguguucgccacaucagcuaucagguauguuggcucuuccauuucuuccugugagagaagacccacuacaaagcccuuuccuccuaagcuguagucucucccucccucuaccugucucuuucauggugaguggcacaggggaaggguggccauaguucaucauauugaaacaguaugcaacccugaguucaagguuugaccccaguacuuccuagcuucuaagacuuagaugauagccugacugugugguugccauaugggugacccuggguuucuggucucccccaaaaaggccauauaaaagggcuccuggagagaggguucucaggcaccuauaggaagcaagauggcuccaguacaaagugucauguacaugucuucucuacccauuggaagcuugguggagacaggaacauaggaagcaaaugcuuguguccaccacagcccucuugaccucucccuucuugcuucuuagggguauccgcuuccuucagauccugcggaugcugcaugucgaucgccagggggguaccuggaggcuccugggcucuguagucuucauucaccgccaggugaguaagccuggugugggcagaacagaagcuggccagccuauaaacaggaggucuggagacuuaugaggucaggaugcagugauggugauaucuuaguaccuggaccccagcugaguggaccaggucuaggcagauaccaagacaugugagucugaggacaggguccaggaccccagagccuucccagccugagccuaccccacauucaugauggcaaaauacuuggcuucuuaacagugcagagcugccgccaccuucacuugggcuugggacaaaagaccauugcaucuuguagaaaauguaagaugaacaacagauuuaugaagcucugaaaucaaaccuaggaaaucaaggguggugccucagacacuuuccagaggacacucugucugagaggcugcuggggacagcuggcucuaaguacuaucuugucauggguacaagggagacugcauggacccaaauggcugacuuaggguaauagcugagacuucuucauugccacuuuugugaauugcaaaagcuagguuacucuggaaggugauucuguguguauaacaugcuacagucaacacaguacaaucuaacagcaaauucuggaacuuuccuccucucaccauacucauguggaccaccaggguaugugaccauggccucuguguugucugucccuaggagcugaucaccacccuguacauuggcuuucugggccuuaucuucuccuccuacuuugucuacuuggcugagaaagaugcggugaacgaguccggccgcaucgaguuuggcagcuacgcagaugcucugugguggggggugguaaguuggggucuuuacugggggucucaggugggagauacauggaucugggcagugggguuaggauauugaacucuacuugcucaauguuuuuaccuucuccacugagguuacuaaccccaguuuuaaaaacuuuugaaccaccaaauguguacuuacagcuuacaaauguauacuacaguaagcguucuccagucccugucuugaaauuugagcauuguuaucuuucaacuucuguuuuggaagggaaggcugaugggacaagggauugcaaccuggaacuucauaucucagccuuguggugauccuuacccugagggauccuggguuuagggugcaggaaggggucaaaaacauacuuugcauguuuguggugucuauguugacccagggagcacaccugugccagagaucaaggcacacaaugccauacuaccauuaaaaccuugugagcuaagagaaagacacaggggcuuuuggauaugaggucugcaaaggcuuccgcugccccaggcagcaguaguaugagugccagucaggcccuaaggucauaaagauggccauaaaccgcucggguuagggcaacuccaaacucacugagcugccagucuguguggagucuggugugugacagugaccucucgugcuagggcugaaugucccaaaguaugaugauacugugugcaggccaguguuuggugugaaugugguguguguguguguguguguguguguguguguguguguagagguauguggcuccuugggugucagauaacagguagaggagggagagguucuggugagagugaugcugaagaaauccagguguacuccaugaccuagcaaccauugcucauggccuaaaagccuaugggauagcugcuacauggccuucgugaccuccucuggaggcaggcuuuauccagccacugagcuuuggggcccucuaagcugcaggaaacacaaggaccuaacaggagcaagcaguucagagcauguauggucugcccucgauuaaaacucuaucuccuccccucaguuucaagagcaauagacuguccagaugcuuuaugccaucauaccgggaggagcugccagggcuggcaccccuggguaggcacgaggauuucaauacgauccuaaauggcauucucagucuguugacuuugggguucacuaggcuggugagaagguugggugggcuguggcauccuauagaaagggccagcacagacucugggaaccugauucagaacaagcagccauccauggugaugaugauugcaucaggcccuggccugaauacugcccccaccccgaccaggacugagcagucuccgaggccugcuuacucucagagcuucuagacugggguugagaaugggagcugaauaaacacauguucucacaaugcccaagugccugcaggaagcagggcacauagcaagaccucuugacauuggccgaaucaguccguuuucuagaaguuucuagcauccuaaacagccucaggagguaaggguacccugagaagcuuccagguugggacaggccccaggucaaaaugcugccuacccuucuuggggccaaugucccccgauacccuagcaugauagaaccaaacaggguugguaggaaaaaucaguaggaaaguuagaaagcuugccuguggaaagaggacacaucccagggauguagcagggccugcaugggggccaggcaacuccaaaccagaauucucuggugggagaugggcaguguuagcugagguacagcaggaaguaaaugggugacuaccuacaguguggcugauaagugaugcccagccuuagcaguacccagccuugaugcugcccugccuauguucccagccuccugcaggaacuauuucccagccccccagccccuggccccccagcccucggcagaaaggugcccccacuccggcaccugugcaaacauccgcccgccagccgggaacacggccccuuugugcccagcuuggcaccggugcucugucuggccuacuccgucagcugcagcccaggccucgaccacagcgcacccuggccuggccauuguuccugugaggcccugugcccuuggcugcccaagggccccccaguacccucauucauucaguggcugucucugcagcugucuagugggagcagcccaagacuggguuccuggcaccucuaggguaaucagaacuugagcccuguaggacaggacagccaggcucagaguucuguagcccugagccaaugaacaggcaucuccuuugucucccucauuccauaagggaaguauggccccucccgaccuugucccuggguuccucaucuguuuaaugugggggugaugugcauacccucaggcaagagcauuuucuaaacaccaggccccucucugucugaugucccuguccuggacuaggccucaagcccuguccccuaccccagagaauguugucccugagaguuggacuagcuuccccuaagguacacugagguaggcauugggcauagaggcaugccugcauagggaggaauguuucucacccuguuagccugcagagccuaugaugaaacugaggguccucucugacuagugcuuauucacugaguaaguaaaccagauugugagaaggggcaggaaagccuguucacugccaauagguggauucaguauguccuguucugcuccgaacaccagagucugaagccgaggcaugggcaggccacacucacuugguagacucugggaagggacuuuuaguauuaaguuaaguuucugguagcccuaggauccugugucgcuccuauguguuucccauggacaugcagcauuggauuaggguccacccaggagacccagaaggaaggccauaaucuggggugaggcugggugagccaugugggggacacagauaaguccagaauguagguauccaggcagcauuuugugagguggcccugucuucauagauugugaguuccuacagcuggaaagcaaacuucauggacugcauccccuuucuccagugggaauacccacaugggugugaggucccuggaacccagaacccccuaaaauaauguccaagugugggcugggaaguauuuggggagccccucaagcuuuccuuuacccuugaaacagaaugcauuuguuuguauuacaguuugagugcaggaaaauggcauuucugcaaacaugggcuccucuguuuaaugccugggggucucugaaaacaggcggcugcugggcucuguuuaccuugaguggcuaaauacagaacuucaagugagcaggcugaaaccccacccuguauuucagucccuuaaaaaacccagucugacggcucuucauuccucaccuggaggcucuggaaaguucccaccucccaggcugggcugcauccugcacagcuaggacagaagggccuuggaguugaggaagucucuuagauagucacaugcaagccucguggaacuauccacgagagacguuauucuucaggauugaucugacuauggagaagugaaggccagagcaggggucagggcugguagcacuaagcccucuccucuucuguguugguucuaugagaauuaugcagcaaaggcugaaggccugccagacuccuugcuaguaagcucuucccaaggaggaggaaucuuuauaguugggccuuauagaaugaugaggagucucuacaaagcauguccaucuuuuuguagcugcuauucaguaagcagugccuagaguuauuauacagacucagcagguuagguggugcuaaacauggguugaaaucauguuauugaggaguugccuguguaaaucucaggaauagagcuucccagaaacccuuucaccacgaggaagcagacagcaucaggaaguagugaagcauaagguacaagguugacacgcugugaggucaacacagagaccaaucuguacucaccucccauguccaccaggcaucagcugugaagccaugggcaugccaacuagccucuuugggcacagcuaguuaauagauauagacaaguuaagucagugagcaugcagaaggugagcuucaggaaugguugugguuggagauucucagccaggcuaccucuagacucaaaaggaggagacuagguacuacuaguucugaaaauccuucccaggggccuguucagggggacgaggagagccaugaacuauacagagccugcccgacagguucugucacugggacagcaaucuaugaacucaaguguguaugacucaggugaccuauuguuaguugggcccuugaaagguccccucuguucauuggcccaagagacuugcagaucuagccauuggggacaaguuccaaacagcucuauaaaaugauccauuccugaguugcugagucugugacuuggggaaaaacaacuugauagggacaggcuacuugggagagaggacucauaaacuagauucggagcucugugguggcccaggagaaagaggguccuagugguuaggugccuuccaacagacaacugaccagcacucaggaccacugcacugggcccuuucuccuacugauccaaggaguggagggacagcuaagccuauagggaaaaggcauggccucagguauuuuuaccuacauaaggaguuuccucucaauucacccaugcuucuucccagcuugcccucuaggccauucucccuccaccuuuguagauguuuuccuccccaucccccauuuuuggaugggguuucauauagccaaggcuagccucaaauaagccauauaucccaggugaucuugaacucuugcuggcuccagcccaggucugcuuucacaaguagcuccugucaugugccugucucccuagagaaggcagcuguggguuagcucucacauguggggugcacacccucugggaagacgucacuugugaggagcuucagcucuccugagcccucucaucccacagccugcaggcagccauguccuccgucccuggaauggcuugucuucaacuuacaucaugugagugguuucagguguguguauaagaugucuggacagcacgugcccuggcugucaguccugaguauaaccucuagaccccuuugugaacuuacgcaguguguaugugcacccucauggugccucagcucacucaguggccccauguucccucgugugcauaugagugugaauggguguccuugucuccaugugaagcauguuuacaacuguaugcccacauauguagaccagguuggucccuuuaaagggcccagccaucaugaugguuugcuauguccucuguucauguaggguguggauuuuuuuaaggauaaugacauuguggggaagauuucacaugaugguuugcuauguccucuguucauguaggguguggauuuuuuuaaggauaaugacauuguggggaagauuucaugugggcaauugggagaaaacaccaguaugcaugcagccucuuauuuaaugguacagcacugaaggguggcccagugauggccugggcccagcuguagccugcucuguuguuugccauccaggaaaaauugaccuguugcuucaugaccuguuaacauacuggccaaagcaacagacuuggcacuguggggucacucuugcuguccuuguccucugcuccccugcugaaguuggucagagugcuugccuaggcucugagcacuuaucucuaugcucacgauauguacauauuaacuucugacccccaugccucucuugccuucccuuccucuucaguggccacuggggaacaguugugguccacagaaguccaucuggaaauggaguggguagugauggccaugggcuuggauaguguggggaucuugaggcuuccucucugggccucacuuugguuggagucuauucgaugguguuccccaggccccaucuuuguugggcagagguucacuuagagguucucauauaggucuuggcugggugguugucaccuggccccaaggggugacagcugaggugucuagagugaucagacuuuaaagaccuugagugggcaggguaucccaucacacugaccugccuucacugauggccugaucuggacaguguguugugaccccaagggcuucguguuagugaaugugaccacccuguucucccagcaggcccaaggcagccucauggugugaccuagcaguuaggcacagccagggugggcccccaagucccucaucagaggccccaggagcaaaccucagaugucagcaggggacugccuggggggggcagccccucacuccuauugucccacugcacacccuggacgcugcucccccacuaagaagaaggcuagagccuugccuuauucucucugaaaaggaaaaauaaaacaucuggaucccugggcugguggcaggaagcagcaugucagccccauccuggggcuuuguggaccgcuggccucagugggagcuuccggccuccugggggccagugcacugcaacuuugguggccaggagagggaucuuuucgauggggcaggaagccuggucccugugggugggcucugagcucuuugccuguccugcacaccccaaucuaucuguaagccuagggcugugccaucugugguaaucagaguugaaggacuuaggagacucagaagcuugaaccaacucaccauauugcuguuccugguacuuucucagaaccgcgccucacuauccugguaggcaggguuuuaaguuggucucuuuugucaucaagccgcuguguuggggcuggcaggugucuuuucugaggcucucagccagcccaccacugacugcaguccuucuuccuugcaggucacagucacuaccauuggcuacggggauaagguaccucagacguggguugggaagaccaucgccuccuguuucucugucuucgccauauccuucuuugcacucccagcgguggguaccuauuaagagcccuuucccuuguuucccacucacccuugccccaacuucuaggcauuccuugaaguagaguaaggaggccuuguugugguacuucacagaagcggcaagguacaggggagcagacugggcagaaccugcaggucugcucuauagccaggaguggcucugucuugugacuuuuccaaaaaucacaaaccuaugucuacacaugugugcuaggugggagaaauacugguuacuuguauauaucugucauuguaggugugucuuauacauguugugugcauauacuguauacauguguuacauguacaagugucuguauuacauuugaauagcauguuuaccauauguacuguuuauguguacauauauacauauguauguguguguauuugugauuccauguaugucauguauauaccuauauuugcacacauguuccguauccauauauuauuuauguuucaugaguuucuguaacacaugggagaugauauguguucaagugucuguuauaugugcaugugugacacauauauaugggucaugacacacaguguguguccccagcugcagagucaguauuccaucucugccacugcuggcuacaguagcuguaggcuucuugcugaggacagccucaaacucccccucuccuaggguuaggaauccucugccccaggggcaaggggugauggcuaaauuaccuggauucccacagguggugccaagaaauguguagagucucaggucucuucuagagccaagcuucauguugagucgacucugagaaauggauucugccuccccagcuggcaaggccaggcaggcugagccuggagacugcccgcaugugacaucugcugucucaaacccaccuucugauagugccugccuggccacagcccugggcacugugcaaaccugguauccagaugcuuuugcuucuugcucuucauugggacccucauccucugcugggcacuggcuagcauggcuuauguaacagugggcaccuucugucccuuaccaggggauacuuggcucuggguucgcgcugaagguccagcagaagcagaggcagaagcacuucaaccggcagaucccagcugcagccucacucauccagguaugcggugcgcccggcaggcuaucagugcuguguacuuacauccauuuggguguuggaaccacucccagccaugcccacuacuugagaggcauggaucccuuugcuucggcucuucccauggugagguggcucucugggaaaguacucacuauuaggaugauagggugggcaaagggaugcaggaccacugcuccucaugcuguucccacugagggccauacuugcagacuagggcaaggccugaccauggcuacuuagccagucuguacucugcuggucagccucaguuuccugacuucucugaucuggacagaacccuggaugaggggcauggcagcccuucucaaagcucguagcucucauggucuuaucuaagcuucuagcacaguucugggccccagcuuguuccucugaugcccuuccagagccauuuaccuggccacugacagcaacagccacgaggccagcaguugcaguugugggcuuucccaggccuggcuugaccccacagcuucucauucuuggaaaaccuuaaaucagacccacuaaccugccuuggccacauuaacauagucaggcaguuauguaguuccucggcugagcacagaggccacugcucaggaacugcauggucuguggacaagacuccuucagaagcuauacccacaguggaagaugugccagggaucuuacuggugggaguuggaaacacaggcaacauggagugugcugggaggagcugcaggcugcaugagguauggagcugcccagauagggcauauacaugggacauaaaacccuucgaaggggcuccaacugucccaggucauaaguaucccugccuggauuuugugucuaugcuagguugcugucauagcauggggcugucacucagaagccuggccagcauagagaacuuucaacugguuuuacuuucucaugcccauagggccuauaaugacagagucaccaugguauguccccauaagaggcuuugguaucuguuccuucccccuucuugcucccuuggcuccuuuaggccccuccagugucuuccccaggucaucuugaugugaugacuauggggagggcauuucccucuagaauguuggccaagaguuucaucuguagugaccagagacuccucguagccacagucuagcccuugaagucccaggaggccucaucgcccacuggucccuggggcucuaccccuccacaaccugcuggugcucacaaaggcucaggcaguccuuuucuacuguccucugagucaagucugguuaucuaacucugccuuaguugagcaucucuguaugucugggacuugcucaaggcucucuuuaggaguggcucagguaacagauaguuaaugaaugaggccuucuccuuccuagcccucuagagggcuaagccuugaugucagggaaggggccuuggaacaagcugggcuuggggcucggggaggacaugaagauuuuuugagagguacugcugaguggcuggaccaaugagccuucuuuccuuuccccucugccugauuucagacugcauggaggugcuaugccgcugagaacccugacucagccacuuggaagaucuauguccggaagccugcucggagucacacgcuucugucccccagccccaaaccuaaaaagucugucaugguaagcagccucacuggccaucaggaagggaacuacauguuagcaggacaggaagcuggagaggcggugugugagacucuggcacugccacuccguguacugcucauuagggugcccacaucauucugaagucagaggaugucuacuccaugccugauccauguugacuucauuuccuccacccuuggagccagauuggacugccaagaccaggauaugauaggccuaaagagaguacuucuggaauaggagagggcagcuccaucagcugcuguaaggaagcucuugagaggacccuggugcugggcuuuccuuacuggguaaagcagacagaacaggaagguguuggaacucuagcccacagagucaaguuccaguagcuauggacaagaguccugccauuggccuggaauagugaggaaaagguuggggcucuuccauuuccuugcuccccccuccuugaaaaaacaaccuucucagcauccaacugucacuggacccuugaacuugcacuucccucuccaugguuucacacaaccugcuuccccacuuucucugagagaccucuuuaaagaggccccagugccucuuugcugccuuggccuucagcccuacugcccuggugcaagccugcauauuuacagucuauuggauuuuuguuugcuugccuuucuuaggcuguggcucauagagggccacacugggccaagcaacccccgaaaacccuccagcaacacuaacacacugaagccccauuucaucaauaucugcaggaacuggagcucagccccuuuacccaaguucccucaaggguauacauuucaagccuggauucgggacuccacgggugcucugggguugguuaaagaucuggcagacagugcucaggaacugcuacuccucauguggacuuuuuagguaaagaagaagaaguucaagcuggauaaggauaaugggaugaguccuggagagaagauguucaauguuccucacaucacuuaugaucccccagaggauaggaggccagaccauuucuccauugauggcuaugacagcucagguaagcaagcuaccaugugugcaggggcaggacauucagugcugacccuacagcagggucaaccuggcuguggggagcuuccaugccaccugucccuaguccuccccuggcacucuguccauaaggccgcagagcacauacacagucacuugccuaccuuggaaacgaugcaugucuugaggucucugcuacuggacuagacuuagaagcuucuggcggcuuugaagccgugcucuccuagucuguuucaggugguaaucacuaugcagucuguugaagggauaccuacuacugguuuagaauguugagggucagcauggccugaccuggccauaagagggaaggugacauguguguucuauucacugggcuucuccuuuuagcacccaaggucuuuguuugaaagauggcuguggugaccucuuggagguuugcccacugauggggaagcccagaagugagggugguaaagaugaagucucugcaggcccuggggggaucaguggcuagcuggugaaaccaugagggcauuuuguaggggucaaugucuugauggauacauuucuuauacagcccuggguuucuaucuagcaucaccauccuauaucccuguaucuuuccuuccauggcuugggugaggccaagcccaugggacauagugauaagaccgcaggccugugaaagguuugcaugcuugggcccuaguuagcuuuuccucuguaaggucauagugaggcucugugauaagggaacucagagagguuaagcauauuuuccagaccaugcagugagaauauggcaugcuccuagaagugccucugggucaccaguuacaaagcagauaggcaagggcacucuucauauccuuccucuggacuggaaggggaccacagcaggaguaaaaggucuccuuaccagagagauuucucaggagguacgggugcuguuuccauuaugaagacauacggucaagcauugucccaggagacagggcucugugggucugggguuuucacauuucuggucucagauguggauguacagucuccuguuggagacuggacacuccuuucaguaucugggccacuaagagucaugcccagccucaugugccacauggccaggucuugugccuggcaggaaggaggcaaugauguuggaugcuugguagagugugaacuaaggguugagaccaacagugugugugcagcagugucuccugaguuuacagcauaaccccugggagacagcauagguggcuguggaagggacuuccccuguaguucucauauaucucuaaaaacuucagugcccaccucaggguaaaugacucuagcagcugucuauaacucaaguuugaacuguucuggucuuuuccuuccccugaaaaguauggguaucgagauaguaagcuagauugugagcuaggccugggauguggcccaugucaccguauaccuuuugcucagcaucuccugggaagccccuuacacuguccugcuggcuguuuccucccaagacuguaugcuaaggcaaauaguccagacauccagcauccacagguucuucauccucugacucaaucuguuuacagacuauuacguggaaguuccucuucuaaagaaucgggaggugucaugaagacguacaagcagguucuccgcaaaugcuaugccauuuuaucuaagggaucagaguacccaugaauuggggcagcccaggaaccacucucccaaaggcagggaggagagacuuugcccaagaugcaguccuggguggagggggcaccugacuaaaagcacaauaagugauaguuggaccucaguacuugaggucaggagagagcccuuuuccagauggagagguggaagcuugagccaaaggcaccaaugcucaccucauccucucuccccauccuaccugaauacuuguuugcuacagcaaugauaggcaacccacuaccuagagcuggcuccuaagguccugguuucucccaucagaaucuugccucucauucagaauuguucugcuuaccuucaagaaucccaggcuccaugggaaggcuucauuugaguguccuguuagagacugaguguccagucucaugugccacaauggccaggucuugugccuggcaagaaggaggcacugauguuggaugcuugguagagugggaacuaaggguugagaccaacuguguguguguagcagugucuccugaguugacacucuaucccuccacucugcugucauguaggugugucucucccuucucagacuuccucccagugccugggaccugccagaauguuuugugacuaaguagaaugcuccaggauccuccagaaacuuccagcucauuggcaguuguaaggacaguuucagguacagcagagggugaccaacaguauuauucuucaucuuucuucuaacaagugucugggccccagccuaccaaguccagcuucucuaagggcagcugaucugugucccgugucauuguucccaccaccacaucuuggcaggagggugggaaguguucaagaaaggggccauggcuguucuaugcucucgaaggcuaucuuaggcaucccgucugucaggacccagccugggccccacuuuacugagcgccaagcugcugcguccucaucagauggcauggggauuuggcucggggcuggccacaucuccaugagccccugggacauacuccccgccugcccacuggagcgggcacaaagggcaauugugccaacaaaugcccagugccccugcagcucugcuucagggguaggaccauugucucaaugcaaauaggggcuuucugcuaaugcuaaugggcagguugggcgugagcagaggcggcagggaugcagcccugugccugcccaggagaagcaucacucgauguuuucugaauacggggcagcagugucccugccguccauucagccugcuuaguguuaugaaguccgcagugaugucugcggcauguuaaugaggugcacgagcagagaaagcagcacugcuuguggaaugcucccacaccgugucgucucuuucuguuaaugugauaagucagccuaguccagagccaccagauuuuagagaccgagccacuggucuugccccucuaaggaucuggggcaacccuuacuucacagguuaccugauacaccccaaucuucucacccaagagacucuugggaaucuugagcacucuggcauagagacgaggugcuaaucccaggcggggagggaggguugccaucacugggaaagccccagagugccugcucccacgaggcagaucccaagcagacacacugacuucuagugccaggcuaaaccgggacuuggaccucauuuguguaugagaacuaggaagccaucaucuuguccuugcagaggacacuuaccuguucauggugugcaaaaaucuaccuguauaguguucuuuuacuauacaguggguagaagugagcugcagugcuggucccaacuaaagaugacuagcagagacccagaaucaugcggggaccuccccuguaaggacacucuacuaagcucaccuaagagaugugugcaggugugguggaauuggacugguggaagcagguaaaguaaggggucuuuuuaugguagcauuagggcucaggcuacccugcaguaaaaaugggucugugccuccuguaaagaaacacuguggaaagcagaaagaagucuacaacucccccaaaggcccaccacucuugccaggaucuuguaccuuuacaggggacagaaugcuaacagagaggguucaggggaccauauaggccugagaaguauugucucucacucuuggaggacucaagccacaugccauucaacuuacuagcaucccagagggauugauauccaggcucaaggaagaagugcaaagcaagacccaaggcccugguugauggagaagccauuguccaaguucagguccagagaaccugacccugguaacuugacugcugcuguccauagggaucuuaaggacucaauguaggauuagugggcaucuccacacuaguagccacuguggguaaggcuugaguauucucacacacacaguaggucugcugaugugugucaaacagcaccucugacuuccaguucacaaagcuguuagugacagaggugcuugcuggaugcacuccacuccaauccaggcaggcugugaauuucuaugguccccauaggauuauauuuuaaauauauugcugacuguugucucauguggacccaucucuugagccccgugacuucugguuguguucuagguauacuguuaaucccccacugacacacacaaauacacaaacacacaaacacagacacauaagcacacauguacacacguacucacauacacuuacauacacauaugcaaacacacguauacauguauacucacguacacacacacacacacacacacacacacacacacacacccuuccuggaauguguugcccaguguuuugauuuuaucuuuuuuagauucuucuucucauuaguugcucacauugcuaacagugugaaccucugaggcuugcuugcagguuuaacuggaccuccuuuguccuuaaguauaggcuucuucuagggcuggucuuggugagcauucagcugcagcuggguugcaucuuuuaauugugugcucacuccuaggugaugauuuaguuggggagaaagauacauaggaauaccucuuugugcaugaccuuuucauuccuggugacugaaaauucuccuuugaguuugguguuaccuaaacugugaugugucaacaugguggauuuuuuuuuuuuaaaucacggguugugguacugacugaaucugagggcuuaugucuuccaucaagcaagcaaagugacuacuauaucuaccggaaacuguguguguacauaugcuuauguguggaggccagaggacaacuuuggguaucauucucagaacacugucuccucauuggagauggagucucuuauuggccuaguguucauuaauuaggccagggaacuccaggaaucucgcuaucucugcuuccacauugcugggauugcaaacacaugccaccacaccaugcauuuuuauaucgguucuggagauaaaacuaagguccuuguaaagcaagcaguuuacagacugaacuaucuuucaagccucuguccuagaauuuucuguuggaccaucucagcuuggccuugccuaucucauguccuucucaggcuaaccauacugcuacuguugcuaacugcagguaugucucaugcacggccuuacccggccacugaggcaguccuuuaguuaccuuagauuuucccaguucugugcauccuuguguggagcuuuaaaucagcuuguaccucucucauaguuuacaucacaaguuuuaauuuugaauucaugguaauguguuuauuuuugcaacaucuauugauaauuacaaccucugcagugcuuguagucuaauaccaugugcucuuuuucauaguagcuuuugucucuaagguuccugggggagaccacauuacucccaaacaggauaacccagggaacacaaucagggucuuuggggacucagauuuacacaggauuuuguagagagcucaugcacuggggguggagacuuaugucuuagaaagcuggccucugucacacaggucaagcaaggaacuuugguuuuauucaccagcaagaauagaccaagacaaaugaauuuccuucauuucccuucccaccagugugggcuuuuucauuugcuuuguuuauguuucccuugagucuacucguuugcagccucuauagggccuaguucuacauugggaaguagaggaugcaguucucaguuaccacuucuugccucauaaagauuccagacucaccuucuuucuuuagggaucaucagauuccacaggugacuacuugggcaggcugagucacaggcugagucacaggugagcuguuucaggcuggaugugcucugcccagcugcaccugcucucuuaccagcucucaggacugauuccagagccacauuuaucgagugaucccagagggacaugcaaggcagguguucucuuuccacaaacuugcccagguacuugcagggaguggagacacagagguuuccucucugugucagagaaaguucucuuuacacaggggaccagaccucaccugcagcagacuuagcaucucaugucuccguacugugggcuguguugacugugcuuagguccuggaaucuguaugaggcacucauguuacucugaggcagguggcuuauagauuagcccuggggaacuccaagugcgaggccagugccagcugcagggguaagaguagcucuucugugacuucucaccaugcugcaucagagcuaccaggguggaagggccaggccugacuauaggauaaugggaggccuacugcucuuuguaccacugcacuucuguucugggccucaggugugucuggcccaagacuuaauagaaacuucuacuaaucuucccaguugucacaaaucacucgguggccucagagaccugaggaaguuggucaguuagaaaaccuuuuggguuagaaaaccucccucacugauaguuauguaggcuauggugagaccaauaggaagguuggucagagcuucuuggguaaguucugaaucagguucuuaucagcaucacaccuggccucuggcuuuuauccccaguguccugaugacuccccuucucucugaggcuguccuugagaacaugacucuaugauccugccuuuucaccuccgguuuauugcaucaagucuagucugcaugaccagugaguagacugaccaaugugugggcaguuaauggcccuucuacaccuagaagugucaugugacuucugagagcccagucucuucucauuuuuccagcaguguucuacucaaccauuucugucuugacccauggcuggacuuucccaucugacacagcugcccaauagucuacacacuauauuguauaucuuuaaguggaagauuuguccacuuuuaaguuuauauauauauauguauauauauauauauacauacauauauauauauauauauuucugauuagaaaaguagauuauauucaccauggagcacaaauacagaggagaagaggauaaagaauaaccaucugcugucuuacggcuguuggguuuuggacaacuguccucucuuggguguguucugagccugaaucagaaccuucuuauuagcaccacaccuggccucucacuccuauccccaguguccugaugacaaagugggugcacccccacuuugaugacugucaucccuggguuggguccacauugacugcucaguuuuaauccugcuuuuaucuacuuacugugacaugagcauuaaugccugucauuuuaaauucuuuugaaacugguuuguguuguuucuaggcaaauauuuaugccaauaauuuugugguguucaccugcuacauagacucuacaaacuaguuugaaucugaugggaaaagugaccuaccagcuuuacuuuuuuguuguuguuguuagaaaucuauuuaguacuuuacucuucugaacaaugcugcuucuggcauuuaaacuuauuccuuugaagaagaaauaaagucccaauuagugacuauuuagaaaaauaaugaugaaaauaaucaacaucagacccuaugacacauauguaaagcacguaaauuauuggugacuaauuauucuguuuuaauuauaggaggggcauauguacauaauugcaggugccugcauaggacuagagguaucggauucccuggagcaggaguuacaggaguuguaagcuauccacuguaggugcuaagaaccaaacuagaguccucugcaugaguaguaugcucuccuaaccgcuaagccaucuuuccagcuccaugaguugauguuucuuaaaacaacuuacaacuaaaaacaggaaaauaauauguauaaaaggagaagaaaaaaaucuauaaguaguuuuguggauuuuaaugucuuuauuauuagagaugguaccguuagacacaaaaaucaacagaaauguggaucugagcaauacuuugaaccaaguugacuuaaugcugguagagaacagcaggauagauauggcugccaacuacacagagaccacaugccaggacagaccauauucugagcugugaaaaaacuuuauaaacuuaaaguuacucaagucauauguucuuuuaccacaguagaauuaaauuaaaaaucaauuaagaagauggcaaauucugaacuauauggaaaauaaagaacaugucuccaaauagcacagggucagagaagaaaccuaagagaaaaaugaguguuuuaaaucaaaugaaagugaaaacacaacaagcucuaguuuauaggacacugcuaaaacaguucuuagaggaccauauagcaccacgcaagcggugaaggccucagacugggaacuauaaaacagcuaaauaaaccaaaauaaguagacuaaaggaaaauaagaauuugcgaggggcguaagaaacuaaaaacaggaaaaaaaauaaucaaaccauuguugauuuuuuuuaaggccaggaaaaucaauaagugacuaaccagauagaccaaagagcaagcgugaugucgcaacuugucagugucagaagugagauacccagcucuauauaaaugacaggacuuaaaacuacaaaacuauccuguacagcucuuuguuacuauauucuacaacuuagaggaaauggaaaauuucuuaggaaagguaaagugcagacagauguaacccaauuaucuaucauggauaaugcacacacacacacacacacacacacacacacacacacgauaagcauacucugggaccauguugcuuccugaugaauccugccauauguuuaagaagcaaacucugguuucuuuuaaugaagggaauucuuuuuaaauucugggaccagcauuacccugauaggaaacccagccauuauaaagaaacauuauaaacauuauaaaaacauuauaagaaaacuguagguaauaucacuugugaacacaaauccaaaaauuuuaagcaaaagaaucaauuaggguucaggaauacaaaguuaguuugaauuuaauuaguaaaaugaaacauuauuuuuuuauuuuauuagauauuuucuuuauuuacauuucaaaugcuauuccgaaaguucccuauacccucccccuccccugcuccccuacccacccacucucacuucuuggcccugucguuccccuguacuggggcauauaaagaaaaugaaacauauuaauaaaugacaaaauaaagccauauuuaucucagaagaugcagagaaaguacuugaaagaaaucuagcaaaaaaaauuaugaaguaaaaaauagaagcuuccuccaauugaaauagguuauugaaaaaaaaaaggccugcaugcaguuaacauauucaaugaacaaauauccguuuugcccauaagucaggaguacaaauaucugguguuaugauuucuauucaacauuaaguuggagaugcuugccuuuggaauaagguaagaaacagcaaguuggaaaagaaaugaaacuggcauuauuuguagauuuccugguugucuguauagaaaaucugaugugucagauuggccaccagaauauauggauucaguugcauauacaaaguagcucugcaaaaagcaauucuacuucuaaauucuagcuacaaguaaggcagaauuggaaacuuuuaaauacuauucugaguagcacuaaacaugugaaacauagaaaucuauuugacaaaagagcucuccuuuggagccuauauaacuaugcugaugaaacuucaaaaaaauaaauauagauauauaauuagguucacaaauuacaagguucaauauugauuucuaaauucaguauaaagccagucaaagacuagcaugcagauaaccuagaauaccaaagcaacuuugaacaugaacaagguuugaggaugaacaccagauguauaaugucagcauaaaaaccaaacagauagugggggaaacuggggaucagguggacauucaaauuuauugacaggugcuuucuaauccacauguaaagguuaugcuagguuuuguuuuguucuguggggaggagacaagauggaaaaacuggauauucaguucaaccaugaacuuuuaucauuuccccaaaaccauguuaaaauggucauagaacugaauucaaaggcuaaaccuuauaggacaacaacaauauaguuaaggauaucuuugacacagcaucaaaagcaugugaguauuaggaacaaauugguuagccaggcuucucaagcaugcuuuuugaaagacacaaugaaaaagacagauauugaaagaaagcauucugguuuugcgugcauugcaugugcacguggaauugugcaugcccaugaacucacaugcagaggacaaaugauugcugucuuuuuucccccaauuuuuauuagguauuuucuucauuuacauuucaaaugcuauccugaaagucccccauacccacucccccgcuccccuacccacccacucacauuucuuggcccugguguuccccuguacuggggcauauaaaguuugcaagaccaaggagccucucuucccaaugauggccaacuaggccaucuucugcuacauaugcagcuagagacaugagcucugggaagguacugguuaguucauauuguuguuccaccuauaggguugcagaccccuuuagcuccuuggguacuuucucuagcuccuccauugggggcccuguguuccauccaauagcugacugugggcauccacuucuguguuugccaggcacuggcauagccucauuuuuuuacggcucucuaccuucuuuuccucaagcagucucucacugaacuggaaguucaguguuccagccagacuggcaggucacuaagcucccaggaucugccugucucugcccacccuacccacaguucuaggauuacaguuaugugcauucaugccaguuuuuuuuuuuuaagcguggaugcugaggauuugaacaccaguuuccauguuugcacaucaaacauuauugcucacuaucccaaaccugaaaauauuuuacaaccugauaccuaaaaaagaauuuauauucagaauaugugauggacacuuuaaacugaaaacucacacauuacaaaaauggguaaauuguuuaaaucaacacuucauagcaaggaagacauauaggaaagcauguaagacaaugcccagcaucauuaguuauuggagaagugcacaaagguagacucuacuucauaacuacuaauugccuaaaauuaaggagauucaccagguacuggugaggacaugaaagaacucaaccaguuguaugccaugucguggucacaaugauucaggaacacugaaaaacaguuuaaugguuucccucucucucucucucucucucucucucucucucucucucucucucucucucucuccauuuggaaacauuccaaaagcagucaacauuugaguagagaguuuuuuuggcaaaguuguucuguguccauacaauggaauacuacucagaaguacaaaggaaugaacuauugauacaccuaacauggaugaaucaccaaguaauuacagugagugaaagaagccagacaaagaguucauacugucgucuucuguuaccacagcacucuagaaaaugaagucuaaccuagagugacagaaaggucaauaauuaccgagggguggagcagugguaggggaaguccaaaagggcaagaggaagcuccugggagcacuggauaugcucauuaccuuaauuguggcagcgauuucaacacaugucaaaaguuaccaaauccuacaauuuaaacacgugccuuuuauuauaugccagcuguaccucagcaaagcugguaauagaauauauaaaauuugcacagcaaaaaaaaaacccaccaaaaauaaaauuuaaguguuaaccuggggaaacaguugccacccauauuguagacacagagugaauuauuuucauucaauuuuucaaagcucuuuauauugagaggaugauuuuuuaaaaaggaaaugcuacugauuccaggggggaaaaugccagacuguuucacuuaugauagagugcaaauauaagcaacgguuguuucuuugauuauuaaguaagacaccaauaauacuccguuggugaguauauagggaaacuuggccuuagucauugauguuggaagaaaagagugaugcaaucucacuaucuaaaguaaaacuguaugcaaucuucaacucuucuauaaauugauucuauacauuugaaagcuguuuuugucuggagauacugaugcuaugauugcuaaguagcaaaacaaugcaaauugcuaauauauccaucuaugaagaucugcuuauuugcuggggaucuaucagucauuaaaacugugagaaugggcuuuuucuuucuuucugcaguaugaaggacagcccugauaucugauccuguaaguuacagaaucucuuggcucagcaguguguaaaagguuccaccaugucuuugugaaugcagugccaugcaguugaagaucugucugcuuguguuccaaaacaguuugaaaacauuagaaugauggucucuuuaaagguuaagcaguggcuggaaauauggcucagugaguaaagauaccugcugccaagccugcucaagauaccugaguuugauaacugguaccuacauguuggaaaaagagagccaauuccuacaaguucucuuuuggcuuccacacacaugcugugauuugcacacacuaccaccacccugcaugcacaugugaccacaugcacauacaauaaguguaaaaucuuuuaaauuuacacagaacaaaauuguauaaccaucuggaccuaauacgaaaucguaauugcuuuuagucuuuucugcgguaauguauucuaaauuaguuuagugcauguuuuaagggauaauuuauucauugcuauguaauuuccugaagcauuucaacuguguugacacuugguagcaacuaauuuucuuucaguaguuuaugcucuuuucuauaaauuuuucuugccugugcuuuuauagucuugcuuuuuucuuagucaaguucaugagaaauuuaguuauucuguuaauuauuaaaauauuauguuuauuaucuuaucagaaaauuaccuuugucuauauuuguuuucuucuuagucaucuuggacuauaauaucuauuaauuccaucuuccuaauuaucuuuaauuuauguauuuucuuuuaaaacuuaauuaaggguaauauuuaguucacuuauuuaaagucccuuuaccaagagacauuuuaagaguuauaauuuuuccucugaucacagcuuuagcugugauauguagggcuugguaugaaauaugaccaauuucauucccuuuuugauaauuuuucguguuuuguuuuuucucuuuaaucuagagcucuuuuuaaauguuugcuuaauuuuuaagcaauacauuuuuaucaccguuauuuauuucccauuuaauaggcucccagugaaagcaugcagucugugaaagcuccaguuuucuuaaaagagcuccuuugcagcaucaaagucugaaaauaagaccagugcuuuuguaauuuuuagcuugggaugugaccuauuccacccaccuaaguuaaaaacauaccuucucuauuugaggggcucagauuuguuuguauaaacagauaaaauacaugacgauggauuauacauccauccauauauauuuacuuauuuauuuaauugguuggauuucuuuuucccucuauuuacuuuaccccaacugaaauagcaauuuuccaacugaaauagugaaauuaaauccuuccuuuacagcucugcuuuuuaaaaauguaggcaaauucguaguguucagggcacuacuuauagcuaugcuucuugagaccacgacccuuucccacuauuuauuauuaugugacccugauccaucuacuuuuuaugccucuauuacacaucaaugaaaucaagcuuccaacuguggggccagcucacuaaguaaagguacuuucugccaagacugaugaccugaaaccaauucccugcauccauaugcuaugaggagaaaaaugguuacuggaaguuguucucuggcauacacacacacauacacgcacacacacacacacacacacacacacacacacacacacacacuguccauacacauaugcaugugugcacacacauguacacacaaaaaauaaaguaaguaaaauaaaauuuuaaaacaaugguaagaaaagucuaucugucuacggcaagaauuacugcagugaacaaauaugaggaugucgguuucuacccugcauacagugaaaacgcuggugucugucuccucagauuuaaccccaagcugcaacaaugccagccuuaaucucuccuaucagacaacucugugcuccauaaccuucuauuuuauuccucaugccacaaaucuugggggggggaggggggagagggguauuuuuucuuaaaaauuauaucacuuacuuaugcucuuagauuuacagcugacuauauuguauauauacaaucuuuuucugcauguuucuucucuguugccuacauugauuaacaaugauuuuauucucuaauguuuuccugauguccauauaauacacagugaaauaaaccauaccucucaugaagaggccuuauuguugucuuugaaacacauggaaggcacagcaugcaugcuuuucugccccuugcuuuucuuacaaucauacuacuacagcuuccucugagcuucaggaacaauucuguucaucucucacuucuauuuaaaucuuagagucucuccuucauucucccuuguaugccuauaccgugauauucuucguugcuugaaauauauuuugcuuuagguuuaagcuaguuuucuaaaaguuuuucuuaaaaucacuucccaguauaaaggcuuuuauuucuaugcagugaauucacaaacuucauuugccaggguugucaaaaacaaaugcugaauugagaggcuucucaaaaagcaggagcccacaagacucagauuggagugccagcagguugcuucucucuuaaaaccucucuccuuaacucccagauggccaauauaucccugugucuucugucuauauagccacacuuugggacucuuucuguaucccaauuuccccuucuuuauaggcacaccaguaaaauuggacucaauuuaacugucuguuuaaaggucugaucuccuguuaaaauucugaaauauuggaaaugagggccucaacuuagaaaauugauggggacggaguucagccccuuacacagggauggaugcauuguuaaauugcauguauguugccagguugcuuuccucaagugcugucugaccucgcauuuccacaggcaggguuccccuuuccugacaucccugccagccauuauuggcagagaaauuuuccaucuuguuagccaaguggggcagggauacucuacugcggaaccauugacauuuggcaggagauaauucuuugucaacgaagagugccccauguacuuuaggauguuuagcagagccccuggcuucugccaggaugcuaacacagcauuccuucaguugugacaaccaaaaauaaaauaaaguaaccacaacucucuacauauuaucaaaucuacccccuccccgaguuagggcaaaauuagccugagucaaaaaucacuggaauauugugcuaucucauagauguuucuuuaaaacauaacaaaacuguuuuauuuggaaguaauaaugaacuacagaaaaacugcaugaacgauauauaagacaucuucauauccuucauuaagauuugagguacacuuauuaccauuccagccucacuugcuuuuucauuucaauauuuuuauauguguauuuguacacuguguuccuuugcaaaacuugaaagggaauugcacacuuuacagccccucaccccuagacauuuugcuguguauuuccuaacaauuuauuuccuaacuguacuacaguuuaaggaggaugacaacaucacauuuccucccuuugaaagugauauaacagacaucaacuuuggcaauuaaacauccauacagucacugaaauaacccaaagccuauauucuacucuugucagugaacacaacaaaguccuuuggugcagcuguccccaagugcaaggcccaguccauguucuauguugcccuugguugugcauauuuaguuacugugaaccuggguauuucuaguaucucuuagucuuuuuucuuuuuacaucaaagucacuuuuugagggauuucuuugauauuucuuuauaauuagauacagauuguggauucccaucuggaauauuccagaaacaauauaauguccuucuuaggauaccauuucccaugauguguguguauguguguguguauauauauauauauucaaugauggugaugguuugaucacuccauuaaggcacugucuguuuuuccacuguguagucacuauuauuuaccuugaggcagaugaacuugcuguggguauacuauaagcauuuuaaaauaccuuggucuguccugauuaagaugcuuucuggaacuagucuuuauuaugguagcugcaaaaaugauuuuccaucuauaauacuccauccaaaaagugcugagaaaaaaaagucuaccuaguauuuuguuaucugauuucaguccugaugugcuuuauaaaugguauugaauauuuuuguauguguuuauuggucaguuacaugucuucuuuacugguauauguauuuagauccuuugcacaguuguauuuuuucacagauaugggaaggagauggcacacucauaccacaauacaugcauggagaauggaggaaaacuugugggaguuucuuuucucccucuacaauaugagucuuggggaucaaacucaagucauuaagcucagcagaaagccccuuugcccacuuucuuacugguuuccuuuugcauacuucuaaaauucaagcuuuuaaucuaauuuuagaaauucacauucauuuguaauaaauaaugcaaagagaucaucuauaguuugaaaaacucauauauaguuuucccaguaguaacaaaacuguagugcaauuuaaggaggauggaaacacugguucaaugauacagaauauuauuuguuaccacaaagaucccuguuuguccuuuuauagccacaccgucuucccuccuaccaucccuuaauucccaguaaucacuaaucuguucuugauucuauagaucugcuuuuuugagauugcuauauaaauagaaucaaacacaucuuuugaaauuugaccauuuuuagaauuuaccauaauucucuagauguucauccaaguuguuuuauauaucaguaguuaauucagacuuguugcuggguagaauuucaugguauguauaaaccacauuuuuaaccacucacucauccacagacaucuaaguuauuccuaauuuggaauuacuauagaucauuuaauauugacaguauuuuucauuuuaccaauucugguaaacaugcaguaaauuuucuuuuuugguuuuuugagagaggguuucuuuguguaggagagugcugggauuaaaggcauaugcuaccaugccuggcacaguaauguuuuauugugguuuaaauuuguauuuugccaauggauaauaauaaugaaucauuuuuuccacauucuuccauucagugaacuguuuauuuaaauuguuuacuaauuuuucaacugaacuuccuuuuauguuaaguuuuaagaaguucuucuuguguucugaauacagagccuaagucaaguauaugauuucucaguuuuuugcccccucuauagcuaucuaucucauucuauugacauggucuuuacuggagcuauuuuuuaauucauagagaucuucuugucugccucugaagugcuaagauuaaagguucacaggccauagauucuucauuuuuuaaauugggauugugugugugugugugugugugugugugugugaauugcaacgaguucugaguguuguauauauugaauuauguguguauauauguguguauauugauauauaucauauuuauccugcuacaaauauucuaucaacaaacaauuuuugaguauuuucucacaccuauguauugccaucuuacuuucuuuaaauuuuuugauaauuccuuuuuauguguauuaauguuuugcuugcauauauaucuuuguaagguuauuggguccccuggaacugaaguuauuuuagcugccauauagguguuaguaauucaaccaugguccucuggaagagcagccaauauucuuaaccgcugagccaucucuacagcuuccacuuucuuuguaguauacccccaagcauaaauuuuuaaaaauuuuuaauaaaguccagugaaucagcucuuuauuuuacuuucgguuuauauaaaaaaaauagcaaaacaaaacaccuuucgucaaacauuugguuacaaagauuugacucuauguuuuuuuguaagaauucugcaagauuuaauugcuauuuuuaagucuuugauugauuuuaagcuuuuacauauaguggcagggaaccauucaacuuuauuucccuuacauauauaacaugcuguugaagaaaaauccauccaaaacacuguucauucccucauuuauuucuguggcaccuuuauuaaaaguccauuuaccauagcuaucugguucuguauuuaauaaacuauuuaauagacuauuaauucuauccccucuuauguaugucuguuugaugugaugcuuacauagugccuuguuauuuuauaguaaaucuauauauugaaaaguaugaacccuuuaacuugacugauuugggagauugcuuuaacuauuguaggucauuugggucuuacauaauuuuaaacauugcuuguuauuuucuagaaaagacaccugauauuuugguaaggaucaggucucuacaucaucuugaagaacauauguaucuuaacuucaaguuuuccaguucauaaacacaagcuauauaucaauuuauuuagaucuagacuuucagugguauccugucauucauagaguauaguuuguauacuuuaaaaaauagaucgauuaauuuuguuccuuuuaguuuuguaaaaaaaaaaagaacauaauuuauaaguuaauaauuuuaaauguauuuuuguggcauuaaguacauucauaccugugauuuauucauuuuuacauuauaaaaugaauuguuuucuucauuucauuagucccucaugguacauagaaauaugauugagcuuuauauuuuacaaucuugggauuuugguuaaauauagaaauuuaauuuuacuuuuuuccagacuuguuucuuuuccuuguauaacugaucagaacuucuacacaauauuuaauaaaagugauaaaacagguccccuugacucaauuguggguggcuggguuuauuuuuugagacaacuauauagcccaagaugacaucuaacuuaucuuucuucuucuucucccuccucuggggagauggaauuauauuuguaugccauuauacugaguuaacuuauucuugauuugaagggaaagcauuucaucuuccaccauuaaguacaaugucaggcacugguauuuguuuuguuuguuuauagacagggucuccuguagcccaggguggucuaaacuacucacugugcagcugaaaaugaccuugagcuucuaaaccuucuuauuuccaccacuugaauacugagguuaucagcaucuaccaccauaucuguuucaauggagcagaggauugcauggugcaauuuacauauaaauucgugguaacaccuacucuugugguagcuaacagaucucugagguucuguucauuguucuuccuuacucuuuuuuuucuguccuuuaaacugaauaaucuuuauauaucuauauuuaaauucacugauucuuuuucucugcucccagcuuaucuugcaaucuggcucuacaaguaagguuuucauuuaaguuauuguaauuuguacugacaacuuuauaauauaucucuuuauuaacauuucaucugaugaguuauugucacaauguuuuacuuuuauucuuuaaaacaaggcuuauuuuagugugagaauauuuauacuuugaaaucuugaccuacuaaaacuaguauuuagguucucucagugaucauuacuauuuacaaaucuuuaaucucucuagccccccucuccacuuaggaugauguguugauuuuuaggaacacuacauuugaauuuuuucccaucuacgugggcaauugcuuguuucugccaugccugugccaauuuugcuucuauaguguuugcauuucccggcaauguguguaucugauuuaucuucaaguuugcucuuuagaaaaugacugucuuuguuuuuaaagcaugcuuuaauugaucagcuuaagccaccauuagucagaggccuuguuuuaaguaucucaagcugguaaauuuuccugaaagggcuuugccuuaggauuuccauucaacauuuggacucuuuacaacuguccuuuguuuuaccaucuugucuguauagugucucacaaucagcaguguagauaaggagaguacuucuggucuuuuuuugagaguacagaccaucuuaucucuaagaauuuacuaucuuuuuguguguguguauuuaugugcaacaaccagugcuagagcaucagauugcuauaacaguggcuuuaaccaguaaaugccuugaggacacuauuuuuugacauaaagaaugagacuggcaauagaguucaaaucagguuaggcuucuucauuggaagaaaagaugcuagucuucaaggcuauuguacucaucuggguaugggaaaggcaaccuuagguuaaauuuccacagaccuugcaauuucuauggagauuuaucagauuuuacuuuuguaguuuuuuuuaaaaauaauugugauuaaauaggguccucacaacugaaauaaguacucuguuucugcuccacaacccuaauguuuuucuucaguuuguuaugugacuuuaauuuauauuucugaaaucacuguuuuugacagucuuguucagauuuacaaugguaaaaaauuuaaacacuguauuugcuuguuucuuuagaaaaaugagaauuugcuaguuguucauauagaguggugauucucagcauuccuaaugcugugccccuuuaauauagauguucauguuguggugcuccccagucauaaaaauuauuuuuguugcuacuucauaacuguaauuuuguuacuauuaugaaucauaauguaaauaucugauaugcaggguaucugauaugugaccuuugugaaaggggacaugacaucaaauuugagagccagugguuuagagagauggagguuugccauuauccagacugcucuugaacuccuaagguaucauucuuacaaaucuuuuccccaguaccuagaacuauggcuacccuacugagacuuuagccuguguuucuuaucccacuguuuuuuugaaacugcccacauguuuguuauuaaaauauugaaaauaucaauauauuuccaaaagucaaaaaugacacaugccagguguggugguauacgccuuuaaucccagcacucgggaggcagaggcaggcagauuucugaguuuggggccagccuggucuacaaagugaguuccagaacagccagagccacagaggaacccugucucaaaaaaaaaaaaaacaaaaaaacaaaaaacaaaaaacaaaaaacaaacaaacaaaaaaagacacaaaauaaucuacugagagaagccuuuuccucccauaucccuucuauauucauaagccccaacucuuguaaguaacaaaauguaaguuuucugguuuagaguuuauguguggcucuuccaaauacauguaaucaucuuaucauuucaaguuauuuauuuaaaaagaaauauaucacccauucacagauaguucuccuucguugguacacuauucauuguauaguauuccuuucaauuaaugucuaauuuauguguaugugauuucuagauggaaucuuuacccauuauuuugugaucuuuaguuaugcaacauuaccaccaauuacaauuagacuguauagacgguuuaucugauccugaguuaacauugguaccugguaucugucuagaaaauuguccauuucaucaagguuuuccaguuuuguugaguauaggauuugugguaggaucugaugauuuuuugaauuuccucgguuucugugguuaugucucccuuuucauuucugauuuuguuaauuuggauacuaucuccguauccucugguuagucuggcuaaggguuuaucuugauuuucgcaaagaaccgcucaugguuuguucauuauuuguauagaucuuuuuguuuuuauuugguugaguuucauuauuuccugcuaucuacuucucuuggguguauuugcuucuuuuuguucuagagcuuucagguguguuguuaagcugcuaguguaugcuuucucugguuucuuuuuggaggcacccagagcuaugaguuuuccucuuaggacugccuucauugugucccaaaagucuggguauguuguggcuucauuuucauuaaguucuaaaaauucuuuaauuucuuuauuucuuccuuggccaaguuaucauugaguaggguguuggucagcuuccacguguaugugggcuuucuguuuuuguugcuauugaagaccagccuuagucuguggugaucugauaggaagcaugggauuauuucaauauuuuuguaucuguugaggccuuuuuuugugaccaauuauauggucaguuuuggagaaggugccauguggugcugagaaaaagguauauccucuuguuuuaugaugaaauguucaauagauaucuguuaaauacaucuguuucauagcuucuguuaguuucacucugucccuuuuuaguuuguguuuccaugaucuauccauugaugagaguaggguguugaaauaucccacuauuauugugugagguacaaugugugcuuugagcuuuaguaaaguuucuuuuugaauguggguguucuugcauuuggagcauagauguucagaauuuaaaguucuucuugguagauuuuucuuugaugaguaugaaguauccuuccuuauccuuuuugauaacuuuugguugaaaguugacuuuauucuauauuaggauggcuacuccagcuuguuucuugggaccauuugcauggaaaaucacuuuccagcccuuuacucugagguaaugacugucuuugacauugaggugcauuucuuguaugcaucaaaaugcuguguccuguuuauguaaccagucuguuaaucuaugucuuuuuauuggggaauugaguccauugauguuaaaagauauuaaagaauagugauuguugcuugcuguugcuuuugauauuauuuuuauguuuguguggauaucuucuauuggguuuguugaaagaggauuacuuacuugcuuuucuaggguguaguuucccuccuuguguuggaguuuuccaucuauuauacuuuguagaccuggauuuguggaaauaaauuuuguaaauuugguuuuguaguggaauaucuuguuuucuccauauaugguaauugagaguuuuguuggguauaguagcccaggcuggcauuugugaucuuuuagggucuguauaacaucugcccaggaucuucuagcuuucauagucucugaugagaagucugguguaauucugauaggucugccuuuauauguuacuugaacauuuucccugacugcuuuuaauauucuuucuuuguuuugugcauuugguguuuugacuauuaugugucagaaggaauuucuuuucuggcccaagcuauuuggaguucuguaggcuucuuuuauguuuaugaacaucucguucuuuacauuaggaaaguuuucuucuauaauuuuguugaagauauauauuggcccuuuaaguugggaaucaucacucucuuuuuuuuuaagauuuugauuaauuuaauuuauuucuuuucuaugauaucauucuuuuuauuagauauugucuuuauuuacauuucaaauguauccccuuuccuaguuuccucucugaaaauucccuauccccccacucucccugcuccccaacccacccacuccuccuuccuggcccuggcauuccccuauacuguggcauagaaccuucacaacaccaagggccucuccucucauugauggucaacuaguccauccucugcuacauaugcagcuagagacaggagucccaccauguguuuucuuugauuggugguuuagucccagggagcucuggguguacugguuaguucauauuguuguuccaucuuuaggguugcagaccccuucagcuccuugggugcuuucucuaguuccgucauuggggacccgguguucuguccaauggaugacugugagcauucucuucuguauuugccaggcacuggcagagccucacagaagacagauauaucaggcuccugucagcaaaaucuuguugacauccacaauagugucuggauuugguagguguuuaugggauggauccccagguggggcagucucuggaugguccuuccuucagucucugcucagaacuuugucucuguaacuccuuccagagguauuuuguucccccuucuaagaaggaucgaaguauccacacuuuggucuuccuucuucuugacuuucaugugcuuugcaaauuguaucuuggguauacugaguuucugggcaaauaaccacuuaucagugagcgcauaucauguguguacuuuugugacuggguuaccucacucaggaugauauccuccagauccauccacuugccuaagaauuucauaaauucauuguuuuuaauugcugccuaguacuccacuguguaaauguaccacauuuucuguaucaauuccucuguugagggacauguggguucuuuucagcuucugccuauuauaaagaaggcuucuaugaacauaauggaacaugugucuuuauuagcaguuggagcaucuucuggguauaugcccaggacugguauugcuggaucuuuauguaguacuauguccaauuuucugaggaaccgcuagacugacuuccagagugguuguacaagcuugcaaucccaccagcaauggaggaguguuccucuuucuccacauuuuugccaguaucuacugucaccugaguuuuugaucuuagacauucugacugguaugagguggaaucucaagguuguuuugauuugcauuugacuaaugauuaaggauguugaacauuuuuucaggugcuucucagcccuucgguauuccuuacuugagaauucuuuguuuagcuuuauaccccauuuauaaugggguuauuuguuuuucugaaguugagcuucuugaccucuuuguauauauuggauauuaguccccuaucagauuuaggauugguaaaaauccuuucccaaucuguugguggccuuuuugucuuauugacagugccuauugccuuacagaagcuuugcaauuuuaugaggucccauuugucaauucuugaucuuacagcacaagccauugcuguucuguuuaggaauuuucccccugugcccauaucuuugaggcuuuuccccacuuucuccucuauaaauuucagugucucugguuuuauguggaggucuuugauccacuuagacuugagcuuuguacaaggagauaagaauggaucaauucgcauucuucgacgugauaaccaucuguugugccagcaccauuaguugaaaaugcugucuuuuuuccacuggaugguuuuagcucccuuuucaaagaucaagugaccauagguguguggauucauuucugggucuucaauucuauuccauagagcuaccuguuugucgcuguaccuguaccaugcaguuuuuaucacaauugcucuguaguacagcuuaaggucaggcauggugaguccaccagagguucuuuuauuguugagaauaguuuuugcuauccuagguuuuuuauuauuccagaugaauuuucaaauugcccuuucuaccucagugaagaauugaguuggaauuuugauggggauuacauugaaucuguagauugcuuucagcaggauagccauuuugacuauauaaauccugcaaauccaugagcaugagagaucuuuccaucuucugagaucuucuucaauuuccuucuucagagauuugaaguucuuaucauacagaucuuucacucccuuaguuagagucacaccaagguauuuuauuuuauuugugacuauugugauggguguuguuucccuaauuucuuucucagcccguuuauccuuuuuguagagaaaggccauugauuuguuugaguuaauuuuauauccagcuacugcacugaagcuauuuaucagguuuaagaguucucugguggauguuucaggguaacuuauauauacuaucauaucaucugcaaauagugauauuuugacuucuuccuuuccaauuuguaucccuuugaucuccuuuuguugucuaauugcucuggcuaggacuucaaguacuauauuaaauggguagggagaaagugggcagccuugucuacucccugauuuuagugggauugcuucgaguuucucuccauuuaguuugauguugguuacugguuugcuguauauugcuuuuauuauguuuagguaugggccuugaauuucugaucuuuccaagacuuuuaucaugaagggguguuggacuuugucaaauguuuucucagcaccuaacaagaucaucaugugguuugugucuuugaguuuguuuauauaguggauuauguugauggauuucuauauauuaaaccaucccugcaucccugggaugaagccuguuugaucaugauggaugauuguuuugauguguucuuggauucaguuugcaaagauuuuauugaguauuuuugcaucgauauucauaagggaaauuggucugaaguucucuuucuuuguuggaucuuugugugguuuagguaucagaguaauuuuggcgucauggaaugaauugguuaggauaccuucuguuucuauuuuguggaauaguuugagaagaguuggaauuaagucuucuuugaaggucugauagaacucugcacuaaacccaucugguccugggcuuuuuuuuuuuuuuuuuuuuuuugguugggagacuauugaugacugcuucuauuucuuuaagcgaaaugggacuguuuagauuguuaaucugauccugauuuaacuuugguacgaaguuguccauuucauccagguuuuccaguuuuguugaguauagcuuuuuguaguaggaucugauguuuuggauuuccucggguucuguuguuaugucuccuuuuuccuuucugauuuuguuaauuggauacugucccuguguccucuaguuagucgggcuaaggguuuuucuaucuuguugauuuucucaaagaaccagcuccugguuugguugauucuuugaacaguucuuuuuguuuccacuugguugauuucagcccugaguuugauuauuuccugccaucuacuccucuugggugaauuugcuuccuuuauuucuagagcuucuaggugugcugucaggcugcuaguguauguucucucuuguuucauuuuggaggcaccaagggcuaugaguuuucucuuaggacuccuuucauugugucccauaaguuuggguauguuguggcuucauuuucauuaaacucuaaaaagucuuuaauuucuuuauuucauccuugcccaaggaaucaucgaguagaauguuguucaguuuugaugugaauguuggcuuucuauuauuuaugcuguuauugaagaucagccuuaguccguggugaucagauaggaugcaugggauaauuuuaauauuuuuguaccuguggaggccuguuuugugacagauuauaugaucaauuuuggaggagguaccauguggugcugagaagaagguauauccuuuuauuuuaggauaaaauguucuguagauaucuauuaaauccauuuguuucauaaauucuguuaguguccaugugucucuauuuaguuucuguuaccagaaucuguccauuggugcaagugggguguuaacgucucccacuauuauugugugaggugcaauaugugcuuagggcuuuacuaaaguuucuuuaauuaauguggauguccuuguauuuggagcauauucagaauugagaguucaucuugguagauuuuugccuuugaugaguaugaugugccccuccuugucuuuuuugauaacuuuggguuggaaaguaguuuuguucgauauuaaaaugacuacuccagcuuguuucuucugaccauuugcuuggaaaauuguuuuccagccuuucacucugagguagugucugucuuugucccugagguggguuuccugucagcagcaaaauguuguguccuguuuguguagccagucuauuagucuaugucuuuuuauuggggaauugagucuauugauguuaagagaaauuaaagaaaaguaauuguugcuucuuguuauuuuuguuguuaaacuugggauucuguucuuguggcuaucuucuauuagguuuguugaaggauuacuuucuugcuuuuucuagggugugguuucuguacuuguguuguuguuuucccuuuauuauccuuugaagggcuggauaugaggaaagacauugugugaauuuggucuuaucauggaauauuuugguuuuuccaucuaugguaauugagaauuuugcuggguauagcagccugggcuggcauuuguguuuucuuaggaucuguauaacaucuguccaggauuucuggcuuucauagucucuggugagaagucugauguaauucuaauaggccugccuuuauaugucacuugaccuuuuucccuuacuacuuuuaauauucuauauuuagugcauuuguuguucugauuauuauguguugggaggaauuucuuuucugguccagucuauuuggaguuuuguaggguucuuguauguucaugggcaucucuuacuuuagguuugggaaguuuucuucuauaauuuuguugaagauauuugcugacccuuuaaguugaaaaucuucauucuccucuacuccuauuaucccuagguuuugucuacucauuguauccuggaauuccuggauguuuugaguuagaaucuuuucgcauuuucuuugauuguugugcccauguucucuauggaaucuucugcaccugagauucucucuuccaucucuuguauucuguugcugaugcucacauguuugguuccugauuucuuuccuaggguuucuaccuccagagucgucccacuuuggguuuucuuuauuguuucuacuuccguuuuuaggucuuggaugguuuuguucaauucuaucaccuguuugguuguguuuuccuguaauucuuuaagggauuuuuuugguuuccucuuuaaggacuucuaccuguuuagcaguguuuuccuguaauucuuuaaggacuucuaccuguuuagcaggguucuccuguauuucuuugaguuauuaaugcccuucuuaagguccucuacuagcaucaugagauaugacuuuuaaucugaaucuugcuuucuguucauguguguugggauauccaggacuggcugaggugggagugcuggguucugaugauggugaauggucaugguuucuguugguaagauucuuacguuugccuuucaacaucugguaaucucugguguuguuauaguugucucuggcuggagccuguuccucuuguaauucuguuagccucugucagcaguccagcucucuccugaguaucaguggucagaguacucucugcaggcaagcucuccucuugcagagaaggugcacagaggucuggcauucagaacuaccuucugucugaagaugaaggcccccaaaagggccugucccagaagauguguugcuucuguagucuguguacucaccugcacagacuggucuccaagggacccaggacacaagauggcucccucaccugcuccagcagucagagcccucccagguggucaccucucuucugguggggaaggugcccagaugucuggagccugaaacggggucugucccagaagccaugucacuucugccugucccagaagcugugucgcuucuacaauccuguugcucacccuaugcauuccgugagaagaucugcgcagacuggucucagagggacccggacacaggauggcucccucaccugcucugguggucagaggccucuuggguggucaccucuccucuggcagggaaggugcccgaugucugcagcucaaaucagggccugucccagaagcuguguccugaaguucuugucaugcaaaacuuucacuuccuuaaagucacaccaagguauuuuauauuauuugugacuauugugaaggguguugcuucccuaauuucuuucucagcccauuuauccuuuguguagagaaagauuuguuugaguuaauuuuauauccagcuacuucacugaaguuguuaaucagguuuaguucucugguaaaaauuuuuuuuauauauauacucacacacacacacauaaauacuuucauaucaucugcaaauagugauauuuugacuucuaccuuccaauuuguauccccuugaucuccuuuuguugucuaauugcucugucuaggacuucaaguacuauauugaaaagguagggagacaguggggcagccuucucuacuccuugauuuuaguggaauugcuuuguguuuuucuccaguuaguuugauguugacuucugguuugcuguauauugcuuuuauuauguuuagguaugggccuugaauucuugaucuuuccaagaaucuuaucaugaagggguguuggauuuugucaaaugcuuucucagcaucuaaugaggugaucaugugguuuuugucuuugaguuuguuuauauagugcauuacauggauagauuucuguauauuaaaccaucccugcaucccugggaugaagccuacuugauugugauggaugaucauuuugauguguucuuggauucuguuugugagaaucuuauugaguauuuuuacaucaaaauauauaagggaaguuggucugaaguucucuuucuuuguugguucuuugugugauuuagguaucagagcaauuguagcuucauagaacaaauuggguagaguaccuucuguuucuauuuuguggaaaagcuugaggagaauuggaauuaggucuucuuugaaggucuuauagcacucugaacuaaacucaucugauccugggcuuuuuuuuuuuuuuuuuuuuuuuuuuuuuuuuuuuuuuuuugguugggagacuauaaaugacugucuguauuucuuuaggggauaugggacuguuuagaucauuaaucugauccugauucaaguuugguaccuguaaucuuucuagaaaauuguccauuucagguuuuccagguuuuuuuuuuuuuuuuuggacaggguuuuucuguauagcccuggcuguccuggaacucacuguguagaagaggcuggccuugaaaucagaaauccacaugccucugccucccaaaugcugggauuaaaggcaugugccaccaugcccaacuccagguuuuccaguuuuguugcguauaggcuuuuuuaguaggaucuggugaucuuuuuuauuuccucagauucuguuaugucucccuuuucauuucugaauuuguucauuuggauacugucccuguguccccuaguuagucugguuuaucuaucuuguugauuuucugaaaggaacagcuccugguuugguugauucucuguauaguuauuugcguuuccacuuaguuuauuuuagcccugaguuucauuauuuccugccauuuacuuuucuugggugaauuugcgcccuuuuguguucuagagauuuuaggugugcugucaagcugcuaguguaugcucucuccaguaucuuuuuggaggcacgcagagcagagcuaugacuucuccucuuaggacugcuuucauugugucccauaaguuuggguauguuguggcuucauuuucauuaaaagucuuuaauuucuuucuuuauuucauccuugaccaaguuaucauugaguagaguguuguucagauuccacauguauguuggcuuucuauuauuuauguuguuauugaagagcagccuuaauccaugguuaucugauaggaugcauggaauuauuucaauauuuuugugucugaugauauggucaguuuuagagaaggugccaugaagugcuaauaagaagguauauccuuuuguuuuaugaugaaauguucuauauaucuguuaaauccauuuguuucauaacuucuguuaguuucacucugucucuguuuaguuuguguuuccaugaucuguucauugaugaggguaggguguucaagucacagacuauuacuuauuugagguguaauaugugcuuugagcuuuacuaaaauuucuuuaauuaauguagaugcccuugcauuuggagcauagauguucagaauugagauuuuuuuccugugaugaauaugaagugccccuccuugucuuuuuuauagcuuuagguugaaaaucgauucaauauuagaaucgcuacuucagcuuguuuguugggaccauuugcuuggaaaauuguuuuccagccuuuuacuuugagguaguuucauugucccugagguggguuuccuguaagcagcaaaauguuggguccaguuuauguagucagucuguuagucaaugucuuuuuauugggguaauugaauccauugauacuaaaagauauuaaagaaaaguaauuguuucuuccuguuauuuuuguuguuagaguugggauucuguucguauggcuaucuucuuuuagguuuguugaaggauuacuuucuugcuuuuucuaggguauaguuucccuccuugaguuggaguuuucccuuuauuauucuuuaaagugcuauauuuauguaaagauauugugugaauuugguuuuuccauggaauacuuuguuucuucaucgaugguaauugagaguuuugcuggguauaguagccugggcuggcauuuguguucucuuaguaucucuauaacaucuguccaauaucuucugccuuucauagucuauggugagaaaucugguguaauucuaauagggcucccuuuauauguuacuugaucuuuuucccugaaugcuuuuaauauucuuuguuuugugcauuagguguuuugauuauuaugugucaggcagaauuucuuuucugguccaagcuauuuggaguucuguaagcuucuuguauguucaugggcaucacuuucuuuagguuugggaaguuuucuucuauaauuuuguugaagauauuugcuggcccuuuaagucaauaaucuucauucucaccuauaccuauuaucuuuugguuuggucuucucauugugaccuggauuuccuggauguuuugaguuaggaucuuuuuccauuuuucauuuugauuguugugcccauguuuucuauggaaucuucuguaucugagauuuucuuucaucucuuguauucuguuaguuaugcuugcauuuaugacuccugauuuuuccuaggauuucuaucuacuguguugucucccuuugugauuccuuauuguuucuacuuccauuuuuagauccugggugguucuguucaauucaccuguuugguuguguuuucuuguaaucuuuaagggauuuuuguguuuccucuuaaggacuuuuaccugucuagcuguguucuccuguauuucuuuaagggaguuauuaauguccuuucuaaaaauccucuaccagcaucaugagauaugauuuuaaauccaaaucuugcuuuuuggguguguugggguauccaggacucacugaugugggaguacuagguucugaugaugccaaguagucuugguuucuguugguaagauucuuguauuugccuuucaccaucugaucacuuuccuagguuuugaaucuccaggguugucucccuuugugauuucuucuuuguuucuacuuccauuuuuagauccuggauuguuuuguguuaccucuuucagggcuucuagauguuuaccuuuguucuucuguauuucuuuaagggagucugauuucauugauuuuugccuuuuuugaaagggagagucuggauaacgcauugacacaguaugaugaugacaacucucacauaugcuucugucugauguuguuuuauaaaacuauaugcuccaauaaugagcaaauauaguuuugaaauaaucaucuugaccauuugucuauaguaccaucucauauuuuuuguagauaucacacauuguaggcaagguugcuccaaguaguccuugcuguccuaaaacuuguuauguagacgagacugaacucaaauucauagagaucuaucugcuucugccugcugagugcuacgguuaaaggugugugcuaccauggcuacagaauuugaaguaucuuauauauaucaaagguuauuauggauaacugaugucuucaugauuuugcugucuuuuaguugaguacuuuucuugucucucauuuuugugguuuuauaaugcuugcuggucuauugcuuagggauucccucagauuuugcuuguuuuaaaugggcauuauuucuccuucauuucuaacaaugcccuugaacuuaaugguuggaauuugcuuugcuucugaacuuggaauaucuuacuucaucaccucauagccuguagaauuucaucuuugaaaucuacuguaguccauaauaguauaaaugacuuaucacuuuucuuuuuagacuuuuuuauuguaauaugucuugaugaagcucuucucugcucucuuucucucucucucucaugaaaugauaugugauugugagguauauuuaauuauaguuagaugugggggcgguucacauugcauaugguauauaugcagaucagaugauaauacuauggagucaguucucuucauccaccuucauacagguuucaaggacaauuagaucgucagucuugcaucaauugacagcaagcacuuuuaccugaugagcgaucucagugauccuguuuuuagaguuuugauguacauuucauuaauaauugauauucacauuaguauauguguauacaugucauuuauaauuguucuuaugauacuucucaaggucuuuuaccuacuuugaauugaucuuauauaaguaaugcauuuuucuguaaauaacagauauuaaucacuuaucagauauguaacuugcaaaugcuuuacucuuugugguuggguuuuuauagagaaauaguguuuugauguucaaacauuuaaaauacucauagaguuuucuauauucuuccccccaaguuucacaucuaagaagucacugccaguuccaugaauucuauacuucucaggucauguuuaggucuuugacagaccuugaauuaauuuuuauauaugcuuuuaguaaagauccaacauuuacccuuuuacauaaggaugucuaguuuuaccagcacuauauauugucaagaugacuuuuucuuuuuaaauuagucuggccaacacuguaaaaugucauguacaccaaggaucauuucugaguucucucuuuuaauauguuccauugaucuguaagucuaucuuuaaauuauuuaaauuacuaucauucacuuuucucaaugguaacaugguaagaccauuugauguuagaaaauggagucccucagcacuguuugugcuuaauuugaagaccaugaucauguaacaguuuuguguaauuaucuaaagguugugaauauuaugauggauuuuucuaauuucuguagacauuuggauauucauuauggaugcccugagggcauaaaaugcuuuguguaguauuuauauauuaccuucaacuuuaugaauggugacuauuuuuauuuaucuuuagcaauaauuuguaguuuuaaguauauaacccuccuccaucuuaauuaauuuaauugcugaauauuuuucaccccuugaugcuuugagguuuuaauaguuguauugagacacaauuugcaauaucuauucacacgcucugaaacuuuaugauuauaaauauacuaauacaaugaaacuacuguaucaguccacauagauuuuacauugguguucugcaaguauuuaagauauauucaucaaguucuaaauauagauuguagagaaugagguuuacaaugcugaauuuguucaucuuauaacuauaauuccuucaaccaauguuuucuuuaagacccaagucuaaauuacuaaccaaucuuauauucagcuuuuagaguuuaacauuuuuagauuacacauauagugagaacaugaaguauuuguucuuucuaauucacaguuuaaccuuaguucauccauacugucacaaaguaaaugacuucuuuuuugagauuaaacauucuguuaauuuuauccauuguauccauuuugacacaguauuauaucuugauuaauaugaauaauguuaugauaaaaauuacaaguuaucuaaacauugauuaaaccauccaugacuuauuuuucauuuuaaaauugaaauuguuuuauuuuguuuauuauuaucauugucauuauuauuguguguauauuggacuaugggugcaugugugccauagcucauauguagaggucauuugacaaauuuugggauuuguuccucucuuuuucuguguguucuaaagauugaacuaugauugguagauuuuaagguacauucuuucuaugagaugucucacucagcuuauaucuucaaucuuuuguuguuaaauuuagguguauuuuaaagccagugaacuuuacaguuaacuguaacauuagcguguuccuuguaugagacaaaugcuggugaccauaacaacuugucauucuacucgagcacaaagacacaguauuaggugcuucaauuuuuuucaaaugccaauuuacauucaauuuuauauuacauuuauaucuuguuaugucaauuuacauucaccucaaacauagaaucagauuuuucauuuuuccauaucuucacuauuuuuuggacuuuuaaaaauaauucauaaaauauuugagguauuaucaugauuguucugaguuacauuccccagauagugauacugagcacuucuuguauucuucuuaauacuuuguauggguauguuggaaaaugguuaacucugucuuuugucugagucauauuuagauaauuuuuguuaucauuugcuauugaaauauuuguuauuuuuauaguuuauauguuaacacauuagauguaguuuggaaauauuuuauuccauuauguauguuaucuuuuuuauuuuuguuuccccuucauacuaccaaaccugugauaggcagcaacuuuguauuuauuucuaggcauuugauguuguaucuuaaaaaguaauuguuaagaucacuguuaaaauuaguuuauucuaggaguucucaucuagaauuaaaucuuuaacauacuuuggguuaauaugauuauggaauagaaccaauuucaauuuuuuucauuuucauauccaggauuuacauaccaucuuuugaugaguauucuguucucaucguuuauucauaauuccugugugaaagguaaauuguccaucuaugugucaauauaaggaucugcauugcuuacaauuggucuuucccugugaguagguuaaucaaggugggugauaguuccagcuauuuuuaaugucauaaaugcucagcuauucaacuuuucuugugauuucauauguuuauagaauuuuacuuaucuaaagaaagcauaaaacuagaauaaaaucauuuucaaucugcgcauuacuuugggcugcaugaaugugcugaaagucuuuggauccacaaagagguaacaaauauacaucuauuacugucaucuucaauuuuuucauaaguauuuauuuuuaguaaacaaaaauuuugcugcugugguuaaacuuaugccuacauaucaugaaguucagucuuuuguugucuauaccuuugguguuauauucaugaaauuaaugccccauauaauguaauuuuucuucaaaauuuauacuuacauuuauauuuuugaucccuuuuaaguuaauuuuauauacuguaauuuaaaggugcuacauucauuuuccuaaaucuuaauacccauuuuccccaaaacuauuuguucaaauaacagaccuuuguugauaaaugguuaugauacucuuguccaaacuaacugauauauucaauguuuauuucugauuugagguacuauuuucuuaagagcuuucuuaauuacccuuuuggguaguuuacuguuaauauaaagaaauguagauauuucuuguguguuuuauauauugaacuuugauuugaagacuguaauaauucuuuaggcaauaacauuuuucuguacaauuauaucauuugcaaauauacauuuuauuuuuuccuuucuuauuuauauaucucacuccccauccucaauuccucuagcuagaacuuucaacauuaucuugaauccaauugguaaaaaagggaauaacuuacuuaaaaaaaauuauuuauuuauuuauuguguuuguguucaugcauuugcaugugcaaaugccuuuacacucaugugaucauaaagggacaacuuaaaaaagucauuucuaccauagcagucccaaggauucaguuuaggucaucaggcuuggcagcaauugccuuuuaucuacuagccauauuacccguuccauagguaucauuuucuuacuuuaguucaagaaaauaauucaguuacucaauauuuacuguaagcguugcacacaugugcuccauuaaaacauuucagcucuaaauaugacauuuuuaucauaaaauuucuuuaucucuuaagauaauuacuaauuaucacaauugcucuguaguacagcuaaaagacucuuguaaaauagggguagaugugacauuaguccaugaaacuuuguuuuacuggaacacuguugaugacuuuggccuuuucugaaugauuaauugguuuagaacuauucuaucuucaauuauuaaagaguuugaaggugaauuaauuuuuugucuuuaauuuauaccugcacuagccugucuuuuuaucccuuugacauguaggauaggguuuuuuccuuuauaguuccaugagauguaaacuuagauuauuuauuauuuauugauauauaucucaaaugguucucuagugauucuuuguacagaugaguuauccacuacuauaaguggagaaugcuaaaggauaaucuuuucagguuuauguuuuaaguuuuaagacagauauuguuacaaauguuagaccucaccauuaauggauucuauuauuauauagugacuauaucuucauaauuuugucacuccuguuuuccauguguaauguauugcuaguuucuauuuuguuuuucagucuauaugcucuuaaaucuaaaaugagguuugugacugucuuuuguuuggcugguuguuuuguuuuaccucuauacuuaaccagugaauuucauacuuugauauaugcuaagaaaugcacugauagaauuaaucuuucaaucuuuaauguguguugucuacauuguuguauugaaccuaucauauaccugaauguccauuuuguucauauaucugaauuuucaaugauuauuuacuggcauggacuagcuggcaaaccuucaguaacagaaccuugagagagaggaucagguuuucaaaaaauaggggauagauuaaaguuuggaauaaagagauuacuuuucuccuucauuagggccucugagaaugcuuuggauuggccugguucucaauaguuuauguacucaaaugaauuuucuuucucugucucuucuauuuaaacucuacaauugggaaauuuaaugaucaugauuucauuccacgaacccucaaggagaucuuuucacuuuucuauuuucuugauuucagaugcccucuuuaucaaagaucaaguguccauagguguguggguuuauuucugggucuucgauucuauuccacugggcaacuucugucucuguaccaauaccacgugaucuucaucacaauugcuugauuguacagcuugaggccaggaauuauuauuuuccccggaagaucuuuuacuguuaagaacuguuuuuguuauccugggucuuuguuuuuccauaugauguugaguaacucuguugagaguuacucuuuccaugucugugaagaacuguauuagaacuuugaugggcauugcauugaacaguagcuuacuuuugguaagauguuuauguuaauccacagguccaugugcaugggaggagaucuuuucaucuuuguucuuuagggacuugaaguucuuuuuaaaauuauuuuuaauuaauuuuuacacuccauauucuauuugucaccccccccccauccauccccaauuuccugaggcuuccacucucuuaagguuuaaguucaucaucucugaaugaacacagauccggaauucuccuguauguguguuggggaccucauaucaguugguauguccuguuuggugguccaauguuuggguuaucucagggguccagauugagacugcugguccuccuacaggaucacccuucuccucagcuucugucagccuucccuaauucaacaacaggggucaacugcuucuuuccauugguugggugcaacuaucugcaucugcuucuuucagcuguuuuuuugggucuuucagagagcauucauaauagaucccuuguugugagcacucuauagccuuaguaguagugucaggccuugggaucuccccgugagcuggaucccucuuugggccugucaauggaccuucuuuuccucaggcuccucuccauuuccauccuuguaauucuuucagacaggaacgauuuugggucagaugugugacugugggauggaaaucccaucccucacuugauguccugucuuccugcuggaguuuauaaguucccucuaucuacugucaggcauuucaucuaaggucccucacuuugaguccuggaagucuuucaccucccaggucaaugguacguucugggggggggucccccaaccuccuauuuccugaggaugccuguuuacauucuuucugcuggcccuuggggcuucaguccuuuucccucacccaauacaagaucagguuccucucucccacuccccguuccccuucuugucauucagaucuuucacuugguuaaaguuacaccaagauauauuauguguggcuauugugaaggguuuuguuucccuaauuucuuucucagcccaucuaucauuuauauaaaggaagguuacugauuuguuuccguuaauuucauauccagccacuuugcugaaguuguuuauccgcuguaggaguucucugcaaauaguaauaacuugacuucuuccuuuccaauuuauauccccuugauucuuuuguugucuaacuacucuagcuagaacuuuugaguacuauauuaaagacagggagagagugggaagacuuguuccugauuuuagugggauuguuucaaguuucucuccauuuaauuugauguugguugucaguuugcuauuuauugcucuuauuauguuuagauaugugccaugaauuccugcucucuccaagaauuuuaauaucaaaggccuuuucagcaucuaaugagauaaucauguuuuuuuucuguuuguguauaugguggaugauguuuauggauuuucauauauugaaccauuccugaagcccugggaugaagccuacuugauccugguaaaugauggcuuugauauguuuauggauugaauuugcaagaauuuuauuguguauuuuugugucaauauucaaaagcaaaacuggucugaaguuuuguugagucuuugugugauuuaggugucagaguaacugugccuucgcagaaugaauuagguaguguuccuucuguuucuauugugugggauaguuugaguauuaguauuagcucauuuuuuaauguugguagaauucugcacuaaaaccaucuggcgcugggcuguuuuuuuuguaguuuguuugguugguuuuuguuuguuuguucuuguuuuaguuugccugaucuugauuuaacuuuaguacaugguaucugucuggaaagccaaccauuucaucuagauuuuccaguuuuguuaagucucuuguaguaagaucuaauguuuuuuucaauuuccucaaugucucgcuuuacauuuuugauuuuguuaaacugaauacuggcucuguucccuuuagauaguuuggcuaaggguuuaucuaccuuguugguguuuuucaaagaaccagcucuugguuuuguugaguuuuuguauuuuguuuguuucuaauagguugauuucaaucuugaguuuggcuauuuauugccauuuacucccuuuggauguguuuacuucuuuucauuuuagagcuuucaagugugcuauaaguugcuaguauaggaucaguuucuuuaugaaggcgcuuagugcuauuguccucaacacugcuuucauugugucccauuaagucuggguaugcuaugcuuucauuuucauugaauucuagaaaguuuuaaauuuuuuccuggaccaaguuaucauugacuagagcauccaguuuccaugaguaugugggauuuucauuguuuuuguuguuauuucaguccagccuuagucuguggugaucugauagaaugcauggaaucacuucaguguucuuggauucuuuaaggcuuuuugugugugauuauuuggccaauuuuggagaagguucaugaggugcugagaggauauauucuuuuguuuugagauaaaauguucuauagaucuguuaaauccauuugguccaaguguucuuuucaaggucaagguuuccaguuuuaauugaaaaaucuuguuuugagccagucuuacaauuuuccuuucacuguacucuucaccuccagaauuuggcuuugcuuucuauagcuuuauugaaacucauuuguucauguauuguuuuucagauuguacucucccaguucucuuuuaguuggcuauucuuaacucauuuuaaauugucacuaaguuaaugugccugguuuuuuggagucgguuacuggaacaugacuuguauuucuuugauaauggccuuguucuuuuauauacaaagauauauauguaggugcauguuugugcauauucauguguucuaagucagaggacagccuccacuuucuuaacuagaaaugcuauccaccuccauugagauagucucgacuugaccaaauaggccagacugccaaauuacuaaacucuuuggauucucuuccuuccauuccaucacugugacugcaaacauccaauauacaugacauuuucacaugaguuccagggcucacccucagauccucaugcuuuaaaagcauuuugccaaaugcuuuaccaaauggauaucuucccggcucucuuuggguuuuuaguauuucucauuauauugggacaguguuccuuaauuuugguauacauccauuguauuuacaaucugguaugaaugagcuaagaccuauuuaagugcaagaaucaagaauugguuggaugcagugguuccuauuguaguaagggcaaaacaauauaguuuuucagauuuaucaucuaugaaaucaagaauaauuacgagguagccuggccaucaaagcuguggauaacauacugcugccucaaaugaaauuaugucaaugguacucuuaaauaucaauuuugauguauagaaaugaaacuuguguacugauauucuuuugcacuacugaauuuaccauauacaaucuuaugaggaaucuuguuuauuacuuccuuuccaauuuacauguguuacauguguccagcuaauccauuugauccaguuaaaccauucaccauuauguugaauagagguggcaacaguuuaacauguuuuuuuuuucuuaauaucaaacuacaaaugcaaaaugacuuaguucuuuagugcaagguuuggaauuuuuuuaggucuguauuaugugaagauauuuucuauuuucuacuuuuacauugaugucugcgauccauucucaacuuauuuuuuauuuauuggguauaaagucuguaucuagauucuuacauuuuccauguggcuaucauuauuuuaucaccauuuguugaaaaaaaaaagaacauuuuucuccauucuuauuuuuguuccuuuacuacagauuaguugagugaacuuagauuguauuuuaacaugcuauuuucuuuuccuuucaucuuuacuuaccuauucuuuuacaaguaauauaguuucuggauccccaaagcuuuacagcaaugcauuaaaauagguuaauuuuaaauuauccuuuaauauuauguuucauauucuauccuuuuccuccacaguagccuuagaguccauuuuccaauacugauaaaacauuuguguuugcuuaagguugcauuuaauguggggaucagcauggguuauuggacaucuggcaauauugaauuuuucaauauguuaaauauugaaaauauauuguacauauuuuuaucuguuuauuuuggugaugccaaagcaauaauguacuuuguuucaaauuccacucguuaacuuggggcauauaggaaaguaacugauuauuguauauuuugagucauguaaccuugcuguggucccuuaauaguugcagaauuuguauauguguccuuucauauuaucuacauagauaaugccacuuaaaacaaaacuuugcuccuuuuaaacaaaauauauauucccuuuauuuugguccauuacuuaggaguuuuccacaagauuuugaaaaaugagugggcaccauccuuaccuccccuuuuuuuccugucaauuauguuugguauauacuuuugguaaaugguauuuacaaaguuaaugacguccuuauaguguuuacugauuuuuuuuucuuuuggauagggaauuuugucagaugcacuuuugugucuagugauauaaucauguaacuuccuuuugcuucuugugaucacucaccugaguuuuuaauauuccagauguuuugugugugugccuuuuuugcuuuguauuaugaguucauaaagaauguugucagguuucuguauguagugaaauuacauacauguaauuucuuuucugguucuugucucuucugaucacuuaccaguuuuuaauguuccagggguuuguguggucuuuuuguuucuguuuuguauuaugggaugauaaagaauguugucagauuucugugucuagugaaguaaucauguaacuucguuauuucuucuugggucuugugaucacuuauauaagcuuuuaauauuccaauguucuugggguuuuugagaugaguugauaaaaauuuuuguuggaugcaugcuuguguccaguaauaauuauguaacuuuuuuuuucuucuugugauuacuuaccugaguuuuuuaauguuccagaguuuuguguuuguuuuguuccuauauugugaguuuauaaugucagguuucugugucuagugaaauaaucguguaacuucauuuugccuaucugugucuugugaucaccuuuuuaaguuuccagaggguuucuguguuuugcuuguuuuuaaaaagauuuauuuuauguauaucagcauacuguuguucucuucagacacgucaggagagagucagauuauagauggauauauaacuacuaugugguugcuggaaauugaacucaggaccucuagaagagcagucagugcucuuaaccacugaaccaucuuucuagcccuugcuucuguuuuguauuaugaguugguaaaugucagauuucugugucuagugaaauaaucauguaacuuuuuguuuuuuauguuccagaguuguuggguuuuauuuuccccccuuuuuaaauccaugaguugguaaaaaaucaucagaugcaugcauguguccaaagauauaaucauguaacuucuuuaagcuucuuguggucacuuacaugagauuuuuuaauauuccaaaggauuuguguuuguuuuguauuaugagaugguaaacaauguugucauguuucugugucuagugaaauaaucauguaacuucuuguuguuuugugugugugucuuuugauuacuuaccaugguuuuuaauguuucagaggguuuuuguguuugcuuuguuucuguuuuuuauguugaguugauaaggaaugugagguuucugugucuacugaaauaaucauguaacuuccuguggggugugugugugugugugugugugugugugugugugugugugugcgucuugugaucacuuaccuaaguuuuuaauguuucugaguuguuggguuuuucuugucuuccaucuugaguugaugaggaauuuugucagaugcauuuuugugucagugaaaucauguaauuucuuuuuugcuugugucuugugaucauguaccugaguuuuuaaugguccagaguuguuagguuuuucuuuucuuuccuuuaucuugaguugauagggaauuuuguagaugcauuuuuguguccagugauauaaucuuguaacuucuuuuugcuucuugucaucuuuaccugagcuuuugaugcuccagaugucuuauguaugcuuuuuuuuucuguuuuguauuaugaguugguaaagaauguugucagguuuuuguguguagugaaauauucauguaauaucuuuuuugcuucaugugucuugugaucagcuaccuaaguuuuuaauauucuagaggguuuugugugugcuuauuuuuuguuugguauuauugguaaagaauguugucagauuucuguaacuuauuucuugcuucuuguuucuuaugaucacuuaccugaguuuuuaaugauccccaguuguuugguuuucuuuucuuuuucuuuauuuuaaaucacaaguuaauaaagaauuuucucagaugcacuuuuguguccagugauauuuuuacuucuugugaucacuuacuugaguauuuaauguuccagaaguuuuccuguuuguuuuguuuuaaucaugaguuaguaaauaauguugucagaccuuuuuuuuuuuccccuugggucuugugaacccuauccugaguuuuuaauguguagaguuguuguugguuguuguuacuuuuauuaugaguugguaauuguauccagugaauaaguauguaacuucuuuuggcuuauuacuuaccugagauuuuaaugcucuuuguuuugaucaugaguugguaaagaauguugucaaauuuuuugucuaguuauauaaucauguaacaucuuuuugcuucuuguguuuacuuaccugagguuuuaauaaucuagagggcuuuuuuaaaauugauauaaaauuuuuccagaugcauuucaauaauauaaucauguaacuucuuuuugcuucuugugauuacuuaccugacuuuuuaauguuccaaacggcuuuuuaaacaucaugaguuaguaaagaauuuugcuagaugaauuauuguauccagaaauauaaucaugucauguaacauuuuuuuucuucuugugauuacuuaccugauuugguaauguuccaaggguccuuuuuuuaaucauguguuaguaaagaauuuugucagauucauauguauccagugauauaaucauaaaaguucuuuuuacuucuuaugauuacguaccugaggcuaaauguuccaaaguuguuguuuuuaccauggguuggucaagauuuuugucggauguauauuucugucuggugacauaauccugugacuuauuuuaugcuugugauaacuuaccuuaguuuuuaaugucccauagcacugagcaguugugguauuuuuggauuuggcauauuaauguugcguaguguauuguuuuacacauacagcaugaguuacugguauuuagcuuguuuggaauguguuguuugcuacagaaauaagggcaacauuggucucaacaaaugaguuaagcaauauuuccuaccuucuaaaagacacuguagaaccuuuaguauacauucuuccauuaaauaguugagauuugucagaauuuaucaguaaauccauccaagcauggugcuuucuguuuagguugccuauuaucuucuuauacauagccucaguguaccauuuuuccucauaugccuguuaagucuggaaaagaaagucuaucaggaaaacaaguuuaucauccugcccauaaauccuaccuuugugaaaacuaagaggucccuguauauuaaccucuuacaaaagacauuuccaugugauuaccaucuuuuuuguuucagugaacauugacaacuuuagaaucuuuuagacccucaagaaauaagauguuuaaacuaaaauguuucauuuuuaaagcuuuuucauuugagaauauggcaaaaagauaccuaccccccucacugcacauucuuagauaguuuugaaguucucaucaauguacucaaauugaugaucuaacauaaucuuaccauugcuuguucuucauugucuuuuuauccuucacaauagagcucauuuugcauuggccaguuuuguagauuuuacuaaacugacucaggcaugggaugauguucuuuggaagccuggcuuucuuucaucaacauugugcuucuagagauuggauuuaagaugugggucuuuaacaucuaugcuaaauggagguguuucuccugcaaaacugaugcauauugguaaaguugccauucauuaacuucauauuguuuggguguuuuucaaaucagaaagcaaaauucagucauacacauauuuuuuucaauuuaugaggauagaauuuuaaguuuuguucauguuagacaaguacccuauugucgugaggcuacauucccagcccuuuuaaguuuugggaagcuccuuauauauuuuuuaaauguuuuguccuagucuguagcuuauauuuuuauuaugauuaccaauauauuuaacucuuuaaaauaauugcuuuaaguaugugucuaguaaauccaaugucugggcuuaaagaucucuuugaauacuguaauuucucuucaaagcauaguaacccuuugcucaucuuuaucugaaauggcuucauccacaggguuauagagaauaagcagaucuuacuuugauaggaacuuugaaaugagauuaucaugggccauauuaucuaccauacuuuuacaagaagccagguaagacaaacagacauuuccccuaaacagaguugugcugcagaaagucaacacaccuuccuauuccaauuuucucuuuaccaagauuauaauuccggagagguauguuucuaucuaguauuauguugguuucuuuugacaaauagcuaucucucccaaacaagaagaaaauauagcaacucucccuuccuuauccuacccuaauuuguuucucauauuucucauguucugggagagauauguuuuucuaucaauggcaacaacaggaauacuacuagauauauccuaucugauggcuuguuagcagauaucuuuuguugugguagugguggcugguugguuuuagccugcucaaaaaucacuuuaagucucuuagguaauaccuacgaguuaagaacuauauuguauuuaauucagagcuucuuuuaggugugauggcauuagagcuugugcaauuagaaagguaugguagugucuugagauauagcucaguagcaauucacuuuccucuacuagcauugccacaaaauggggugaagauacuuauuaaauaacaaugacuaugcaaaacagauuucccaaucugaaaucuacuguaaacaugagauuuauaugugggauucugguacaauggacccaggaggcugcuaagauacaaccuguaacuacaaacuuguuuugcuauauauuugcaauacuguuuuuggaaaaguuuguuuacuagcauuauuuuggggugauuucucuggaucuuguauacauuuucaacuaagcuaagcccucuuucaaaucauaccauaccaauucauacauuguaugaccuaaaguaaccauuaacuccucuauaaaucacugguaccauucauuucaauuaaguauacauaaacauaauuaaacacauuuuuagauguuuugaacaaaaucuuaccuaacuggccaaucuuaagacaauugcagagugcagaaugauauauagcgauuuguuuuguucuguuauuucgcucuucuugcuucugaggacagauuggaugugguuuguacuauugcuauuuuauaguagguguuccuguagggcuuuuuaaauauuugauuuucuguagauaaugauauguuuagaugcaaguuuuguuauuaauccuguuugguauucuuucagcuuccugaacuguuuaauguaugauaauaauuuaggggaaauuuuuaguuccuguuguuucaaaugguuucuauuuguuuuuuauuuuuguuuuguuuuuggcuucuauaugacuauuucuaguauucuuagggauugacaugucuucuaaugcugccccaggaauggagauaacuagauaacuuuuuuacuugggagccaaacucagguccuacguauauaagacaaacacuuaaccaacucagccaaauucucacuguuuuguucauuuuugucuuuuaguuuuuguuguuuguacaaaaagauacucugauuuuuuuucucaucugugugcaaucaaaugagucuacagaggguauuuuucauacauugcuauugcugguucccagcccuuuuuguguuuucccuaugaguuugguuccuuccuugcuauuguccuuggauguuguccuuaguuuuauaguucaaauaucuccgauaauuucaacauaucugaaaugucugcuauguuuuaaaaaguuaaugucuuuuagaauccuuguauuuuuuuucaauagguggacagcagauaugauguaucagacaaaaggaacuucuauugaaugggcauuauuaacaauacagaaagguuucguauauaagaaacauucuauaguucuguguuuaggucucacuuuuacugagccucuugacugaaugucacaaccauucuucaauauuuuuucuugggugguauaggauggcuaaagugaacuggucugguguuugguuauuucuacuccacaagaaaucuagaguuaauuugaauugcuuuaggucaguucaguuagcuugugauaaauccuagcuggcuaagaccuaguaaacuaacuuucccugaagguaaacccuugacgaaaaacacuauuguuuguuuucagaauggcuuuccucccucccaauauugaaaguuucaagggaauuuuucucuacuacucgcauugagaaucugaucaaacuccuggaugaaguacuucaugaaaacguuaaggcucuucccaaaacuuagugccuuugacuuuuuaguucuuacaucuaucuacaucuaaacuccagcaguuaaaucacaaauuagguuuuucuagccaagcugauuccagcaaugucuacuguaauauguucugauucuccaugucuaccugucucucuccuucaaucucccaucaccucuccccccccccucauuuugaaggcauuguuuuacucuuuucauuucugauacagaaauggaaucgacuuuucagucaacucaccauuuuacuuguugagauacuguaauuucuaagcuguuuacauguugagauuuauacuuuuccagauguuuucugaauaauuuuuaugagaauuaauuacacuuaacuuuacaaaauucuagauugaguuuaugccaacauaguuucaauauuguuccuuucauuuagauuugguucauuaagguuuaguucauuauagcagguaaaaaggagggcaggauucuuccaacuuuuacaaauuaauucaagauccuauacagcucuaucuccuucaauucuacaugguuucaaauuuuauaucuauugcaugaauauauccaaagacauaugauauauaugccagauguauauaucauguucuuuuaucacaaaaauaauaaacauuaaaaacuuagauauuauauauaauacuggcuuuuauguuuuacauagcuaccugguccucaaggucugggcaucucuaugugguuuccaguuacuuucuaguccuuucuuauuugaaacuguauuacuuucucuaauaguuuuuguagagccaauauaguaugagcuucccagcuuuuauucauuugagaagcucuuaagcucauuauuucuccauguuugaauaauuuugcuguauauaaaauuguugguugacagacuuuuuuccucucaguacuuaaaaaugcuauuccauucucagucgacucuauacuugcugauaacaaacacauuaauuguauugagaaucacuacaugacaagcaaagucuuuuuuuuucuuuuuaacgucuguucugccuuucaauaauugauaguguauuuuucugugacucaguuaucauuucuggguccuuuugcuuauguuccuguacauaguaauuuuugucuuuaaucaaauuuggggaggcauagccacuaggucaauucuucuuccugcuccuucuuucaccuacuuuuugggauuuccaacaaagauauuagcauacuugguaguuuaccauagaauucuugaaaugcucauuuucccccccuggugcucagacuugauccuuaaguccacugauucuuauaucauucagaucugcugaugaaacccucuaauggauuuuuucauuuguuaauacuuuucaguucuagaauuuguuuaauuccauuuucuaauuuuaucucauucuucauauucuuuguuuucuuuaguucuuuaucauuuucuuuuuaucuuucagcauaacuuagacuaauuuuauuuuauuaucaaugagauuacuguacaugccauggugcccauuucuagguuaggggcugauuuuauguaguucuuuccuuauaccuuuauaugggaucggagcucaaacuuaggucacagggcuuaaguaucaagacccuuuuccagcugaaacauuccuagccuaauuaaaaauuauuuuuuugucaaguuaaguacagugugucuauacuucuuucggcuuucugugggaaggaacuuuguuauuguuucucuguauaguccauauuuucuuuguuuaaagcucuauauuuucaauuauuuauauuauaacuguggacauuagauucuuuucugccuccagauuuuuuaaugcuacuuaagugguuuuaagcuuuuuuuuuauuuauucccaagcuauuuuucuuuugugaaguuauguguggucuuugaaguucuguuccuuucauuuauguucaguucauuaugacagcgagguauaaaaggagggcaggauucguccagcuuuuguaaauuaacuaaacuggaauuuuccuucaauauuuggacagacuauuaacaauccugucuuugcuuucacuuguagcuugagguaacuuacguauagaaaucucucauagauacugguuuguaguauugucagggcucuucuuagcaucuagcucugugcauguuuuguaaguuauuagcacauacuauuauuuuaaaugcucuaaaauuccaaggaagcucucucuagauugccuucugaggcuuuucagugggccgcugugugcuucaaccacugaucuuugcucaagucauuauaacugcucugaaggucuuacagcguuugcaaguacuguccacuauuuuucacacugagaaaauucgcaauuacuauuuggggggaaaaugaaaacaccuuaagucagucuuucaggcuacccacaaacaauauaaaacaaaaaaaauuauuguaaaacauaaauaauuauuuuagacaaggucuguacugcacacuucagaaacaaggaccaggguccauacuaccuaucaucugcaacagugccaccaaaccaggcuuaguagagggaagaugaguauuuaaggacaagugaaaaugucccaaguuucuguaauuuuugcacaaacuuguucuuuccucuacuaaauggguuuuuuucccagugguugaacuaaaguuguuagucuuggcaacaagaaucuuuauccacugaaucaucuugcugggccccuaacacuuuuuaauugcccauuucuuuuugugauauucacuugguugcugugaauuacugacugcuucccagaauuaaucacugacauuaauucugaguuccuauaaaaauauuucuguggagaggggaaccuuauuuuuguugacacuacuuagcauccucacucuuuugacagagcaucguaggccucuucuuuugcacucacagguauacaauggugggcagacucuccucucauggguaauuucuauguauuuggccuacuguugaaggaauagaucauauaugguuuuauuuugcucuuacuguuguugaauugcuuguucugauuuuuugaguaagugagaagauuugaaguccagggguuggggugggggaguagaauguuguuauucuccaaacauuccugcaaaucuuuaaaauuaugcuuuuucacauauagacuuuucccacucuugguuucuauagcuucuuccccugcuaaugccaccauguuuguuuagggguuugucuguuugucuguuuguuuggaugucccuuucacucuucacuggccucccaagucucccuggcuuuccuuugcuacauccuauacauagcaaucccaaaaauucuuucgauaaaaagugcaucaugcuacuuucauucuuaaaggcuuuaaccccuuccuaucacuuuuuuggggcuagauuuauggacagagaauaacaggaaacuugugccagcuacuucccaagaaaguggucuauuuagugaacagcuggaauucagcuuacaacacuccuuaaagaucuaccaguaauguggaccuggaguauugacuccacugaaggcuuacuuugagagauuucuuuccauugccuuuggccuacccugcauuaaacaaagcccuggagucauaucugguauuucuuuuauuaagaagccuuugguaugaagacaguaugaaugguaaaugucguacaugugugaggacccauacugccuauguguccucaaaaccagggauguuuucuuuucuuccauguucuuuguguguaccauacagcagggcuuccagugugguuuaaugagcugccugaaccauacaucaaggucuucacuuucaagccauuuaacuuuagucauaugcccuucugcucucuaaaacaggcuaguuacuaagugagcagcacccuccuuucuacaugguuucugauuuuugaaaauuacucaaggauggacuaauuugcuucucgggucuagcuuggcaacauugaaccaaagcacacagagucagacugcaccaaugcugccacaccuuuaugugaucuucaugcugaggaggucaaagaagagagucucucccagccccugccaggggcucuuugcccccccuuccucuacucauaguccuccugcagccagcaggggugagggagccaguuugaguugauuacuuuugacaucaguuguuaacauaauuuugacauuaagcuucucccuagcucuggggugauucugacuauguccaggcucuggcuugaggaaccauggggagccucuggggccccagaucuggccucgcuagaggcagccugggaagagaccuguguuucucaagcacacacccuccaggccugggaguggggccccagcagaugucuggauuugguagccagggccuggagccggaugcugagaaugaggccugcaacucauuuccccauuaaacauucugagaacaucugcaccaguuuccaaggcuucuccuuaauugcuuugauuauugugugaaguuaagaacuggcacauuuccgugauguugugaugaaggugaaaagaucgcucuuaauuagauuaaaaacauuuuuuucuuccuguguaauuucuccuugaaaaaucaaggccacuuuuuuguuuucuucguccaaagaccuccagaaacuuuccuccccaccucuccagagguuucuggggaauguccugugagcucaacuuuuggagaagauagugcuuaacccagauuccauuguauauuaaaguuuccuggggccgcucuugcugccuggaaccuucccuuccaaaugugucuugggagaccuggacagugacuucuugcagcauggaaagcuggguagacuaguuuuguucugcaggcagcugugcuacucaugcucugcuuccugggcuugcuuagggcuagcucugucauugccuguccucuuuagcaccuuaccauucagaccccacccuugggcccacagaaucauuuccauuuacucugagauuuauguguuaggccuguuaucuccauuaugagaaaaggcauucagugaaaagucuccagcacuaugaacucuguaguugcacaaagccuagcauuguuccuaggauuucuugggauuccauaggucaucuucaacugucaugucacuguccaucucaaguuaaauguauccucagucuuugcuugaacacaaaauacagcauguuccauaaagugcugcaaacacaggguagagagagaagcucucuaaagagaaguuugcauuauaacaguagaaagucaguggacagcuguacgaagcaccuuucccagaguuuccuggcccauguagagcugaagcuggggccucgggccagauuuaucuagcuaaccuucuucuuuccugucuucuacucugcaaagcuuaacaagacugucuuaggguguuuguuguuguuuuguuugcuguguuuugcaaccuagacuuacccccagaccuaucuccucagguucauaucuuaccccuagcuuuuuauauuccuaagugcucuugguaacagacugcagagcccauuucaaucuagauaaggacaaugagacauuuuucuaguuuaugaaucugaaccuggcuguuccagacacagcuagagcuagucuggugaugcuuucucuccuccuucuacccuguccuuuuugugcucuuucccucucucugccuauagauacaugcauagcuauauucaucuguguccuuaaacacucacuuuccaauaaauguaagauguccacuauuuuacauguaccagaagaaagaugccagacuuuuuccaaaugauuucugccacaggcucaggcuaggcucucaaugcucccaaccaaaguacaagccaucuuuauaagugcaacuauguuucugaaguugugauccagccacaaagcccccuuuggaaauagccaaugaauuccuaaaucuuacacacuggggaguaggaaaugaggaccccuuuaaggaagauucggugaacuauuuccagaagccaggccugguugcagaguucgcaaaaacaacagguguccacucaagcaagguauuuuccuaagcggaacuggguaccagcugugaauauacauuuacacugcacucucgccuuguuccuggcagcuguugugggaauagcuuuuacacuuucuguccuugucucuuacuucuccccucugagugaagacacaggugguguugggucuggucuggcucagggucugugaacagggcaugggcagcuggcacaggcuguggggcugcagcucagcaaugucacgcaggaccuggcugcagcuguccagaugcccuagggaggguuuuuuuuccuucauggugcaggauccacagggcuuuggcaaauccaccaagacggggaaauugauugaggggggacagggaaagggccucugcuaggggaggacauaggcagcuuguuuauuccaucggagugagcuggcucaggggacuugccugugccaggcaccggaggugacaugggagaggaagaaagcaagguuccugugcugagggccaggcacacauaagccccauagcaauugaaggggcaaucucuagagccuuggggagcuuacauaggaaggugguuuagguuacaucugggagaucaggcaggauuauaaucaguuaggaggaggaggagggcaggggugagcagcugggugaaguuacugacaccagcaagucucagcagagggcagugggcaacaggguggccuggggccuugcagagaguuggacuuggaaugcucagaugaucggguaugcagagggaaagucugggagcucaaugcaggaguaauggagcuaggaaagggaaggucuuggagagcuugggaaguaggagcucugugucauugggucucuugggcaucuuaaggacagacuggaggagguggcugaguaaggacacuuagaugcauugugcuaaccccaggaugaggagggcaaggcaaauacaggaggcuuguaugaacuguuuuucugacuucuaaauguaucauucauucaaauagaaaauacauauacuauaaggaaggaaaugaaaaucauuugaaguccuuuaauccacaggcaaacauaccacauuuugaucuauuuccuuccagucuuuuuuuuuuuucaaugcuuaaguacaaugcaaaucacccuaacgaguaggcccuuuggcugagaaggaagaugcugcguacagucugguuuugguucucuugagagagggugaaacuuggcaguggguagucccagcuggggcaguugccacgccugaggcuacauucgccauuccagaccucccauuuuccuagaaaacaaaauuguuuuguucugcccugcacacuuagguccagauucuggcucugacaagacagaagcagccaaggaaugaaagcaucaaaaacuagaaucguuuuaggaaaaugugacuucacugucacuaggaaacaguacuuuuccuccaggaccagguacacugacauugguugguucagaagagaacaccugacauugcucuaguauccucuacacagggucuaaguggucauaugacccuugucacauucaccauggucucaguuuguucugcaguugggcuaucuuuuuauaucuuuaugaaagacaaacucugggcucuucagagaugaagugcccaauggggcuucuuagaacacaauacuugccccaagcucuugccuaagaggagcaccaccaguguguuuaaguugaaacccugcccucucaacucccuuucagaaucuuugagaugucugaccuggcugugaguacagauccaaauauaaaguggguggcaguccugaauaguguuucucccaugaaagagaagcaccccuaaagucucugaaacaugccuagcagacaacagucucuccuuuugacuuggaaaaacaacugugcugagccccucucugacccucacugcaggggccccaugaacccuucccaggauuaaaccaaagaguccacauuccucucuggcaggugcaggccccgcccgcuguggacagccaacugaugugcacauuuuaauuuccuaauaccaggacagagccuuucucaggaguugaggggcucacccugggcccucaggcuuggagauggcacuugucauucuggguguguagaacacagcccccucuuccagucaccucuuugcuucuccuuucuuguguauacaagugaugcaaguacugaaauauguauuuguguucuuuuucuuuuuuuuuccaaaagaacauuugaauccuggaugaaguuguagcugugacuugacaaguguauaauauaacccaguacacuugaaucucagcccugagucucuagaaugggaacaguaacauacucccaccacgucccagaccugugggccucuucaugugcacacauuccucaagguuuacaggucuuucccuggucucucugaggaugucacaggcacagagcccuuuacuugagcccuucuuccagcuaugacuaaguaaugucuguauaguuuccugcuggaagucugcugcuggccccuugggccaugagcuccugaguuuauuuauauuucccugauugcuagucaggcacaacaccuuuccauaagcucaucacgcuuuugaauucuugucucauuuugaaggggguggguguagggugucuugcuuauuuuucgguuaggucauuuuuuucaguacuagagaauuaaaccuaaggucuuauaccuagugggaagacacuaccacugagccaucucuagcccucauuuugcucuuugagaguuaucuugacucacuguugucccagcaagguccugaacauaauauuucuucuuccucagcuuccuagguagcuacgauuacagaccugcgccaccagacuuaucuauuuguucuuacugauuuaccuaacuuuuuauauguuuuaucauuuuugaaucccuuuuuacuauuuaaaauguauuuagauaucuagguuuugacucugaauguggcuaaauugcuauuuuucuuuuugauuauugcuucuuaguuauucuaccccaaagcaauguagauauucuucuauauccaggccuaugguccuucuaguucuacuugucauaagcccugaaacaccaagaauguguuuucaauguacgcugugagaaaauuaagggcccaguucaguguuuuccccaugugaauuuccuuguccuugaaugugucauuuaaaaggccaucucaugauaaguaagccuuuaauacauugcaaguguccauggguaggcuauuuucugacauccauuucuaucccacuagccaguuaagucucuccuugaaucaguucuacauuguauuaaugacuacuauguugaaguacuuguuuuugauaagccuauuagccacccuguucuuaaagaauauuacuuuucccuggucuuuuacacuuccaaauacaucucagaauccacuugucagaguauucaccacaaacauuaggauuuuaauuaaaauuuaggauuuuucagaauuuuuugaguguuuugucaaugcaauaaaggcaguuuucuguuugucggugucucuguuuaaaguuuugugcuuuucuuaauaguuuuuaaucuaucuuuauacacuagagauucuuuucuacuauucugcuucuuuucccuuuuaauuuguguguuuuauuugcauauauuacauauucuuguaaaagaaaaaauagucuugcaauguaccuuucacgaaguaccucacauaaccauguuacuuugauuaaaaacuaaaacaaguuuaauuuaauacaaugcuguagagcuacacuuuagucuuucucccaguuugaugcuccaagagccuguccaauaucuaccaucacgcucauucagcaggaccuugguguccugucaguacugucacuggaguugaugcuuuuaaauacuuaucaaaugucagugcuacucugggucuguauaacauucucucaaaauuagaauaggguuacaggugucguaaaugucauuaaggcaaggugcuuuucucauuuucuuccaucaccauggugucaacuuuacaugauuaaauagcucacuguaauugacccacuauuucaccuuuauuagaccuaguuauuaaaagcaagucaccaggucuggccaacauucggagaaugaggaauuucauucuaucucuugcaaagaguauuagagacucugugaauguguuaaaaucacuaaagcaauuaaaauuuauuuugggacuaaggauguaguguaguggcagaaugcuugucuagcaugaacaaagcccgggauucaaucaaugucacuggaaaacaacauaacuguaaaauggacaauacaaucauauaugauaauuaaaugaacaaaguggcuuuuuaguuuauuguauauguucaacauggaucaauaaagagaaugaaggaauaauuacaaaaaaaaaagauuucaccuacuaauucuauucuagccuucauccacggaucuuucaagcauuucuacggugcacuucugguuaacucguuccuucuacacuuacagagaucacuuuuuucaucucacuuucaguuauuuagaaauacagacggacuuggcaacuguguuucugggguauagcugaggauuauuguuuuguggcuaaccuuuuucuacuuuagccacuuguacaggagcccuuuagacaugcuuuccauuuaguuccuuuuagguucaucguguaguuucccugugcuagccccagaagcggccauucuuccaaggagccauauucgcuuuuauuggcagacuaacaguguuauauaugaccugggcacagaguguguucuuugccacaaaagggucacugauaacauauccuuucugcagguagaacuaggaaauauguaugucuauaaugaaagucuauauacauccauguuucaggguuuguaucuuuaugcagcuuaccucgaguuuauacuguuucugauuauccuuacuuuguccucagcucccauuuucuaguauagauacugguuuguauaauccuugauauacaguaccccugugugaaacaaaauuaucuacaagaauauuguguuuaugucaguauuuuuucucuagguuuucuuuaguccaaacauuauuuuuuaaagcaacguuagcaaguuccuccucccccagaccccaccuucucucuucagugcucuaucauguauucacaacacacagucuacucaccauagucuauuaucugucccaggauccuccaauauucuaguugauugcuggacauuauuccacugcauaggugggacagauagacacaccacgauuucuuuauucauuucacuguugccaucuugguuauaacuuguuuggugcaacuagagguaaaauugcuguauauuuuugugugcagauuuaugugaacuuaaauaucccauacacugagucauaaaucauauguguguuuauaaggcuaugaaguuuguucuucagagcaguugggccacuuugcauucccaccucgggcacaugaggguugcagucauucugccuccuugaagugcuggcuguuacaagguuuuaauuuaaugcuuuauccaucuucaugauaauuuucaggguuaucucacugaagcuuuaauauuguauuuccauaaagaccauagacuguggcugagcacaauuucccaugcuuauuuguaauccacuuuuuaagauggguuguuugcuucacuguugucaaauuaugaucauucuucuuuauauacucuggguacaaggcccuugauuccauuaagugauaugcaguaaaucugugacuugucucauugccuucacaaagcacagcauuuuaacagucagugagccuguuccuccuugcuucuguugcuacuuagaaaaaugcacuuguugcaggaauaacucauuuguuucuaauuauaauaaaauugaguccccucccccacuuggauuaaguuuucgguguugcaucucaauucucuuucaaaucuaaaguccuagagauuuugaaguuuucuuaacuuuuuuuuuaguuuuauguucuauuucagauuuuuaaaagacuauauauaguguucuuguauuuccauuguaugacuucuaaacauccuuugcauuacacauaaaugcuaaauguguuaaaauuuauauacacauacagauguaugcccacauuuguauguuuauauuggaaauaaauguaaaagacugcuguaguaguugugggaaacccauuccauaaaguaaaugcaucacuguaaaaaaaacaagacagucuuuaugauaaaacaacggaguguuaaaaagacaaacauagaccaagaaaguuauuuaugcuucauguaacacaagguuauuaucucuaaugaauuaaaaguuccuuugaaaugccaagcaaagguuauuaacgggcaauucugaaagaagaaucccaaacaagccagaagcagucagugaauaugaaaaugagaaaaccaucccccucucacaggcccaggaccauuauaaaaggggaugggaggacuguaagagccagagauaggcgacgacuggaacaaacuaacuucugggcaugacaggacaguugcaugauugccuacacaagaucaagccagucaacacuguaucauugaguacaagaauuucacgaaccccaagagguucuugaaaagcuauggacaauuaauggcuccugggaaaggagaguuuuuccuuaacauucuaacuccuggugggucauucauacugcaguauuacagcccccacacccagaauuacauggagagcacaaacugaaguugaugaauuauugaauuuuaaaacaagaggauacaaaauugagaaguuagaaggugguugaggaucaaaguucguugaucauagucucaaagaacuaauaacaauuuugaaaaugagaaagccucaguguuuauccaugcuuaaaaggccaagcaaaauugaaggggaggaauaguuggcuacaacuuaacagaagaacaauccaaaaacacuuauuaauauuaccaaagucaugcuaucucaccugcccaguauaucaacaacuuuuaacaacgaagauggauauuacaucacugucugguugucauaaaacuacaagacugaacauccauaaaauaugggaugaguaaaguuaauugugguagaccuaagcuaugggcucaugugcugcuaaaaugaucauuagaugcauagcugcauaccuaaagaaaagaaugucgcagaguaagaaaaacugacaagaacagaagucugcccaaguuuaugaccucacauuugugcuaccagaaaagccagggucccgggcagcagaugauuccuauaauugaggaccacugugaauuuuucaauauuccacucaucagaaguacuuaauacuauauuagauacuuuaaaggagaagugaguugagagcaaacacuaguaagcuggaaaugcugugaagacuaaucuggaucagugcccugagcuauggaagucagcuauugggacagucuggaggccucccucagagagaacccgguuaauaaggcaucaugaccagaacaaggaauucagcuugugauuccugauaagcagagguacuagcaccuuuuguugcaugguccacugaucugucaguguaugugugugaauagcacaguaguggagaucagugcuuucauuuguucuuggcacaaauguuuuaugugaagcuggugagaggccuagaacuuaacauacauagggcagaaccuuacucaguccuggaacucagccccagggcagcuacaacacuggggagaauguaccagccucuaugguuuacccugggaggcuaaguccccagguaccuggggaccaaucaauaagugaaugggcauaagugaauggaauaagugaaugcccacucacuuauuccacucaguguaaaccaaccugauggguaaggcuaaaacuuccaagcucuguccucacucuucaccugaucuugagagcuuacagguuuaucccauagcaauagcagguugggguggacauuugagucuaguucuguccaguucuggauccccuucaugaucaaguuucuauugaagccuaaugagcuguccccauaccuucuucacaguaaggaagagcccuacacugcuggaaguaagcacaccccauuucuugagaacaaacagcuuugcagaggaccuggaccuggaaggggagacacugcugacccccaucacccaugugucacagugaguguccauuugcccucaaaggcuggggcucaagggaacugcccuagcauagggcaaagcuuauccucuugcugggaugcagucuauuuacccaguacccacaacucacugccuauccuuaugaaccuggggacacuggcugcuggggcuggccucagggcucaggcaggagagaagggcaggggcuuucccacugaaucuggaaacaugauccucuuguuuugacuuauggaaaaccagacugaucauuuuccacuuguuugcaugcuuugagcgucugagaaacuuggguugguuuuguuguuguuguuguuguuguuguuuuccuccccucuaccccuccaccacuccuucaagagaguuaacauuauuuuuuagcauuucccugugggauuuuggccaaagccauggggcagaugcuaguugccacuacuguccucaggggcuccuucagguggaggaaauggcugauuuucuacgccuuccaguuggccuucccccaggcacagcuggccugggacacaugcccauccucuccccccauuugggcccccaucaaggcaucaccaggacaaacccuaguacccagccaugccaugauuucucugcaacaugugacucaaauguuccuaccaaaacucaggagaggcagcgaugugguggaggcaggucacucagacugcuucugaccacugccccacggggcacuccucuagaaaaguguuucugugccaggauguuaaugccaugcucuuaguuuuccugagauucgcauucugagacucuuccacucuuucuacuaaaauucauguccuuaaccuuguguagucauaacgcuucuggccuaugccuagauuucaggcuugacuuuacaaugacugaagaaacuuggacucacagugcuggggguuucuuaaguaaccagauagccaaguugaggccacccugggggaaggcaggcuugucagaggaaugauuaugaucaaacaaggcaugcccacuaucuucccagaccacccaaacuuaaacgagguuagcagugccucgugguuuguaagauguagagaggguucauggguuuagagagagcgagaauguuauugagaagcaggggucacucucccuccuaagauagccuuacaggcuggcugcauuagcaagcgggaacagaggugugggaacaggaguccagacaggcuaggcagguauaggcuggcgucagaggguagaaaaauagcuuacacuaugguuaagucucuccaucaaguccacggcaugagacaacucaaaguguaaacacuggugucuuguggcugguguuggauaugccagugccugcuuaggaguaaggauaguaaguagcaccauggcaaccauagcaggccucagggaauugccuacgccuagaaagaccagucagccuucuuaucccccugaucacucaccucucauugguauccauuccauuuuauucuucuggccauggagcaaccuccagacacagaagcagcuacaaugagaguagcgcucucaacaaaccaucuaccuugauagaugugucucacaucuccuagcuacugugagcaccaacgaggucccaagggaggguggaaacuggugauacaugaccauaguucaguccauagaugcccuauaaccacaccuuugggggcaaaaggccaccugugcugguauuaguauacucaaagcuccuggagccagacauuuacugucuaucuguucuagaagcagcccuaagccacuuagacgacucugcucagaguacuaggccaaaucugauaacagaucuguaacagaaccucagagacaugaaugaugcuuucuuggucucuauaggccuagugugucaccaucuuuccagguaccacagcucuucucaggccagcacuccuggaaccugaguagguggacagucuuuauccagucaagucucuacccaagaacacaccaagacucuuucuaggccaacuuauuccaaaugcagcagcugggaacaagccaaucuaggaaggugggaaaggaggaaaggaggagcccacgguggggcugaguuaaaagaccuaagguagagauagagagaucauaggcuuaagcaaaaaauauaaucuggucaaagcagaguuggagucaggguugaggcaucuaagaauuuagacacccacaucuguagaagucuagugccauccuugguggaaguccuagcagagagcaugaccauaggccuggugugugucuggguccuagaaccugaugugcucccaggacuacuggccuuaccaagaccccuccccauucuaggggagcagauaggccaucauggguacuguguaaggggcccacgugcccacaccagggcugcauuccuuugccucuugcauagucagccuguugauugaugucuguaauuaagcuaggcuccagcagcucacugaugcagcauggcuccugugggcagcuggcccuaugaaccuacacugaaaaaagaggcacacacccucguacgugucuaccagggacagagauguguacuagggucuugcagggagcagagugggugggaagcaguugcagaaaaacagauccauuuuucuucagcauuuuacugauguuaaauguauuaccaugcugggccaguuccagaauucaaauuaaaagcauaaauaaagacacauuuuguuuccaucucaagcucuccccgcccaggggcccuagggaggugaggucacuguagccuugauuaugggaaggucccuggggcugggugaagcuccucuuuucagagccgguuggccacugauaguuuggggacagagaggccaaggugcaggccuauugaaaaccagagagguaaauagggaaggaugcugagaagacaauauugcuucucugaccccagcucaacaggcacguaccagcagcuccucaaguaagccccaggcaucguccagaucuggauaucugggccucgguguugcauacauauuucagucagaugcugucuuccugguucuaacaucacuggaagggagcccuguacuccucaaucucccucaacaugaauccucuaucuaaagccuugcuccagacuucuaagggccacguaggaaauagagacccacugccacgagagauggggaguaucuuuacaacuaauagggcaagucuccaggauucugcuuacugggauuaacuggcaagggcucauuugcaucccaccagcuggaauguccuugucgguccuguagccaucagaauugcacaucuuuccagugucuacucaguccucccuuuccccaggaaugccucucacaucaucuugaggcuaucaucaaagcucccugauucuagccugggucaggcaagcagcagaguguuguggcugcucauggccacucuuuuuccagcacuccccaaaacuccaggaugaaagaacccuaagauugccaguccuacucugacacagaaagcacaucauuagccuugccugaaaugaagcaaggucuccagguacgucccauagaugccgagacauacacagggcccaggacaugagcaccuauagcucaacgcuaaagaagcaugucuggguuugaccucagugagcuucuccuacagccacuucaccccacccuccagccgaugaaucaaucagaacuugucuggaaccauugccccauccguugcacaaggauaucuaagaugaacauccccaaaugccaagccuaccacaagcacagcagccuauagcucagccuggcucugccauguaguuucccuaaagguuucuuccaagagguugguuccugagcccucagacuuuuuugaugugacauuuucaacuggaagccucaacauuuauuuacuaaccagccugccaucccacucugggaugacauucaggggccaccaguuuaccaagauggguggagaaaagucuagaggacagagggaaaguaagaauacaggcuaggacauugcaagaaucccaccaggugcccacaagcaccucccgggcgagcaugugcuugccgggccucuuuugacaugacagcuucaaaaaucuuugagcaaaaccagccccucgugcguuaauuagaauuuccaugucuucaacuuucuccuggacccugcagaaucucacgccaagacguucgaguuucucuuuuccagggaggcccgcuguggccuggcuuucauccacaucacuacuaaugucuccugaauucugcguuugucagcgaggcuggggccagccuaugccuucuggaaggggagcauuaguggacuagggggcuagcucuucugaugggacugcuuugccugggauauucagggccuggagacaaucagggccugcugugguaccucagugagcacccauuucucuuacuuggcuucucaaccugcaaaugaugaugggagaagauggaggggccauguugggggcaguguccaggaggauagggaaggggacuugucaagaacagaugagaccaguuugucuuuccagacuaguguccugucuucugugaauauccagaccaccucugucugcauaaggugccaaagaagccccaugagagcccucccgggagggcugugcaaggcuguaugagucacaggaucccugucagagccccacaaggccccggccaggcucaaacccgucucugaaaugcacgggggauuaaauguucuccuaauuaaauuaaaagcgaggcggaguggcucaguggcucagugggaaagagagggacugggaaucgaaugcccucaaucuggcucccagccugcacuggcccagcuauaggcagcccccagugccccuaaccuucccuaguuucacuuccuucaucuaagcacaugaaaagggaugcagcaaccuccuagaauuguucugagggagacagagaagccagggagaguagugugacaguacauacuacaccgauaccauaaaagaaagguacucugaaaaacagagagagccccucaaauacaucuucuguuugcuuugccuagagcuggaaguggaaacugaacaauagggacugcugguggucuggucagggguacuggaguaauauauccuucuaaacaaggugguagucaggcggcaaggccagucccucugggcuuguaccguguugugucucuacuaaagcucagaaaauacugucuucuauagagcacuggguuacaaacuuacuuauaguagaaagggaacacaucaaaagaguaacguauacagauuuccaguacaaaccuacugcauucucccuaccugagagccaagcauccaaagaaagcaguagaauccccagggaguccccuagaucccauuuccuaucauggacacaccaagaacaaaccauaagcucacuucccagcacaacagccuucuuugcccgaguuugaaaucuacauggcuagaucgcacacggcacacacauguaucuggcacuuucauucacucugaugucugagaaccacccaccccucccagugaggcugaagaaaacaguggucucgggagccuuuugaucguugacacucuguucugaguggccugugauuugcucuuucauucuacuacccaugaccacugggcagaucuggguagugaguuacuaagaauauucuacauauaugugucugguaaaaguuauggcuaucucugcuaauuguaugccgagaagugcugggucauugcgggaucagcuguuucccauggcagucaccccaacuuuuaccccugcuuggcagcaugugaauauuccacuuuuuuccacauccucacacacacuuggaauuuuucacuauuuccuuuuuagccauccuggcuucucauaacaucagagugguaucuguaauuugcagugagcuaagccccauucuauauucucauuucuuuauagaucucuguaagacaucuauauccuauacugagagcuguucuucuucaggcacaaguuuaucucucucuguccuggguguucuuaagugugagucauuugucagauacacagauacauguauuguaaauacugcccugcuugcggacuguccugcccccucuuggugucuuuugaugaacagaaggucuuaauuuuaacaugguccaguuaaucaaacauuuccucucuggauagugcuguuuauguccuacuuaagaaacuuugacuacuccaaggucauaaagauauucugguuuguucuaaagcuuuaaaagcucaccuuucacauguagaucugcaguccaucuggaaucgauuuuuguguccugugugaagucaaggucaagauaagcuuuuuccuccacuuggacauccagucugauacagcaccauccuucucccacugcccugucauaucagugucacuauaaaucagcucgcuguuggcauaugguuauucucuggacuguccucuguucaacuggucagcuuucagguuguucucuuuggccaguguuacccuuucauuaucauugcuguuuaccaguaggaccugagggcugggguaugcaggcucccucaguucuuccucauggcuggcuuggcuggcucuguaaggccuuugcuucaauauauaugcaucaguuucuaggaaaauguccuuuguaauggcccuaugagggcucugcggaacaauggccugauugguucuccagccauuucggucaccuuccuguccucuuacuguaguuuucugcauaugcuuauggucugaugugggcucgcaauagcuaagaacagugucuuccaggaagcccugggaagcuugcauuugcugugggcucacaguggcuacggaccaucuuucaggaaacccuggcaggcuugggucauccaauccugcucacaggacccuaaagcaguuuucuuaaugucuaugagcuacaguucucuuuguguauuaacacauuuagaauguaucuuccucuguugguauauacauuuuagcaaauguggacagguauccagucauauaccugacuuggggaacuacuugagaaaguauaaaguaucccuuugugacuggagaccccauaagguuuugcuuauuugaccugacagcuuuaaaaacugccagguaaugauuuuccaugggcuacaaaugggucaggcugcaucccaagugcuguccuaaacaggauaaaauuagacuuaagaggacugagcucugggaugaucuggaauauguagcagcaggggaaggcuacaaguccugacuaaagccugaaguagcuggggaaggggcuugugagcuguuuugacuccuauaauuagagauacaagcaggagacuagcacccauaacucugaugaggaagucggacaugggauccaaggacugugccuuuggcaguuaaagguuccucugugugcuucaauauuuggucccaucaucauugggcugacuugcuuacucaaaagcaccuaccuucagacagacuaaggagagggguaaguuuuauauccugcuuuccuuuggcccugcaagugauaggaagcaggcucucuguugaaaagauaaacccaaauguagccacaguauuuacaaacuaguuuuucagugcuagccugugcugcacuucuggugcuagaguuggugaugguauaguuagcugauauacauaauguauaucuguguaagcuggagaacuuagugggucaguguucagcuucacaaaaggggacaauaaagguucaggaagggcagaaacuugcuacuaucacacaagaaauacuggaagagccaggcucauucuaggacacacugucacugggggccuacgucuccuuuggugaaggucagguugaaguccugagaguaaguaguaagcuggcacucucaguaauacgugagaguuuaugaccauugguagauuugaacaguccaugguggguuugggcacuggucaucugaucaccuucugccaugagaauucugugaauucagccuguuaaguauaccgugauugacauugccacauaaggaagccaggagccuucacuggcuuccaggccaugccagcaucucuagaucucagagacuaggaacuaggauguccuuuccucuuaagcuucucauggugccccgaagccuccaacucaguauuuaugccuauauuuguauuccuuuuaggagaguucagguguccuuggcaaaagccauaccugagacgcaucuccuuggcaaugacugguuagcagaggucugacgauaagcccauggcuggaucuaugggugaucugggugacaucuuggaaacauggaagagaauggggggaaguagauaggugugggaagccacaugugcuguugcagaguggcgcucacuacugcuggccaccacgcauaaguuuggacaaacaaccaauguguacacaugcaguaaaauuuuuugcaaagacacugccuggcccgggcaugauaaugaggcuuugagaguauaaccaaucagaugugagacaugcaaaugagguaugauaaugaggcucugugagguacagagagagaguagccaaucagaugaggaacaugcaaaugaggcuuagugcauaaccaauccaggugugagacacgccucuccuaggccuauauaagcagcaccaguucugggcucggggucucuucgccucugcaaucaagcucucccaauaaaugugugcagaaggauccuguugcagcauuguuacugcuggcgaguccggcgcgugcaagagauaggggucuagucuaagucucuacucagccaagcauuucuagcuccauaauccuggcuucaccaucugcuuagauauucugccuacguaaucucgucacacauggagcugcugccccagaaguccagagacaauuggcagguccccugagagcuuuuucuucuuuggggacaugagaacaacuuagaagcaagagaucagagggcucugagagagauuacuggggaaggguguaauucaagauguuuucagggaucacuuuuauucuaccuggcuucucucugaggacucuggcuguaagcccucauauaaaaucaaacucuaaguauuacucuguccuaacaguggcuuauggugcccuacuggagaacugaggcagaaaugaggcugcauuugcaagguaguuaggagguauuuauguugugggguuguaggcagguaagaagggugaaagaugaggcuuagagaacauagagcucucuacaaacacauacucucaggcaggguucuuaccuauccugcuuuagggccuaaacuugcugccccaacagaacuagguucauugaaguagguagcacuaagcagcuguccucugggccccaccauuaauuuccuaggcagcuggucucuguaccugaggugaagaugguagggcgaaggucauacugggacuuaaagugcucauuuguucugggccuguccccuugcccuggccuugacuacacuuaggccauaugugugagccaacacccugcccucuacuccaagaucuuuuucucuugccuaagucuaccuccuuuggagguagccagacuuuuauuucccucagguuuggauauggaguuuguuuguuuauuuguuuguuuguuuuuagaggcaagguuucucuuuauagccuuggcuguccuagaauacucacuuuguagagcagacuggccucagaaaccugccugccucugccucuuggcaguuuaaaaggcuagaauuaaaggcaugugccaccaccgccgagcuugaaauuguuaaauuaaauugaaacucugcuaauucaaaacacugaaauagucuuuuucagaaaacaaaaaccuacccuaugaacucuaccagcuaggagugugggcuccagaugcaggugccuggggugugggggggggggaggguagcauggucaaccuucaguggagcaaugcuugacaaaaggcuccaggcuugacugaacuuagcaugcuaugugcacagggggagggguaaaguaguccagcccagaggcucagggccucacugaagauauucuucccucuggggauaugguuuagcaguuagagagcugcuggcuuaucauuuaugaagcccuggguuugacccccaacacggcauaaacuaggucuaguuguacauaucuguaaucccagcacucaggagcuucaggcaagaagaucagaaguucaaagucauccucagugacaaugaguuugagaacaaacugagcuaaaugagaccugucucaaacaaacaguuauucuucccuaaggcuuugcauacuccaugcuaccaggcuuuucuuuaccagacugucucaacaaugggcaauggccccaucacaggaucucaggagaccaugcggucuggguuugggucacaacauccuuggaggugucauauaauguaaagacaagagaauggaagucaaucagagauaagagaguauacggccaccuaauggcaugaccagagccagaaagcgggcccaauucuuaccccuauguucuguuuacugauggaaccuaucuccucuguaugggguucugucagucaccuccagcagggcuagaucaaauggcugcauuacugcuaguuaccuggggcauuuucuuaaguagcacaaaaccuaggacuggaacaggaagauccuuccaaggugaugaggacaagcccacuacagacucugccaggaagaaguugguagaccugagguuaugaugcagauacuuacagaugagaccugagacuggccaaggaaagaaaguaaggcuggccaguaaaaccauaauaacacuuuacagaacacccagaaaauccacuaggacaacacuacuuuugaccaagcaagaggaucagacugggccuuagagccauagacaguagagacagucaacuguaauuagacaagcugagcaccugguagcaaccagaaccaggugagagagcaaugcccauauggcaaagccucaaucgccuccagaacugaucucaggagaaauaauccugcuuccaggagacuauggcauugaaaauagucucauuugaaaucaaaggauuugauuugcagccuuugagccaagucucugcccuagguaucuugcugagcacagaaccaaaauguccaccauagucacucauuccuucugacagcugcagaagguucuccacauguucccucccuggcuggacaaguacaaaucccagaaacuuaggcuuaggaccagccagucuaccuugucacugcugaucccuacugugacucauuaucaaaaccaugucagcauguauaaauguacaagucccagggaugcuggauccuggggcuuggaaggcuuagguagggauagagaucccuaauauguuggaacauucuaguagcgaaggcuacagcagcccaaacagcagccucuucauuucccggaccaagaauguuacaggcagaaguaggcuaggauuuccuggaagcaagcacaggaagguaugaacgcuuaguccuaggggcugcuagacagagaaaaagggaauagccucugacuggggugagaacagacauuggggaggacccuucucugcuuuuaagcuguucugggcuugcagugugaccuucauuuucacuguuggcuguucgaugaguacaugaguuaggucuccccacuagugggaagggaggaguggaagcugguuuguggggccacccagggugggcucaggaagggaaggaaugugacugaggcuggguggggcuagggagagcacagccaguuguugguuuuucuuggggcccagaaagauuugaauggacacggaagccccucucuucacagccccagcgcgcacacuagcaucuuucuucgucagauggcuguuggagcuugagaccaaggauacccucuggaaaucugaauuccauucacuuuuggcaaagagcagcuuccugcuuagagaaggugugugcauauguguacucccaaccacagaaacugguagaggggagagacacguggguggauggcuguuugaaaagauaguaggauggcucuagugucuccaggcacuggauggcacuugcaaagcuugucucuaggauuaggcaaauaucuccagggaaugaauuagaaacgugcagucuguguugccuuugaaauaagcucuggcuuaaaaccaucacagggaaacaugccuuugaauuggaaagccagaacuuuuuuugcaaaauaauucaaaaaguuuguugaaccuuaaaccuuuccugaugacucuuuccuucugaacuucacucguuaaaaguugcuaugaucccagccccaugccagaccagcuuccuggaaacucucgccaacugcuggccuuuggaaaggcuugucacccuaauagcuguauuaaaaaaaaaaaaaaaaaaagcacugggcaccuugacugcaggaucugaaaaguccuuuguguuugcuccagcugcagaguuuuuccaggccucccuucuggggcugacuggagcuguuucucuccguuuccucuuauacuggcggguacucggcuggccucuucccgcccaacuucucugccagagcccaggugggcaacagggaugccaagggcagaguccacagacaagcccaacaugggcauguccugagugggcaggucugggggugggcucacagcuucuucuuccccaaccauggggacucaguagggagaagugaggaccccccucuuaggucaacauugugucauuuccacaggacagacagagccaaacuagcagaccuguuucaauggugaagauaacuuggcccucccuaaugcaguuuuggcaauaugaaaugugguuguagacuaagaucuaagauagauuuaaaaauaaauuuguauagaaaacauucaauuagaucaauagaggcacaaaugaacugaaagaugaacugcugucauucuucauuuaucaaauuugagauuaccugaaauggaggaaaguuacauaaaaacuuccauauuuaaugaggcacaguaggacacgccguacucauucucuucuuucagaaucacuccacucaaaagucuauaaugacgagacuuguguagcagucucacuucacaggaggugcccgccugugcaaugggguucaggguacccuucagcagaggguugcuggcucucuuggagccugcccagagccugcccugacucuggcucugccuuugccuuucaaaaccuucuuugugcuagagcagccccugcuccagagugacaugaaccagagacucccagcuccaaggcaugcuguccacccagcaugcauacuguggcugccuacagccaaucccgaucuggaacuacaccugcuauguccaaacaagacuuuuguaaaguauuaauguugugcuaaaaaagcaaacaucacaguaaaaugcacugcacaucagagcaaaccuuuuauacuaguauuauguuaaaaaaaauaccacaaaugcaccacacauccuuguguauacaugcacaaaucaaacagugaaaauuaggguacagaaaggaauauggcaaagaaaaacaaaaacacaaaacuaagggucuccuaccccaacccuaauucccaaguuucuucuccuaaauguuuuuaguucugcuaggucuucccagagacuuuauauaagcaaagauacaugucucugugccuccuuuggacauggguggcacacauucuuguauacuuguacgugugucuuauguacagguaggugccguagucuugcagaugucugcacaggacuggcuuguuacgauauguugcaacucugaguagcaguuuuacuuauauaugcacauucaagugagcaggugacagugcuguuuuucucguggcugggauuccaggauguuguaagggggauguggccuuugcucugggccaggcuuuuuccagacagaacgugcucacuauucuccucagguuguuagcuguauuccuggaaccaggcgcauuucuagucaacacguaaacucaacaguaucuggcaaagucauguagaugguagugcaggauuaggaaugcuaaacuagguguuaaaaaaccaccuuccuaaagguaccuuuaauaaauugguggacccagacucucuuccaaaggauagucuaugaagaaagugaacauucccaaggaugcuacuauacaaugcagaaaucaggaguccgacagcacacaguggccagggacugagacauaugucccagaggccaugccaaaugaaacuuugcacguuuagcaugggcgcucugcaccaauggacaugaauucgaagauagagcuuuacucagacaagcagcaagcauccuuucuacuaacagcugcagagccucugauuaugccaugauuuauggaacaaguccccuauugaugaauguauagagcagcuaaaaauagugauuauccauucaaguguauucacuuaugaaccgaccacuuaugaaauuaguucccucugaaauugcucuccccauugaacauggcugugccuccccauccccauccauguuaucccugcuggcaucucuguugacugagcuccuucuaggcugcucuuguccaccaaacaacauuaagcacacacaaagcaaaucacuuaugaagagaaacuauaaaucuuauagaagaauucaucaaguuggaaagagauuugcugaugaauuucuccauggaaaaaucagacaguuagaccaguuaucuauugaaaagaagagccaggcuaauucuagauaagcauuuuaagggagaguuggugaggucauggaagauucagggcagccccucucaaaaucagccaggccuugccauacuucugcaacaacauccuuucucugcaagaugguacugcauagugcuuuacaaaauaaagguuuucaauuugcuauuuuucuaaaagugugugucugcagacauuaguguuauuauauaugagcaaaucuuuuuauaacuuaacacuuuuucaagauaaccuuccaaucaucugcuuaucacaauguauugauuuuuauuucaaauggauucacuuuaagaugucucuucggccuauuuuaaaugggauuuagguagauaaugccucacagacccuauacuauuguaaaugcugcccaaauaugccuguuucccuagaucccgacaacaagaguacauauggaugggccuguuaauuggaaagacuuaaagcaucguaugcuacagcuuugguuuucuuuuaucugggggggggggggcgguguccauggauggggggggggcauguggggagaacacgugugcugugcaggagcccaugcacauggaguggccagaggaggacaucagguguccugaccuaucacuaccugacuccucugagauagagucucucccugaaccuggaccugagcuggcagccaguaaggcccaacaauccuccuagcuaucuaucaacagguacuguuacaggcgggaaugcaguuacacccaccuuuugacaugggagcugagauccuaacucagguccucauguuugcaugccaagcccucuuacucacugagccaucucuccaccaugaggguuuuauccuuuauaaauaccuaaaacauuugguuugggucauuaaaaacacuuuuucccacuguuucuuggauauugcuuuuuuuuuuuuuuuuuuuuuuacaaagucaguucuuucagucugguuauuugagggguuuguaucagaucuggaaauaagcucacugugugacugucuuaaugaagucucccguguuuucuaucaucuuuuauuucaugcuuuauguuuauauuauuuguuuaucuggauuuggaauaguuaaaaagccgacuuauuuuccacaguuauaugguuguuucaacacuaaacuuacaucuuugcucugcugguuuuaacagcuaucuugauuguauuuccugauuuugugucuguuuccaggcucuacuuagaacuauacugguccugcugguguuauuauauaacuuuaugagauguccuucugugugucauggcuucuucguacauuaucaaaacccagguggcaugaaguguucauucacaauguaucaacuagugaguggcucccagacuggccugugagcuaagcauggcuauggcuaugagugacacacauccuuaacuccugacuuaguccucaauagcuaaccauguucagggaccaugagaacuuaucuuagaggcucccucauaaggcaacauccaaagaguauguuauggccagacacaggagccaucuggguacauaucuaaucaugcuuuagggccaucguaagacaauuuaucacauucggagaaaacaggagaacaauguguaauucaaggcaaaggguuagagguuuugucuuuuggguuuugaguacaaguagaguucagcacacuuagcuagcaugugggaggcccuggguucagucccuagaaauugcccuucccgccccccccaaaaaaacuuuuaaaaguaccauaaucuuaacauauagcccagucucuccccuaaauucugucaccaaaaggagggggugcaccagacagugcuauuauaaucuauacagguaaaaauggcuccacagcaugaucuguaaagcaaggacucagucccuuucucagcugggccaccagggacaauuauguuuuuccaaccuuguccauggcugggaggaaugccacacccacuacuugauuggugcuucuauuucaggaugugcaacuaaaauguuacauggucaaaaagcagguccugaagcuauaaaccaaauuuuaauccaggcuucaccacuucuuccuucauucuagaccuucggucuauaaaaucauacuaaaagaacauucuuccugaguuguucagaggugaaauguauuaauauggaaccauguagaaagguguucgacauggguugucugcugugcuccuuaaaugcauuuuccaucacaaggcaucagcuuaccuuucaucaccuacaacccacauucuccaugcuuggcaaggccguggagagggaagucugguugaauagcaucagugucagaagcaaggcagaugcagccccuuaugguuauucagaaugggagcauaaucuuagaaaucauugccuuucucaccuugacagaagaaucgcccuaccaugaugaggggguaggggugaggucagacuacagagguacagggguggcuccaggugcuucagaaacaugggacaugccacauuuuccacaagacuuagcauaacucaccuguguguaaccuuccuuauugugcugauauuuuagaugaaagaagaaucaccuugguaaauagaaaacguccauucauaaggagaagucgcuguucccaaugcucaagugaacuagaaagucucuauauuguuuaacucuuuacccacccaccuaucuuccucuuacauuuuuuaauucaccucuugguaucuuuaaguguacuacugacuuaagcgagauguaacuuuuuaagcacuccauucuaagguaaccacagauugacauaugccuguaaacaauagcaaagagauucccuauacucuuugaccaguuuccuccagcaacauacuuagaacuauagaaacguaucaagcuuaggguacaguaccaaugcagaauguuucuguggccucaagggccccuauguacagccacuuuaugguaccucaggcuuuccagcccuacuuuccugauccccuggcaauuacuagccuguacgucacugaaauuuguuuguuccuuugagucaagguuucauuauauacccugacugaaacucagagauucaccugccccugccccugccccugccccugaaugcugggauuaaaggcauauacugccacacauggcauuauagcaauguuacaugaauugagccaagcagcaugccaucuuuaaaagaaaaugaagcccuccgucugcccaccucugaggcucacccagguuguauauguuuuugcauccugcuaugaucuuaauucaggucuauacauuuuuuuaaacugccagaccuucuuggcuaauauguaagaguuuuauauuagccaucauagguuuguuagauguguguucuuuuauuauguagcacugucagauuaacacaccaauggaauuuuuuuucuucucgcuguggccccacuaccaguggaauuuuuacuucaagacuuuacaacaguauuuuagaaaaugucauuaagaacguguguguauacauacacauacacauauacauacacauacaaagagagagagagagagaaagagaaaauucuauaauucuauucucaaugcugggggacggguggauuccaaggauuccaaggaaugugcuuuuauauuauguuaagggaaggugggaggcuagaaagaagcccacuagcuuugacagaagguagacuagaugcagaccuagcacuuaggaggcagaagcaggaugcucucuucugugaguuccaggacaaaccauucuccucuguuuugucugucucuccaacccugggaccccuaguuguauaacucauucuucacccccaugugaaggcucguggggcuaagcuaacucagauaaagauuggcgauuucugugagcgcucuggaaacaauggaaccaguugaccuuaccauccucagacucuggguaggaaguuaggcuuuggugguccccacuaggauaccaugaagccuagaaagaauuuuaucuuccccaggauauuucuggagauuuuuagcugugcccuacaaauaaauguguacacaaaugauggacaugcauacauauacaauguacucaucuccaaaagguagcucugagugccgguucuaggcugagccaagcuguucuaugacagacacaggcuccuggagccgaaagaagccagaaaacucuacaacauccugagcauggguagaggaaagccuucucuuuucuucugaguacuaggccucacuagagcuugcccaugcauccagaaggaguccuaggggcaggaguaacaggagagucccgauuuuaccaacuggguauuucaaaagaaccaccacucuaguguuuaaggagaaaacaugcucacuccgagcacaaugucagucuaaagaauaauccugagcuaauacuacuuaagaguucucaggcauuaugcugagggcuuuauacauauaacuucacuaauccucacggcagcuucugacauaugaauacuaucuaccauuucugauuuagagauaaacugaaacuagagugaucaagucuggggcccaggucacaaagccagggaauagucgaucugccgaaggugcccagcuccuguaacauucucuuggcgucaucuuuaaacgugcuaagcucuccucugacuuucaccuucacaagcuagggcugauuuuaggcugaaacgugccuaggcuauuucucagcuucagacugaaccauggagaacugcacccccaucccucauuuuuaauguauaaccgcauguuugugguaacaaguuuacugacuuucucugucaauuccauucaagguccaugagggcagauacugaccacuuccauucaguguuuuauauucugugcuuaaucuacucagagcacaucaggaaccuucagugaauguuugaugaagaaauaaauaaaugaauauguaaaugacugagguuucccaugcaaucaguuagguucuccuaggacccagccuggggcugggaaggcugcuuuggacccuguuaaugccaggaacaucuuuuuuuuuuuuuuuuuuuuuugagacaggguuucucuguguagcucuggcuguccuggaacucacucuauagaccaggcuggccucaaacucagaaauccgccugccaggaacaucuugaagggacgguacagcuucaaagcucccuggcaggguucuauccauggggccuggggccccagaguucuccagaagcuaucuuaucaccauucucuacaaugcaccccuuucugccugcuguucuagaaauguaggcaccaaugaaauacaguaauuuuugaugauucucuuagaaggguuucacauggaaggaaccaucuugguuuugugaauauguaacuccaguuccaggggcucuggugcccuuuccuggccucuguggguuccauguaugcauguuauacacagacauacaugugggcaaacacuaauacacauaaaauaaaaauaaaucuuuaaaaaaaaaaaaccuguggaucaaggcuuggggcagcagcuauuucuaggucacagcagcaaccucuggcagcuagguacauacaggaaaccuacucuacuguuuaaagaaaacacacuguugccuuagggcugguagaucaugccacauguguguguguauguauacccucagcacuggguaggacuagcuaggcuaacuccaaagcacagcaacaggccagucuuaggaaugaaccagcaccaagucugagaguucccacugaaggcuucuauggauaauggggcuggaagugaaggauggagcacuccagaacugucagucugaaggacuggcaagaccaggcacauagaggccagauucuccuugaugcacaugaggccaucauaucugccacacuacugucugcaaaugcuaguuccugaggcccugggugcuugcuaaaaugcugugcuuuucuuaggaauggguaacugucguggaggaggaggaggaauugcauucgauuccaucaacgaagguuuuccuauugaaacaugacuuguuaaagcagaggcuuaguucagaguaaacauuucacagugcuaaggagaaguggagauuuaugagcuagagcaagccucaggcaucaguagaaaccuuccugcuauccagcagcacacacacugcccuggaguaccagcaucucagauguuguucccauagcugaaggaacaccucuaauaacuuuccugacucucucuguguggaucagaagccucuaagacccugagccucuuuguucucucucuggguucuuguggauccacuaggccuccagggcuagccucucgcuccauggcccaaauguguucauaaccagauuguguuaggugauucucucuggccaucauucacaguugccucuucuaagccagacagccaacgauauacacugacguuuuccugguaagacaaagcuugaugacugccuuggcuucuucgaauuggaaagaacuuccuugucaacuugccuugccuaucacuacaugguucagaggaaaagacucacuagcuggcacagccacuucaaaucugucacaccagcucuuacgggaauggcuccccuugaagaauggagcauaccaugagacuuaggaagacaugguccucccaguucuuaaucgggcacugucuauuauugacuuuacccaguccaaauaguuuagcccacucuugucauuuccgucucucuucggaguggcauguggugagauaagggccuaggccagccaaagacaagauauagaggaacagauggguaaaccccccagcgccaucuuuuuucaugugggaaugagaagcaaaauguggcuuucugaccaaccuccaccuuuccacuucuagguacuagaaaagcaacaggucuaccuucucugugucccuuaagugacuuuggcagaaaugagaaacagccccccaccuccaucuguagaacaaacaguacuugaagauagccuugugggagucgggacccaacugaguccuugcuuuggcugagagaagaccucagcuaaggcacaaucacaugucaaagcucaauaugucuucaccagggccucccacaauucagucugcuacaaaagccacauugguacuuagguuucucuaaagauuuuuuuccuacuuuuuccauaaucauagaguagggcagcguugacaggaacacaggaagcacaagccuaaggccuggcuugcuaucucacuucugauauuuucuaugccuuuguuggaucucacuaugucuaauccugcccucuaagccugcuccagccuaguugugugaccagacccugacaggauggagcaggcaagcaucucgucucaucucaucagguagugcugcuggcccuggacauccuugaaaccauacugcauucucuuuggcccauccugugaguucuaggcugaagagggaaacaugcucacuaugacuuaccaggccuaagguugcugugacucagaaaaaccugacagucuaacucuugagggacaggauuagauauccugaguaguguagaguauuuagccuacaaauugugcauggagaucugagagccagaagcugccaaaagcccauguuagucaaaggggggaggguacccugguuuagcauaaauguugacuucuauuucuggacuuccuguucccuuagcuugggaggugcugaaacccuugaggacuugggacagucuaggauagccugggcugugcugagcugcuacggaggcuggagugugcacuccacaaaaggccugggggauaagcagcugauagagaaaaggcaggcagucuucucucuaccuuucuuggguccccacacaaauugugaucuccccuggcuagcuagaucucaggggaccucgagguaguauucugcuagggugagaaaugcuaagauuucaaaccagucgucagcacgucaugaggauagggaacuccucaaguggcuagccaugccccaaugccaaugagcccuucauggcaccaucaggcugcaaaucaaacacugguuccugaggguuccugguuccucaaaagccagagugggguaucuauccuguggauauuguugguaggauggaaaauccccagcccagccagcugagccaagcugcugcuuuucucccacucacugggggucagcagggaaugcuuccaguuucccuuugaugucucccugaaggagggcagggugagcaccccucugcacucugcaaggcacaagcuggguuaggcucugcuugagaggagacauuggcacuucugccaucacaguauacuggagucaggcaagggacccaacgguggggggagggggggcaaagaggaaggcagaaguggggagacagagagcaagguagagucuccuggaucuucccagagaguucuuggggaggcugaacgagggucuccucuaaauguauucacacaaggcugcuaggacuggaagaaaggcacuguauaaagccauuguuuagacuaaaagcuagaauccaaccugagcagccugacucugaguucccucagggcugucauaccauacaucuccuuauucccgacagccagauagccugcccccacccccaccccaaaaacauaggugcuggagguagggaagcaaaauacaaggccagauauaaagcagggagcugaaugcaaauggaggaucccuccacacaggugccucacuacgcuuguaccuaaggcuguagucuucaaacccuaaaccaggguguaaggugauuucugugucuuuaaggggcaguuacuuucuccucuaguggcucuugugccugagaagaggguggaaugccugccugucuucacgggaaggcuuuuaaacccuccacucucccuuuuaugugaaaacuguuuaacuggcugacuuugaugcagcaggcuaagcccagcagcagcuuugaagucagcccugcagauggaggguucuaccagccuugcaauaaucucucauugcacccugcaacucagugccacccucagguuaucccucuagaacuuaaggccuuucacauggcuuuggguagaaguggcccaugggaagaagcccacccauaggaaaaagggaaugaggaggacagcaucauguagggcugauggcccuaaagacuacaacuacagccuugucucuuggcagccucuggagagggcaguacuguuccuugcccucugcccaguaucucagcauuuaggccucucugggaggaacagaaugaaugacaaaccaagaagaauauaaacauuugcuguagcggcuauuuuccagauucuugauguuuagguggucuuagaaacagaauggagaggagacauacagcccacugaggaaaaucagggcaggaggagugggggcuaagggcaucuguucuuugcauuuggaucacacccauuuguuuauaccaaguuaguggccggacauuuugguacugaagcagcccaccaggcaggaagaggaagugguaccuuaucacgguggccuguggccuuuccauuuacccaggauggcauuuauacgcacccacaccucuacauccaaccuacucuugggauagccuccaacugcuccaaaccugggcugccuuucucaacagugauagcugugacuucccaagcagggacccaggaaaacaggggcugccucucuagcccuccacagacugcuucuaugaaaacauaaauccaagagcacucugucaagguuacaggcauggagcacugguuuccccagaggcaggacucuugucaggcacccaguggccucaaacaaguccuucuauguggcugaguuucuucuugcuugcuauccccuuucuuguggugcucuugggaguacuaaaucgcauccauagaacaugaaguccacaaggccuaaagguaguuaacgagcacuggagcggcuggcaugacugucuggcauggggcauaugacugguugagaggcuaccugccuuccuuagaaaagcuggaaucacagagagcuagggugaggugggugacaccagaaggugggcuucuuugguugucaggcacagucauggggucuaaguaggccucagcaucuauuacaagguagaggcacccaggcuaagaggagguaaaacgggaaugagacucagucuugggcccuggcugggaacaggaugaaugugugugacuugguuguguacaguuguggcaguacauguagcuaucaaaugccauuucucagaagucccgaauggcuagucccgauagggugugacccuagaaccuuuagguacauaucccuuggcagaaggauuaaugggaacacugaccucaggccucaaggagggggugcuucccucccacugcugggagcuuguuuuuaacagucugagccaucuuccccauccggguuuugccauacaaucccagcucuuuuaugcugaccugaaagguucauucaggaauuaaguaauauuagcaaaccccacuaaacccugggcaaagggcagaggaugaagccuugaucuggcaccugagcgagggagguaucagagccucuacucuaauguacaucauuccuagacacaugagguaaaggcuaggcagacgugguguagaguuugugcugaccucuggccucuggccucugagccucugggaggggcacccggggcucagcuguguuuaaaaauuaccaaguagaagauauagaggacccacaguuaaccauuuuuuuugcagaaccugugaaggcuguuugaacagcuaaucaggaacaaugacaagaaagagacaucuuccacacagggcuguugcccccuugcaccuugaacccuggaccugcucuguuugguuugggccucuagguuugagcaguaaagcucagaaacugcuaacuuuggagccucccaaaaucucccugcccacugcacaccccucccccagucucuagcguuggcaaccucuuugcuuuucaucucagccuauucaaggccauuuguuuguuuuuuguuuuuuuuuuuuuuaaagcuugcccggcuuugcauuaaaauggguagaaggauuuuccaucguuccaagauuaugaaauacuuuagcaaggacgaggccuccugagggaggugacccucccugcacauucuauggagaaauguucuuuugcuacucuugauucuaggaaugcagagagaaaacagaaccacugagaaauaaggccuucucucuagucacagaggaaggcaagugucauagucauacuggcaggaggcacauucuaggcugguugcuguccacugccaacccucauaagacuagaacauugacuccacaugaccucugcaagaauggguuccucuuuccuguccaucuauccccggucaccaugcuagcucugcacccaguuucacacccacuaaguagugcugcccuucuuucccuacgcuggucccuucccucagcaucaggagcuccuggacugacaaaaacuagcuuuccaauagcuggacccaccauaucugucaccucauacuccacuccuccaacucaugcuccaccccaaacaaaaauucuuccaguaguguaaaccugaaacccugcaaucacuuccaacgccuucuuuccuagcugagacccaacuaguccacuaccaagccaggcugcuuacccccucuacccauucccuccuuuuguauugucacuccucugggaggccacaacaccuucugauaaccuccauuccccuccacucaggaggaagagccuuuuaaaauguggauuccacuuaguucccugaguggaaugggaucuaaauggaaugggaacuuagagccuuagcagcucucaguggucucagaacaaacccaagauccucacaggaagcaaggacugaagaucuguacccagguuuagaaagcuagcuucuuucucucguguucccuccuccacaguguccucuuggucuuagugccuaacuaggaucccagauggguucuggcugguuccuaauaguccuuucucuauaucuccagaccucaaagaauauucccuucaguguauaacaacacacaagcaccauaggacaggcgugaccugacuccuguaaaaucccuccucgagacagcugugcgaugcaugguggacuuucaacaaguauguguggaauggcugagucuauaaaauggagcaauaaucacuucccugccuccuacacauaauucacuuccuggaaagucuccguaccgugcagacgcuauauacugauucaaagucagcuacgguguaaccuuugaauaacuaagcauucaggcugccuaugccugugcuguguuuccuuucauuagaccagauucccagcucccagagagaacaggacccagagugcuuuguaagcaagacccugcagagugaagaaacauugauccuuuaguauauguuaggagguugaggggauuagaucuacuaauuggccauacugaggaaugguuucuuaauccauagagccauaugcuucaaaaccuaacuuccugccagaccagauaagcccuuauccaugguccccugcucacucuucuuucuuucccccuccccugcucaccuuugcccucgcccucacccucacccucucccucucucucccccucucucucuuucucucucacgcgcgccgcgcgcgcgcgugcacacacacacagagagagagagagagagagagagagagagagaaagagagagagagagagagagagagagaaaggaaaggguagauauuggucuauugauuaauucaaaccaucuuuaugcuccaguuagacccucuucugggaggaucacauggcaaggcccagagucaccuguaugaauacuagacugaacauuagacucagauccauauccacugugauugccccuggaagccagcaggcuucaaccacccucugcugaaccucugcuuauuuaguaccuucaccaggcuuaguuaaccuggacagcagccugaguaagaaggccuggauuugagcuaagggcaaacuagugggccuggcccugccccuucucuauugcagagccuaauugccacaauuagcauuauuaggagaaaggcccauuagaucaguuucuuccccuggcuaaggcuacaacugcuagggagggugagcucaaggcucuucaaggagcugggauucuuccauaaaggagggcacauuuaaauugcaaacaagggucucagucccuaggaaaggcucagggaagcuuucaguucccagugggagaggcuaggagaguucugugcucuaaucucucaggccuuccugaagacucugaucaggacccugggagucuggacucuggccacugacccagacuuucuggggccaggcagcauagaggaccauggcaaaggcugauaucagaggcaagcacagggaaaggaaacccaguauuagaggccacccacuuacucucccaagcagccuucucugaggcaaacccucuucuccuccuaaguguacuguaaacuucuggaucuauuguucacaagagccacuuacuagucuguacuaacuggcagcugugagaagacccaacccagccucuuuccaggccggcuccaaacugguaaagcugcaggugccaaugccucacaacugaggcacugcagcuaaaggaugguuguaaccgggguuagggauaucucgguggcuaagaauacucacugcucuuguagaaagaaccuacauuugucucucagcacccauguggcggcuuacaacccucugaaacuccaguuuccaggggauugauccuuccuucuguccucggggaugccaggcacaugcaugguauacauacaugcaugcagacaagacauucaucaacauaacaauaaguaggguucuguuuguuuguugauuuguuuuaagaauguuguaaagauuuuaauggaaccccaugcauugugaggacaggauuaccugucaaaauauauuuacaccaaugagcagagauggaggugcuucuauuauacaggcauaggccagggucgucuucauagggaccauaagggcauggauuuagugcauugcaggauaaaggccaggguccgcuguguuuaaaggacccuguguuuaaagcugaaaggcuuucuagcuccuugcaacuagucuaaggcagaccuggcagggagugcccccccacccccaccccaagagcuaugugguaaccuugggaggcagguuuuguuaucacaacugugaggggacuacuuggacuagguaaaugccauuuaggcugugaaacauacuacaacacagagcaccccucuccccucaacccccauccuucaccaaauaacaccaagguggcaguuaagaaaucuucaccacuuacuuucucacugaauucugaaaguggaagaacacuuuccuggccugcucuuuccuuucauuuaacaaaucaaugaagccacugaccagaaaugugugagaugccuacagagugcuaacccuacagagaagacacacacgcucacccaggaccucccuucuaguggaggagacaggcagcuaacuuaaguggacacgcccaaggaacaagaauaccacaguguagcccaugcuucugagacugagguagcaauuagcugaggagacuaauugauauggcagguuagaaaaggcacuugcagugagauaugagaauuacaggaaaauaaaagucaggcagaguggcuaaccuuaagacccugaagcgggaggaauacuuugcugauauaauaauaauaaaaaaaaaaauguugauauugggcuggggagaugguucaguagcuacaguacuuacugggaaucgugauugcuggaaaucaugagaaccugagcucagaucccaagcacacacauaaaauccaggucuggcagcacaugacugggguucuagguuauagacacuaaguaagaucccaggggacucacuggccagccagucaaaacaaaauggugggcuccagguucagugagagcuccugucuauaaaaaagaaaguggagagugauagaggaagauaccuagcauugaccucuggaccccacccaugcaugcaccuagaacacgugugcacaaagaaugcugcugaggcccaagcucagcaagagaagaagaaauggucagagcucagggcaagccaaccuuguaaaaagcugauguuccuagaaauaggagucuacagaggguaucuggcaggugagugaugggugcacauucacuucuucauacuuggcucuuggguccuggugcauaacacacagaguaaaucacagccuucugcccauaaaauuguuacugugaaagggucuguuuaaaaggaccacucugcuccuuccaugcuuuugcauccuaucuccauccuguaacccccacucccuuccacucagacagcugcucuggaguagcuuauuaauaucauuguacguauggacaguaugcccaguuagcgcaggucugggagggguguaauuugaauuuaaacaccaaggcagggacugaaacccuccuucuguuugcugucugugucacucagcaccguuuccaugugucuccaucuugugaaguguacaucuaguccccugcuucuaaccacagcaaccagagccaaaugcccaccaccccaccacccccaggccaugcugugcugagcaggcacacacagccucuccuuguucugggggagaacugcuccagcauguuuacucaggagggaaacuguugcgccgcagguauaaaauauuuuauuugaggaaaaaaaaugcuggccagcuuuccagaaugucugugucggucuccccucucaccugcggcaggcggggagucucgcucccuaccuucugccaacacuuggcauuauccuacuuucuaaggguucucagaagaaaaauaaaugucacuuugauuugcauuucucuggugacuucaguuugagcauaucuucacugguaacccuccugcgaguuucuugucuuaccuuuuccucugauuugcuuucucgucgucucagcugcugcucccugguuuuaguguucugguuaucuuguaauuugucaugggcagaacuuugcaugagaagggauaaaaaggcaaaucaugucuuucaauuauggaacuaguggcacuggccaugauggauuugguucauagaaauccuuaauuuuugcaccuauucaaguucauaaauuugagucuugagauuuauccuacuuaagacuuccacccuacccuagaaaauauucucuguaguuuuucuuaauaaauagcaacuaccuuuuacuuacaguuuggagcucccccuuucuaaggacucugaguucacaggauguuucucuuuuacuuguuuuuuaacaucuuccaaggagguuccacugauauguggugccacuuugaucacaugucaccuuccccagacucggggcugagcucacugagcucuguucugggucucugucacuccacccuucuggcugcuaagccauggaauguuuuucaaaguucacuuggcauuuguacaucuuucucuuucacauacauuuuugaggaagagauguuaaauccuccagcuagaagucugacugcaaucuaacuaaauuuacagauuugcaaaauacugaggauucuaacgcuaaauuuuccaagaaaacaaaugucucugcacauccaaauaccuuccuuuaucuccaaugggaauuuacaguuuucccaaaaacacugucuuaaaaaaagaccagacaaucucguugcuauucuaauuuguaucugagugcacuucuuacaucuuuuacaucacuauuguuauaaagaaaugugggguuuuaaaaauuuguuuguuuggguauacuguauauacccaaauaauucuuuugcugcaaaaccuuaucuuucagguaguucagcaguuuucaaagaaaaguccaaagaaacuucugagaagccuucucagacccucccaggaaaggucacagauggucugaggaauaaauacgcccauaacucaucugcagucucuauuuugauucucacaaagucagaguuuuccagagauaugaccucccuggaauauacaauuauacagcucuauguuuaagcacauaauuuuaaugucuaagacuguaacuaccaauaaauauaguccaucuuaaauaaauguggggagggggaguuaauaauuuuuuaaguacacaaagauuguaacaucaaaauguuugcaaaccccaaugcaaauacaacuauucucucuaagucauuaguuucgcucuuccugccacggaagucuuacaucuccauuucuuuuccuuauauuaggagguggcuaggaaaauacccuuggccugcuccuuaucuuaccaggaauaauaguuuuuaaguuuacuuaaaaguuaaauuuggauauacacuguaucaaguuagggaaauucucuucuaguuuuuggcuuccuaaguaauguccuuccagcccccucaaaugcauacauaggcgucaaaccucaucauguaaauuuucugccucuauugagaaaaccauauguuuuuucuccugcagucucuuaauacugugacuuacacggauagaguuucugauauuggaucaucuuuauaucccaaggagaaauccuacuugucuaagaacuguuguucaaaauucucuuggauucaguuaguuaauacuguaaguggaccuucaucuauguucaccagggaagugccucauaauuuucuuuauuugugcucuccuuauuugaauuuggacaugcucugauucgaaauuuuaaaagauccuucuagcuggagcacaaaucccaaaacagauccacuuuuuuucuucaguguguuugguaacacauuaaaauagaacuauaaucaagcaauccaauccuuuaaauuuuucuccuaguaucuggaaaacaggugcagaaauggaucauuuaagacaccauagaaaucugguuaauccugccugccugcuuuccuucagcaaguauugccugaggauggcuguguauuaggcccauggcuggguggggcaagcucuagggaacagaacagaaaagguuccuuuuugguagugccuaacaaagggcacacgguaugagaaaagauuguuaaaugcauauuauuuguccuuauuacuauugagaaauauuuuacacuuuuuaaucauuuaagauaagacuauuuuuaccucuaugaauuacuuacucccuuuuaugcccagaaagguuacagcggaaagcacuccuccccauuuuacagaaaagggaaugugaccaacaagaacaacaaaauggaggacuaagguuugggcccuggccuugguccuuuaaaucaacucugacccacaugggaccccaugucucaaaaugugauucccacuuguuaaaaaccagacucuuuauacuucaguccugaucccuaccucagaccauuaugcucacacucaaaaccaacuuuaauucuuacuguacugcccagucagguccugaauauaacuagaaacccucagucugguccccaacagagaccugagccucugggaucucaauuuaaaaccacagaaaagaaucaaaucccaacugaaaaucuggagguaacucccaguucugcuauucccccaauucagaccugauucugacucugcaggucucaacgugugggucgugaccccuuuaggcuugaacaacccuuucauagggaucgccuaagaccaucggaaaacacagguauuuacauaaugacucauaacaguagcaacauugcaguuaugagguagcaaugaaauuaauuuuaugguuggaggucaccacaacaugaguaacuguauuaaagggucaaagcacaaggaagguuaagaacccacugcaaccacugcggccuccaccccaaguucccaaucccccacaccugaauuccgagucggcuccagacccgaaucucuacccgauuccaaucgugacuccacucuagacucggaaccacuguagacccacacauacacacacccaacucggauccaagagcuagaucacaacucgguucaaaacuccgaauaagcagccuuccccagccucaguuccacgauacccuucccccaccaugcgcgaacauuccgaacggagccccucacucucagcauuaaaacagcuaccacauaacaacacguacuccacucacuaccuuggugcuggccacaccgggcuacaaagcucaggggucuccagacccgauucgguuucagcuccagugcguucugacucggcccgggguuuagaauccgaaggccugagccgguguccuaggccacucaccuugggacucgaccgaccucggggcucaaagggccucaagaccaccccugcuucuguaagccugggccacaaagauggggacguggacgcaaaauacgagaacugagccacggccgugaaacgaggaccggccgugaaacgaggaccgagccguaacugcaaaacgaauacggagccacugcggcaaaacgaagauggagcccagccgcgaaagcgcggcacgaaucaccucugcuucuggccgugagugcuugccgcgaggagggggaggcuaugaugagcgcggccacgcggacuugcgacuugugccgugcugacucagagaagaaacccgcgcugagaaaaaaaccauaccuaggagaaccaugccgagaaaaagaagcgcugggaaccaagcugaacagaaaagcucuccaaguagaaucacacagagggaaaagaagcguguugaagaaaaacugagagaacccagcaggcuaaaaaaaaaugcugagaagccaaguggaucgcgccaaggcagccgaccgcgcuggagugauccgugcugaaacgauccacacggaagugacccaauugcugaggcagaucggaccauaucgccgaccaccaugacgaaacaagauaagaccucaccauggaggucuaggcucaggacaaacacugaggaggaucgcguugagcaaagcacacugaggauggcuagucgggacugagguguagugcucaagugauccgagcagaggcagcuccaaaagaacuguggacaaauaugcugaggcugguggcuggcugauaugaccucaccgugaaaaaccaugcagaggacgaucacacggaugaaaaccacgcugcugagacgagccacgcugggaaggaccaugcagagaaaagcacacuaagguguacuagaccguaaccacgccgaggagaagcccaccgaaguaauccaaaaugaggccgaccacaccgggccugacuggaccaaaaugcaccaucauagaccacgcggaggggcgccgcaaggaaagcugcgcagacgugcugaggcaacuguuccuccuagcgacaacggcuaggccaccuaccaagaccuuggugacguggcagccacgacacuguugauuggacagaugcugaauaaugacuagggagcucuuccucaugauaggcuggauacagauagcucugugcugacuauuuuuauuggccaagaggaaacagccugaugucuccagcauuuggauugggugagcuuguacaggauuguacgaccuagccugcuggguccaccaccccuuaaggccuaccuuccucaucccuuccuagcugaaccugggguucuuaacucugaauaagugugagaccaaccucaaugcaguacagggcagauaccugaggcagccaauguaccuaaacgguuucauggccaaagaugaguaugccccuggcucuggccugaccuugggaugcaaaaaagcaauccacccucucagcugucccauggaauccuacugugcaggccaggguguggucaucuaaagcacacaaggaggccacccugcuuguuuuuuuuuuuuuaaucaccaaguaaggaaagucuuggggcuaucuuacuuaugaaaaggagggggcccugggucugcccauguuauaaaacuagguaaugauaguccugagguuagaccccagccacucgacccauccuccagauucucuugguuccuggcccugucacuggaguguucaggaucguuuccacucuguccacuuacuuauccaugcauuuauuugacuaacacugucuacgcaccacccuguaucuagcauugaccuaaagccuggagaaacuugacaaaaugccagauuugggggacaauccacuugcccaggauucauaagcaagccuggggcgaggggggggaaugcagauuucugugcaaacuauaguuuuagcauguggaacucuggguauauucuccaaaccaccccuacccagaauugacuucaaacaggauuuaggggaaggggagggagagccaguccugugaacaggccaggguguggucaucuaaagcacgcaaggaagccauacaucuuaacugcuuuugcugaaaauauaugucuacaaaaacagccaggaagcucucuugccaaagaugacugaguauaugugggggaaggaggggaaggcacgguuuuuagguuuggguuuuuuuucuuuuucuuuuucuuuucuguucuuuuucucuuuuuuucuccuguuguuauuuagcuggagaaaagagaaacuggugucauccucuagcaacagacaguuccuuuuuacccucagaagcuacuccuagcuugguaccccaccuccuaccaggccacacaucugcuuugccaauuccuuuugggcccgucuggaacaugcugcauuugauucaaagggccaguccuacccuccuaccugaugggugguuuucuuuucugccuaucccagagcagaugugcaguuaauggggucccucaagaaccugucaccaucuuuaaauucaucauauuagcuuugagcuugcaucuuggaagugaagccugggaucuuuugccacaaauggccccuuccacuuccccagcauaagugacuaggcaccugcuuccugccauugccagccuuccaauugaccucuaagaggggcaucagggccacaugguaaacgugguuaucugcuccccuuggcugagaucagggaacccucucugucuuguuucccaucugucuacuagagaugcugcugcugaaccccaugaagcugcuaagccaggcaccaagagaaugugaaggggccauggggcucugauuugaaacccugcucuuccuuacucuaagcacugucccagcuuagcucugaggccuaagccuuuguuugccuccucuggccuagaaggccaggcauuuuccuuggauccuguuccugcaggccuguuucuugcagggaagguaaggggaguggaacccccaguucuuuagagacuauccacauguuuuaccaaaacacaacucccaguaagaaauguaggcaccuuuucaaaauguuauggauguucuuuuuguuugguugauugauugguuuuguuuuuucuaggcaggguuucucuauguagccuuggcuguccuggaacuugcucuguagaccaggcuggacucuaacucuuggagauccuccugccucugucuucuaacuacugaaauuaaaaguguguguuaccaaccgccuguuauggauguucuuaauccaaaccaaauggguagaucucugcugccuagggaagcugugucuuacaaagugccuugcugacccuccaggccucaccuguggguuucccaaaggucuguuuuauucaaauaugugaguaagcucggaagcuaacugaagcaaggucacuuagaggagugacaccuuccugggagcuugauagggauucuaucuugauaauggguuguuuguuuauuuguuuuggguuuguuguuguacuuguucuguucuguuuuguuuucuaagacaguguuucuucgaguagccuuggcuuuccuggaacuagcucgguagaccacgcuggacucacacucacagaaaucugccugccucuuccuccugagugcuggaauuaaagguuguauaucacaaccuccccaccaggcugagaauaguuuuguuuugguuuguuguuuuaauuaugaaaauuuaguuuauuuaaugguauacuuaaagucugaguucuaauugugucuuuagucaugacauacccaacaaguagauucaagagugucuguugucaguuuguagauucugggcccucaguucugucccuaaucaauuuccuuuugaugacaucugguauauaccucacugugcuuucaagaggucuccauaggucaaucuuugaagucgguuaggccaaaaaaccuguccuuuuccuuugggucauaggcucaauugacaccacccucuuccggaucauggggugcugucaaacaacuagcucugccugucaagcucaguauagcugcuauaugccacccccaaacccugccucucuacucuuuucagggagaccagagaggauagagcuugaucugaauguauuugaugucucauugagaaacaagacguauagguguuucuggagagaaaugggagaccugggucgauuccagacugauuggagggagaauagagcuggucugaggaaucaaagaauuugggggaaaggcagcagucauggcucugaggguuguacuagucccuucccaggccggggccagccuagcugaucugugaucaggguugucuuuggguauagugccuacauuuccuucccuuccagaggcuaagggcuguggggaugaggaugcugaggcagaagcagagagcccagcaccuggugcucuguacuugggcuuccaugugacagaggcaggucuuguccuccuccuguaucugguuuaugucaucugaacauagugggggcuggacuuaacguuccuuguguucccuccaacuccaacauuugggguucaaaagguucccucgcaggccucugcauccgagaacacgcacacauacaugcacgcacacacagcugaagagaauuaggcugcaaacggccacucggcuuuucucuugauuccaagguauuuagagugggggugggggaugagggggaggaaguugcugagcuaauucuucggcauuugccagcacagaagugcagauggggcccagagccccauggggucccaagggaaacaccagaucucuuccacacaggcaaggaaggagaaagggcugcagugggagccccucauccaagcagcaacucagcaggcccuggccaagggguucugugggccucacuucuccccacccccaucccuagagucuaaggauagaacuagcuucagccagguuaccaaguuacugcuuuucuccaaagcagagaggcccagggccacguggcugccugguuaggccaucuucugggaacaggcguugcuguaugcuguagucugcacucaacggggaccccauguuaucucugaguggccauuugcaaagcuaggaaagccauucuuaagguucacccuugcagacauuauccacagacuccacagccccuccucauuucccuguuaaugcucaaacaugugcauguggacaucucacgcuugcacacacacacacacacacacacacagucucugucugucacugucugucucugucucugucuuucucucuuuuucucucucucucucugcagaccuaggugagcucccuguaauuuuccgcauagucaauguguuugcugcagagccuuccucuucccacaaccucucugucucuugagccuacacuccaucuggaucuccccaccaaugugucuuuguggaccugcugauaacuccccauccauccuugagguucacagaucuacuuuucuccugcagaugcuggccaaugucccuguggcccuuguccccuuguucugucugcaucccuccuacaaugagcagguucugggcauugcccuguaggccgagguuggagguaagggacaaugagcaaucuuuagggacuccuuagagggaacuuuccuagaaagauuucucuggcugcuggauagaaagacugaagggugugcucaguggguucugugggagauuugacuuucugcagugggaaaggaggugauuuuagaggaagguaguauccaugaaagugagaaggacuggacuagggguaucuucaugaagaggugaccuugauuagacuuuguagcuaagguuagaccuuuagccaagugguaauguuguggcagugggcaagcgggcaagcaugcaggaaaguaagggucaaugucaaugcuaugucuuaagaaagucauggccuggggcuggagagauagcucagcaauuaagagcacuggcuacucuuucugagguggguugaauuccuaguaucuacaugguacuucguaacuauuuguaacuccaguucuggagugucugacacccucuuugccuucauguaucaggcaugcauagacaugcaugcauguaaaguaccaaaacacauaaaauauaauaaaaaaaaauuaaagauccauggagggggacuggauggauaacucagugguuaagagcauguacugcuccucuagaggaccugaguucgaaucccagcaccccuaucaggcagcucaccaccagccccaggggaaucagaccccucuggccucugugggccuaugcaccuacccacacacaaauagacacacauacacauaacuaaagauaauaaaauaaacuuuuuuuuaaaaagcaaagaguuaaccucauacacaauaccuacuacuguggugacacuucauaguacuaggguccccccuggauauagcuugucagugucuccaucccugucuuugcuacacugggccagagauaaggcacaagcuuagcuugccagaccuguauccugccacuuaggguagcucaggguccaaguuagucuuaggaccuugaggaacucugggguagacggcuaggggacaugcccuuaggugacuaugcuacauuagggcugaugcugaccuccacgcacaggaagacucaaucacuucauuuggggucaucaauaacuggaggccagguggugguucgugggaggccuggcauucaggcaaucucugugaguggcagcauggggugugggcacuucucaugggggagggcagcuguccuguauauguuuggacauuguacagccaagccuugauuaggcaaacccagcucucccugcgccccugcugcgacacggguuaaugccgcagcugucucccuggcaccugccuagggccugguuacgugccaggcacugggaaugggaaaacgaagggagcugggcccuaccaggcccaccaccaaaagagucuuuucugccaccaucuuccagaagcaguggucucccaggaugcaucucaggcucagagcauuucuauccugcucaggccugucaaguucagagcccauucaucagggaaaggccccuauccuguccucugacuguuaccaaugcugggguuaccccaaugcucucucugaaguccccagaaggaugugaaccagaaguacuaccccucugcucuauugagcuggucucucaggguuaaagggcuuuccauuguuuuuacagcaagcguagaugcucauucucucaguuagcccccagcccccacugugugcucuuggaaggcaaggcugcugaagugacuaggccucugggaagcaucaagugcagagggccaggaagagccugaugaacauguuucccucggccaggcaggcucaaagugcggaugucauuuggacaaaaaaaaagauaagaaugggacgaaagggaggccugacaauggccauggugcuuuuacaaugugucuguggggccuuugacaccucccccucccccauacacucacauccuucaagaguuaggagcugggaagauggcucaguccauaaagugcuugucauucaggcguggggaccuaaguuaagaucuccaacgcccacaugaaagccaaacauagcagcacaucuauagucucagcgcugaggagguggggacagacgcaucccaggaguucacucgcagaggagcccagcuagcagaauuaaugaggcccauguuccaugagagacuuugucuuagaaaauaaauggagagcaauuguggaagucaugccauaucuugacaugugcauacacauaugugcacacccaugcaaacauguaacacacauacacacacacacacacacacacagagagagagagagagagagcaucuucuuccacucuaguuaggguagacucggugauucaauucugacaaguggaauguguaucaggggacagcaugagugccaaggccaccucauaaaaggucuuauaacuuucuccucauucucccucacugggguagcugacacuuacagaagccagcuuccauguuguaagaacacccaagcaaacuuguggccagauaccagugaggaaguauguauguaugcaccacaaagaaccagaggcagggguggugcucugauucaggucuucagguaauuccagaagcuccaaccagugcccacuucuucacugcaacgucacgagccagcccugcccagccaggcuaccaaagaaccaugauccgcugacccucaucccugugugcaucagacugugacucuguggggugacuugugagccaguaauagcugauccagccaucucugcuugucucagcucaacuguuggcugucccucggccuucucuaauggucaacaucucccaggaaggugguaucugggcaccaguaaguguccuggacccaggcggcacaccucccugaccucacacaucaugccuuuucuuugaugaggguuaacuguccucuagaauaguaguguccccugcucaagacccagcacaggucccagccuggaaacucaagagauccagacacuacaggucugaaguguaggcugugcuuucagagaggagugauguagggacaguaggcuuaugguagggagaaguuggccugugacaauauaaaaggugacugccacucacagaaaaucuccaaguuuaguucuuaagauacguuaagacuaaggacaaugcccguaagcaccgagaaagggcuccucacuagucagcccugccccucauuuguuuaucgugcccaggaaaauugaguuagccauagaauaaagggagcaggaaaaaauaaacaaccuaaaaguagacacaaggguguauagauugguagagaaugcuacuaaaguccccuccccaagccccucuuuuccugggccugcucaauaaacaggcuuugucugucuuugaacauugcuagaguuauguguguuggguuaaauuccuuuagagcccauggguaaauaauggaaugauguagagcuguccaucaguccagccaggaauagagcuacugccauuuucugcauuacucuucaaccccaccaugacugugacacacacacacacacacacacacacacacacacacccuuccucacaaggaaacccuugcuaccucagccaaucccugaaaguuagcuugcagguccaacuuugaggcccugcaagacuuucagaccaucuaguauccagaagagcaaauaaacaggcccacuccaaguaaaucagacaggcagaaggcccuggaaauuuguguauacagaaccaggaaccaucuccguucuccccucucuggcaugcaguuucauaucagagacacagaccauguuuauuagcaacuucugcuaugaaggugcccacauguggccuccuggccacugagaccucuuaugucacuccccagaaucugauuugggaccagaggacuguguauuggcuacugaaggucaaagggauaacuucuaaccuuccauagugcuaaaucucuggggcuaggccucugcucccaagaugucuucugcagacagccaagaugaggggccccaggauacucugcugggucaaaugacauucuauucucuaacuucaggcuagaggccuuugaaagccauuccucaguagagagaggaugccuccugauuuaauuuaagcucuagaugccagaacuagaugguagacaggauucugacccaucccuguacgguucccugccagccugguguucauguguagccugggucaugacuaagggggacuuggcaaaauagugagcuggcaucccuggagucucaugcugcuggugcccugcucaucuaccugcucuucauucucuuuugaacuccugcuagguucccaggaccccaggagaagcccagcaaucauuuuuagagaccucuauugugggcacugugugacuguuugaguccagaagccuagaccugggggccuugaauucuggcuuuugauccaggacuaaaagccucagggcaggagauggaggaaaacuuauccuucacaccaaggcagcagggaacccaauucuuauggaaggccccaucacucuguccccuccccaagccagagccuuucuugggacacaucaauagcagccaauauuuuaaagacgugacagguucggagccuggugacggcugggcugcucgagaacauggcuggauuuacguccucagcaaagaacccggucaccuuucccuacccuagugcaaucuuuuuuuggaagcccugcuggaaaaucugaaucuugugagccaucagcuguuuauaaucagagaagcauauguuuaaaagagcugaggggccuuauaaacgccgugugcaaauuaccuuuggggcugccugccccaccgccccuccccgaggcugccaucgcuggcgaaggcucagugugcugcgcagaauuagcuguaaccccauuguggcauggggucuguuuagcuuuagucacgucagcuuggcccuggagcgugggagccuacaucccugcugcacagcuucccgcccccaccccagcccagccccagcugcagagcacugcuggcuccaggcuccugugccuuugcccugagaaacagcaaaccugagagcugaggagcaagauguggguggaggcucagccccagagcccaaggggccucuuggacuccugaauccaggagcaccuggaacugggaaccacucacagucagggccuguccagucaggggcuccaguacugugggacugguuuggguuuuuuguuuguuuguguguguguguguguguguguguguguguguuucuuggcuuuccuuuuuuuuuuuuuuuuuuuuugaauugacuuauuuaaaaagaaucacauaccauacaauucaccuacuugaagcacuugaaauuuauugaggguugugcaacucucccuuugucuaauucuagaacauucucucuguuccuuaucuaucauuuccuauuccccagccuacucccuaguccaagauacauacagcucaacuuuacauuucuauaguuuggcaugcucuggauacucucuguaacgauaaucauauguucugugcucucuugagucuggcuucuuucacccagcaucguguuugugagguccauuuguguuacuguaaguggugaugcuucguuccuuuuuauggucacauaauauuucauuguauggggagagcacauuuaucccuucaugaaggucuggucuguuuccaccauuuaguuguucuaaauaauacuaccaucaacaucugggcauuuugugaacuauguuuuuauuugcauauccacugagggguagaauugcuggguccuaggauaguucugaugaacuuuuugagaaaccgccaguuucaucucucaaauucuaccaacagucccugagguuccuguacccucacuaacauuugcuuucuguuuuuacuuugcuaguggguaugaaguuggacaggcacuuccuagaggguuaaugacagugagcaucuuuuacagaaagacauuuguguaccaacuuuggagaaaugccaauucugauugaucguucacuuuguuguuguuguuguuauaaaguaauuguucuuccuaaccuauauacuagauuuuauauucuagacaaaagucccuuaucagcuuuauuuccucccauuuuguggguugccucuucacuuucuuguuuuguuuuuuuauuuuuuuguuuuugagugggucucaggcuggccuccaauuugacuaacuugaacuucugacccuccugccuccaacuccugaaugcuaaaauuacaagcauauaucugggguccccccaccccugcuuccuuuuaaaauguuuuaaauuuauauuuauuuauucauugauugaggguuuauuugugcaugugugaggcuacagcgccuauggaagucagaggacaacuugggacauucaguucucuccugcuguguagauagauauucaggcugucagguuugguggcacaagccccaccccacuaccagcugagcuuucucauuggcucuuuuuuaguuccuuuauagugguuuuguuuuguuuuuuguuugcuuguuuuuuuguuuuuagugugaccccagucaauucugagucugaaggcaaauuuuuauuuuccaacccacuuuuuauaccauuuuaauuacaugcaaguauuuugggcaagcaaugacugaugaaacuuuuagcugugaugaaguccaauuuaucuccaccccaucaccauguugcuuguguuugcuauuuuaucugacaauguauauagccaaggucagaaagauuuacuccucuacuuucuucuaagaguuuaaaguuuuuacauuuaaaaaaaagggggggguaauucauuuuuguaugugguaugaagggaucaacuuuauuuuauuuuuuuaugugacuacccagugguuccaacaccauuuguugaaagggugucuucuuuccccauugcuugaucuugccagccuugugggcucucagggaaaugaaggccaaugugaagguucauugcuauugaucugacuuuauuuuuguagcuguguccagagcuugaaaucagaaagugugaauuguccaguuuuguucuccccuguugcuugggucuguagaauucccagcacuugucaauauuuaacagaggaggcuguugggacucugagucuuauuugaaccugagguuauguuugauagcguuaccacuuuaauggucauguggcuaucuuuucagguuucuuccaagaauaccuggcuaucuucagaguaucucuuggguaauucuuuuguuggucuggugaggcuucaggcuggugaccaguagcuuuccuuccucuguacaaccuggcccugucaguucuccaagucagucucccaugcuagcuacuaaaggccauguuucuagcccuaucacaucugccauacuucuacacagccuccuacuauuaagucucacuguuaaguuugcugcccugaccagguuuuucacauccuuguagaccuggcaagaagacacucuuuccucccuucuccaugagcuucuucaagucgcaccagcaccccccuguccaaguguuucuuccuguuccuugguguccuuugccaaguguguuaccccuagacugaagaucuuuaaaccuggggugaguccacuagagauaguggaguccaccucaguaagcuacaggccagcucagagcccagaaaucuaaauuagaauuuaacugacuccuagauaaucguuguaucacauaucuccaugauagaugaacaguucuuuaguaccaagccaggcaucuuagggccucggugcuagagaagcaggacuuuggcagcuuacaaaaggaauuugauuuucaaauuuccuuucaacucaagggucucaaauccagucuacagacuucugguguaggcaggauucuggcccugcuucugaggaggguaccuuugagagugagguggaaguagcucauggugcauaguugccuggagccauggcagguggcaggugcugagggcugcucccugaagccauccccaugggcagagcagggucaugucauuuggaccaaauugaaucauggccaucugauauggcccugucucacugggucuccuucuccaucuguacacagaggacauacugccuguguuuccugcccccagagaaacagaaaggggaucaagacccaaagaggugacagcuuuggugucccuugggaguuugggagagagcuuugugcuugccuuuuuuuuuuuuuuuuuaaugguacugggaauugaacccagggccuugugcagucuacaaaaucacugcugcugaguuguggacccugcccugugcuugcauuucauuuaagcccugaacauuugcuuucuuccuucauugaauauuuucuguguuucuagcucucuucaagguguggaacuguugcuauggaaugagcugacacucaugaccucugccccgggaaggcauugucccacagggcauuguggccucagagagagcauuauaccccccucugagacuagaugaggcuagagcaagagucccaacuacaggauauuguguucacuguagccccuggaagacugugggagacucagaacggaacuguagaaaacaaugaacaauauuggagagugcagacgggagcccccucccugccucugucccuagccacccugugcuccaggauggacuggaggcccauaaacucuucugccucagcuuugaucuccagcucaucagaugacgugguuugggaacccuuggaggcuucuacugauccuggaauguaaagauaaagccaacugagaggccccuaccucccuuaaccccaccucccaccccccagccuccccacuucccacucccccauccugucuccacucagucugcagugggagccuccucuggauacccuagccucguccuuggaacagcuacacccaaaggcugagacgucagggcacaugacucucagggccuccuggaguggaguguucauguuagcugcuuuauuuccugcguggccucugaacuggacaucugaagaauuggaaagauggaaggacccaucuuucuucuuucuuacccuuaucuuucaccccucccucuucaucagagagcuguuggaucccugaaguucaucuggauagucaggagaguggauuggaaucuuggcaagaaugagaggcccaccuaugcagcugcaguggcagcugauggcucucagugaaauuagcaccuuugugaagcauuauguauugacaauauuuaaauuaagaauuaaugagcauuugaaaugagaccccagagaguagccaggaaucuaccugaguugcagccuccauaggcugaguggcuugcagcccccacuucacuugguggccagggccagccagaccugcauuccacuccuccccucccccuggcugccuucuggaugaguucccgagucacauuguucacugagcucuguccgccuucugggcucuuccucuucugcucacuguaaaaccucuccaucaucuuuuccgcugugguuuuauuguuucauuuuauuauuccaacuauauuaaguugggaagagcugcaggaauuauuucugccuacccuuaccccacuccaaagcaagccuuggccauuggagauagugauaaaucacccugguuuccuacuuucuccaguucaacuucucuggcuacaggcuggucuggagaucagucacucuguugcccagaacagguccccagcuccuccacucccacccagagaaaggagagggaaaaaagaaagaagaaaaagaaaaaggaaaaaaaaaaaaaaaacccagccccgaucucaaagaucacaugccucuccuggaagcugugcugcaggcucugugggccccuggcugaguuggggcuccaagagaagccaaggcccgggugaaggccggggaggaaucuggguucuuuuggcugcuggugagauuauccauuaaauccauauuccucacuguagaguucacggauucagagaauaugccguauucgagccgucuaacguuacuacaauauugcuuccagaugagcaaacacuagcuugcagcccagcccugagauacaugauggccagaucaggggcucagcaccaagccuuuguucuguguuugccugcugcccacucccuaccagcucacucaggaaccuccagauugucugucacucagaaaagugugagauaccucagggcacccaaguuuguggccccaccccucaagcagccucugcauacaaggccaaggcucuuuucugcacucuuggaauggucuguucugagcaggguagaggccugcauacgugaaguaaaggaacuggagacaccuuuuuuguccacuuaucaggaucugaguuccguagaagcauuccaggccuccaccuuguagagggguggucuacauguccguuuuuggcacccacgcuucacaaaaaagggcaaaucccuggcagagggaacagugcccacaaaagcacagagcgaguagucagcuaucaccagcuucagagaaacugguagcacauggcuuugaggccaagagcaaguagcaggcggggguggggggggcaagaggagcugccaagugggucacugucuugcagaugaccaauuccuuucuuaugcaaggacaugguuuggacaggguaacuuuucuugcaagaccuuaagacucauuuuuagguccucuacagcacgcgcuuccuuccauuuuaucagcaucaccccacuaagguggaaagcuuaggcguggggcccuggaggagauagcagguaucaugcacacagcucgcaagugccagcagucuugcauacucugguguuggcaccaguauaaaguaucacaguugggaacuagcaguaacacuguugagagacacugagcaagaauacccuugagcagauuuggucccagcauaucacacacacacacacacacacacaccccuccucccucuuccuacaaguucucuauaugggcacuuuaugacccagcccaggauccccaagacugacagacacauagccaggaaauagcaagccagaguaugcucugaagccucucucaggguccuuccuguccacuaagcucaggggaguccaagcuggagagaucugugggcccuggcauggaugcuaggcaggagaggaucaggcagaggggcagaaagaggcaggaaggagaaaaaaagaggcagguugaggaugagcaggguagugggcauaggcuuugaagacuaauaccuguagcagcuaguuggguaguagggcaggcucagagggaauuccuacaaucccagcauuuugcagccauguguauaggucgucuggaccuaugacacaccauggucaaacuaaagagaaucucucuagaggguuagggucaccagcucagcccacaugggagauucuugagauaccuacaucucauuuccuguccuguggaucaucuuccaccuggcccuuuccuucaagaucaacuagccagaguagcccaucucccccagagaccgugccuuagcuugagugccuccaagcuuccuggaucagggagcagccacaugagccauagcuccaaugccugagugggcagggacagccugggcaagaaccaugccaauacaaaccauaaaacuaccgcccccccagcugggcaugguggcacaugccuuuaaucccagcacucgggaggcagaggcaggcagauuucugaguuugaggccagccuggucuacaaagugaguuccaggacagccagggccauacagagaaacccuguccugaaaaaccaaaaaacaaaaccaaaaaacuaucucgccccaugccucagccaggccucucuagcugaccugcucagugaaggaugaggaccaaggggcggucacucuccacccaugugauacagcucagauaccugagauaaaacaagguuuccuugacaaccucaaggcuauagcuucaggauucaucccugugccccacaaaagcacauuucagccacaccacugagcacccugccucugaccucuccuacauuaauuguucccacaguuacaggggcaucccuguccccagagcacugaccaggccacagagacuagagucuagucccaggccaccucaucuaucuuaggacccaggacuacauuaguagucauuuguauuauacuuuuguauagcuauuuauguuguguaaguuugcuuuuuacuuuugaccaugacuaucuccuaaauaaugugacccacucugugccagacucaguggcucugacacuaggaaaagaaauuaggaacgaggcacaaagcucaagggcuaagcaaaaacaugguggagguagauuggggacacauggcagaaagauugcuauaaggcuguggcucuccugaucugcauacugaguuucaggcuaacaaggccuacaaaucaagacucuauuucacaagcacuuaaaauaagaaauucuaaagagccucagucucuucgucccagguccaucuaacaaaccugggaggcagcuucagguggaaucuguggcuaguuugcagagccacaucagggaagcugaccucuggucagacacugaggucuccuggcucuucaggacagaaugugucccucccccaucaccgguccaguuugugccccagggcucagcuucagguaucuagggcucuugaguaauggcuaggcagacaaacaacuucaguacugcaggcuggugaaauucuacagccugucucccagugugccuuaucucaaaggcucccuagucgcccagcccugcagcuccaggauuccaaacuccugguugggguaggggaacacuggaagguccccuguggaaggggaccucuggaagccaguucccucugcugagugguguggaacuugguggcucacaccgggccauggguccugguauuucuaguguagaacaaccacuauuuccguguuuugagggagccacgagcagucuggagcaagcacuacgugcguccugcauauugggcaaccgagggcguggccccuggcuaugggccagacacacaguccaagcucaacaaauccccacugagcaaguccaggaauccugaugucagguguggaacuauuuggcgggccccugauuagcuggccaacuaccaagugacaaacugaagauuuacaccaaauaugaagccuccccagcuguccuuccuucucucucugcuuguucaguguggcaaggguggggcuuuaaggacccugguuacuguuauaaagaaucuuguguucccuuuucacucccagcagaaagguuacauggguuucuacaaggcauuguagauuaugaccagcagugacuaguguugauuaggggaugggaaauaagauggccccacagugauuacauggauagacaucuccccauguguuuaaucgcagcccacccugcauuugcuguacaugcagucucucuucaaaucuuuguccagcuaugggaagccacaaagcaaagaaaacacagugacuugcagguagccagacagaauucuccaucccugccuccaagccuuuuucuaucaagacaacuaagugacucuuuucacaccagggccagcauuaggacagguaagagaggacagacccaggaagucauugcuucccccaggacuauuauuuccuagccuggcccugcuuucaggaacauuuuuaagccuguauuguuggcucucuaacuuuguuuaaacacacaaucuuguaagaguagaagagaagaggcaugggcagccaggaguacaaugaacagcugugggaacaaaggagagccaggaaauggaggcagaaaguaaaaaagccacccuccaggggcugagaccugugaaccuaucuggaucucagggaaaaacacccuuaaaugcucacuuugucccaaguccccagggucugcucccuuaaaaaacagagcucagcacccucuguguguguguguguguguacaccacagcauguguguggaggucagaggacaacuuguaguugauucuuucuuucuaccaugugggcucuggaaaucaggcucgggucaucagguugguugguuaaguaccuuucccgucugagcacucucaccagcccugacaucccagcucuuuaaggaucauggaaaaagaacucaacuuggcuguguugucuugauucugaggcugagaagggcucaucugcugagaaaguaagucaaguuuuauucugaugacagggcaucgccucgaggucccaugguucaaggucugugggacugcucccuccaggaguugagcacuaggcugacauggaacaugccccauccuggucucccuucucagaugaacucccagaugacagggcugacaugccccauuguggcuuaaacccuucgaggacucucccuguccucggggaggagcugggagcucugcuccagccaaacaugucuucaucuugccuuccuuccuccaacuuccucuguacccuccucccacccccaccccccuguagcccccuccguauuaaccuugcaugcucugaccucucuggcgcugccugagaccugaugggccccauacucagagagccuuauauagcccuggcucugacuacgccccuucauccuguuuguuucugugauauuuuucuugacuuuccacccaugacuggaccugggucccucaggauccaguaccaaauucacuguucuucccauucuucugugccaucccuccaggguucagcucucaggauacaagugagcagaggaaggggcucaaaucuuuagauuacagaaauuggcccugggggccauaaugguaaugaggaaugagaauaauggucuccuuguggcuucaaggaggacuguucagccugggccaccugggaaccuacugcauggcuuuccauaggcacgaugccuacccauuugccuccacaccuggcaaccagccccagggacaugcacaucuguaauaaaagaacaguugagaaaacuaugggaaacacuauguugaggaaaccuaugggauuuguguccaccuggguauugagugaacccugagccaaguuacacagagcacccacccagucuccaggucccuauuuucccaugaguagcugaacagugggccagguaggcauuccaugggagccuagguucaauucccauacauacaccugaauucccagagaaucugagaaauacagguuccugagccuuauacacacacacacacacacacacacacacacacacacacacacacacacacugagucucugaaucuuuaaaguggaagccauucucauguuacgcucacagauacugaguuugguuaucacaaguuuaagccaggaagucagaaucuucuauucaaaacaaaaaaacaaaaaacaaaaaauaaauaaacaacaacaauaacaaacaaaauaaaaaaccuuucuccuuuuggucauuccagagccaaauauguuugcugaugggugagccuucaggcagcccauuagcaucuauaagagccaugugucuuggcaaagagcuuugagguugaauguaucuuaaauucaggauuaacaaucuccaacauugcugugaucucuuggagucaucucauuguuccauaguuuuccauuauggaaagacagaaauggauacaacccaaccauaucagguguaugacuagaccacacugcuggugggaccccagggucuggcccuuugugcaccugguugaagguaggacaauucugugguaugcacaauaugccaagccucagaccuccacaacuaguccccaacugccugugucccuuagugcuuggguuuuacaagaaauagaggguaugauucccaacuugcuagagaguuaccaggaaaagcucuaguacauuagauaguacaggggucuuugacaaggauggggaaaaaagaaaacaauuuaaagaugcagaacaagccacauuucccuugcauggauuaucuuuagaaucagugaugucuucaagguaugugugugcuggcaguucucacgucagaccaauuugcauaugcagguacaaucucccuagcucaacugccuuauaggaccacguugaggucaagccuccuuuaagcuaagcccacacuggccuuguguggggacagaugaaggccaagaggaggccauuggccuugagaaaacucccaaagcaaaggcagcccccgaaggucacaaggcugucucugcaaaaggaaugggccagguuggacagaaccuacauguuguuaaucucugcaugccuagagccuggagccacagcgccuuucuuugaaaagcuuccaauggaggugucaacuugaggacuagugucuccccagcuacagaaaauacacaguaguacuucccugaccccacacauggguuaacuugacuucacaggcucucacagccagaggcauccugggaaaaugguugcuguggggaggguuuacccagaguguguccacuguccagcuuguguauugcgagaacgcaagagaauaaauaggagguucuacagacagggaggcuucugcuuuggaagagcccguugagggaaggggcacuaugagagaagagaggugguagccaagagaaaugaguggacaggcuuccaucuuuccuuuucuccucuucuggcuaucucuggaucuccacauacuaccugaugacaacagagacgacagcauuccuguugacuauugggacgagaaagggacauggagacuccagggcucccaaggaacauuggucugcuuagggggugccuacagaccucuuauagaaagaaccuuccuccuugagugauccuugguacccuugucuauaaagaauaugagaauacccuccuaacagaagacuugcuaggugaggucaguuggucagucauagaccccauggugacacucccauagcugguccacgacucuggaaugaucaggggaccagaaaauaauagcauuugaagcaaacacuggggcucaaagaggugaugcuguucccagcccgaguguucaaagggacuucugucugucguucaaguucucaucgauuuauagaacaggcugacaggccugggcuggaauggauggcaaaggacaaccuugugcccaauaaugguguucagucauuccacaugagguacggcuagccucuuaggccauuuacuugugaccuaguggucaaagcaaguuggggguggguggguagcugacaccuuccucaccaauuacaggugugaagaccuccguucucuggcugguaggaaguguguaucugacucuugugucugacacagagcccaccuccuauaagucucccuucccccucuucgcaugacccccuugggucugccuagggccccauccucuugauagaaaaucacaucuggccccggaugcucugauaagaucaccagggggugggggccacagcaaggagaccaggaaggagagccagaaagaaaaacacacacacauccaggcccacaugauauacaguccuccugccggcucagaauugcuuuauggugucaccuuucagaauggaaccacuuauucugucagaguagagagcccucuacucugccaggugacagcccuaaaucgugaggagcgacagccguccuccugccuggauuggguuuccuuacaauggagcagggcugguggccagggucccauugcuggcucuggagccaggccuucccugugaagauaauaccauuugaggaagggccaguaagaggguaaaggggaggugggaaagggggaggucaggcugucuuggggcuuaucugcacccuggucagcagccacauccccuaaggaggcacaugucaaaaacugcccccugcugaaggaaagacacucagggcuacauacgaucucauacaaaugccagucaaaugcuguuaagcuuuguaccuacuggcuaguuuuuugacauagcccuaggacuugccuaggaauacagagagaagugguguguaccaaagucuucuauuuaggggaaagacucaccuauaccuguuuaugauggucauugagauuaucaucuuggaguuuugggaggguuguauucauguauauaugugcacauguguguggaagccacaggucaaccacaggucauuccucaagaggcaucuuccuugguuuuugagauagggucucucuagucuaaagcuugcuaauaagaaguguuuaaugggcugaggaaccccagaaauauucuugucacuacccagcuuacccccaaccccagcuccaggauugcaaacaugugccacaaugucaagcucuuuuuguuaugugcauucugaagcucugaacucaaguccccaugcuugcacaacaugcacucugcucuagcaucaucugucuuccuaacaacagcauagagcuugcuucacacccuggcauauccuccuuggucgugugugacaugaaacaagacucuccaaggccuccauauucugagcuguacaguggaaguguaguggacucugucgcaggguaaugaugagugaugcagcaagcuguaccagguaccaaggauaauguuggcccauggggacccugcacuaggccgcaguccaacaaguucuuggugugcuaagaggugccccccaaguacaugccagaacuagacuuggcucugacuugggcaggguggggauaagucauugggauguagauaaggacuccuagagguauguauagauacagcuuuagagaagcucugaguugguccccacauaaacagauggaccuuaaacaucuaaaagaguagguagcccucaucaggaauacucaaugguuccuugaugcucuggcuuccuaacuauggcacagcaauuccugccuucuacaucagaagaggcucauaccacaguggagucccccagcauuugucugcucaggcccccaucuucucucugaacuuugaaguaaagccuaaaugugucuggagaucccuaggucucagagugugcccuuuuauucagaauugcuuacacccucuucccaggugugccauuucccaagccugagcugcuagcagugccaagaaccccagccugaaggcucuaaacucacacaguucagggugaccccaggaaggcaccagggaggccauuugggcuugaggggggaaaucaccaacuuguaugaacacugccuccccaggcuuccccacacucagagccaggguaaccugcccaggaguuauccuggacucugagagccucuggggcccagcaggucaaguauuauuucugacuuagaaaggcaggaggccagcuccucacuucucagauucugcugagcucacugaaacccuaaccuucgggcuuccccacuaauuugugauaaggccgcgccaagaaaaacagcagcuaaagaccccagauuucucugcaaauuccaaagugcuugguucauuccagcggggaaggggcccaaggcagccgugcguacagagccaccucugugugggugcugggcuugagauggccucgcaggagccugcuaaggaggaccaccugccacucuggggagauugcuuccagcuggccccagcaaggacaaggccaaggguggguuagggcgguggcuuggagaagcugagauggcucucaggauaugugcugacguggcaagcuuaggcagaagugaauagagaaauguccacccaggcuccugacuuaaagaccccuagaucccuggauagauuagguaaccugcuggcaccucagauaaggagugguauguuguuuauuuuggggugauguauguguacguguguugcuaggaauugaacuaggggucuuauauguacugggcaagcauccuaccacugaacuaugucccagauguguuugagugaagggcacacccuuccuggaggcaagccuagagcuagugacagauuuucaaagaagcccagaagcagcuagggagaugagagcuucucuggcaaggcagaagacacuaaggacagggaagugacccacuccaggcucuggcagcucccaucccaccccuucugcugauaugagagggaggugucuuggaguccagaggggcuuugggugggacuguggugacaagccaauggagcagggccagagagagcgguaaggccauuucccagcagggaagaauauaaguuugauuuuuucccucccaaaucauguuauuucuguauugucucaaguagaagcugacuugaauaugagagauauggggaauuuaaagccacugaggaccugugcuuagcuugccauggugacuguuacuucccugcucaguggccagccauccuuacaaugggcauagaggccuacauaaaacacacuaggcccuucuagagcugggcaggguauugggaacuauaaacccuccagaacccuaagcaguaucagauccugccccagacuuacagaucaagaaaagagagucuaugccgggcagugguggugcacgccuuuaaucccagcacuugggagguagaggcaggcagauuucugaguuugaggccaaccuggucuacagagugaguuccaggauagccagggcuacacagagaaacccugucuugaaaaaaacaaaacaaaacaaaaagaaaaagaaagaaaagaaaagagaaucugaagcucuguaaacugagagucaugaguccuggucaccuugagaggaauaaggacccaagaucuaaguugcagccaguggcuucaugguggggaaucuugggccucaauggccuccuucaccauccuucuagguaucucauuagcugaacccacgugggaagccaaagggaagaagccugggccuacaaccaaaucaagucagucuucuucaagcaugaguagcagcagaaagccauaggaccaggaagggacagcgguagcauccagaguucaagaccauuuguguaaaaucucugagacaugggcuuuguguggucagugaggagcagggauguuugaguaaucuucuauggauguugcaggcaggagggaugccugacuccaggaacauugcaucaaucccacuagcccacugaccuugcguacaguaacaaaugcaaagcucacaugccaaaggcccacaugucauccccagccucguugucaccucguccucuucuugcucugccuaggaacucuaucccuugccuucuuccaucuucuuugugucccaggaccuuuggguguuucuucugcuuaggacugcccucaugcaauccugucccuucuuccaagagcaucuuugggaggcuucugaccucuuccuuccacccuggguaugauuguagccucuucaguuucuuccuggccucccucuagaguguguacugugcaggauagaaguguguuguccugugggaaacugugggacaugcccauaugccagcuaucuuuccuacaggagcacccugaaaaguuacccuuauuacuaggauugagucuucagugucuuaauauuuggcacccaccagcuuccagauggcaucuucuaggagacucaaacaccuauucauauagccauguuuuaggaaggacaagggccagacugggaggccagaacaggagcuacuauacuaacccaagcaagagagaaccaggucauacacaaggaaguagugaagcugguauuuauuuuauuaaaaaaaaagauucuaguuuucaauggcaacuguaacauacucccaccaacacaacagcuuuuuaaaguacacagcaaagggcucugggaguuaggaauucaagucaauguguaguugggucucugcaaggggguggcagauuaaauccucuccucagcuuucugacuccugcugccugcuccuccuccaagcucucucuccacuccccaaacacuucuacucagcaguccccauugccuuccuccuugcuuacaaggcucacagagguucacugaaguagagucaggguaguaacauggcagcuugucuguggggccaguuaugucaagacccaagagaaaaguaggguuuuuggcggccagauagggaaugguugggugucugauagggauugccaugaaagacacuagcugguagugaucaugguuucaaggggccgaguuggacagacgacgaagauuccagccagacaguggaaguguugguuuugguggcuguaucuaccaacaaggccaggccuaaggcuacgugcaaucaagcccuaacucugucuccuagcagccauggcucacugguaacuugguuucccugaaagaaauaaggagacccaucuucuugggcgaugagcaaucaugaaucuggggccugaaagcuaaccacagagccugagauggaggucacaggacacugccuggccuauggccuggcagaggaaaguagacuccccaagagucccucaccagcucccuguaggcauaggucaggcuucccccacuugagggauguugaacuugccuucuucugagcccaccccuugccucuucccuaggacaagagguacaaauggauucuaaggauuucacccuccaagaccccuaugauucuuauccagaggacaauauagcaugcucuuaucccagugacagaauacuagguccccagguaacugaagguggcauguucugguaguauguccauaguagagucuugagaauagaagccacugucacaggucaaccaucaucacacccucuuguaugcaaaacacagugaccaggcaaggguggcugucuucuggcugugauggugggacuccauuaacauuccugagggugguuucccucucagcaacagaagagucccucugaacaaguccagcacuccaggggcccugugacaacagguacauguaagaagcaggcugcguaggucuaguggaagaaaguggaauaccggugagagcccugugugccacauucauucucagagccaccucccuuuaccuagccagcccucccaugcuuuggcccuggcagcuacuggacucccucccauaaaccgugaucaccaaaagcucuagccauuauggcugcaaguuuaggggguucacugggccaaagcugacugcaaaagccacuuguauuaucaauaccuccccccaggacuguucaacugggccuugggccuugggaaggggcagcaucccucagaauuucauagccaucuuauuccuauggucuuagugaaaaugcuggcaugguucuggggaugucccuaaauagcuuccuggagaaagagcaucacucagggucuguuaccaaacccagcaaaucuuaagguccuguuucucuuucccaucucaggagcuggaugaucauucugagaucauguacacacacacacacacacacacacacacacacacacacacacacacacacacacacgaaugaaccaagauagcauuuagcccaggcuugaacuacuguauagcuaagaauggccuugaaccccuuauuuuucugccucuuccaucucccaagugcaauaacacaccuaguuuauucaauacugagaauggaacucagggcuucaagcaugauaggcguucuaccaauuaagcuguacucuuaucccaaagaucaggagugauucucuauagcaucaagcagacgcggggaccuacuucagccaucucaucuagcagaguggagugauggcuguucuggccccuaagaguggccugcugaccuuugugugcuucugggccucucccuaugucaucuguaaugauuacuaugucauuccuaaugucuaggccuauagucaacugagcaaauuaguucagccccucaacuggcuccuggcugccccugagcaaugagcccuauagggccuguucuucucacaccuuugucccuugagcucaacagguggacucccagccuccuuucuccccucgccucauugcuucucugcccaugccaaggccagaaggcaggcugcaugcgggcguuacagggcaucauggcagggugcaagcaaaggggcccgaggcaccgggugcuuccgacggggccugagggccgucugaccuuuccggccauggggcagcaguugcgugagcaggaacaaucaccccagugugcaaggcacaagcagccuuuucuuccucagcaggccggcgcacacagcucccagccuggcuucccuugaacaaacauauuuauuguggccgccacugaaggccucgccuugcagccggagccugggggccucugucccacccacgggggcccagggaggggaccccugcccuggcgguccauuggccagacccucuucccuuugggcccuggccccacuuugcuaaggcagggguggcucucgucacagcaggcuccagagcuuagggauccugcuaggagcuugugaccacccacaggcagcaggccggccaguuucccugguggagcacaaacacaaagacaccugagaucucuucacauggggcaagaacuucaccucuggaagccucaguuuccucuuccauaaaaugggaggcaugauccagccucacacaucucucaagccccagccccagccccagccccagcauccaggaacucaaaaggggcagcuacagcugucuuuucucaggcuugcucuccgucucagccuuuccucccauguccaaagugaaagaguucccacaggcagggcucaccaaccucaggucccucaacugaccucagaccaaggaauccuauacuuuucccucugaugugacucccaacccucauuucucucuaucaugccagccuccuccccacagcacaacauggaagacccaacugagcaugaaauuucccgugaggaucaaacucugguuauaaaaguauggaagcuaggguagacuccaaaggauaauggggguaccccaaacuuccaaccagcaguuucuaagaggagagaaggccaucuugccaggagaggcacuauaggaggagccaagccagacccaagcaccccuguagggaaguaggugcacauucauuuaucucacucucccaccugaagcugaacccccagccagcagaaaacagaagugcaaaguuucugcaggacaggacggggacauccggaccuauuguuugcucucauuuccuaccucagggccuuugugugcccaugcacaagugcguacaugcaugugcacgcgcacacacacacacaccccgcccccaggggcgcgcgcgcacgcacacacacacacacaccucuuuccucugguugaguccuguuuugucuucaggucccuggagcagcuauuucugagguucuccaaagaggaguccugugucauaaaucaagacugcccagaccuucuagcaggccuggcauuccuggugguuauagaugccaguaaauugucuaccauagcucugucuccaggaacuggaagacuaaggucuggggaaggguucugcucugcuucaagggcuucaggaauaggagggaggggcugguaagcauuuggagagagaaagagagagugaauacugcagagaaugaacagauagucguaccaggccucaaagugagucuagauggcugagaagcagggaagccaccaguccaaguccaauaacugcuacauauagggauuaggcuggguaaauggaggcugggucuucagugacugugcccuuaauggagacagcauuggcaggaucucagugagcaggaucagccugaguugugcuacuuuugugggauacuggguggcuggagagugggguaccucucuaggacuuucagaguugagaaaaacaucuaggaacaguauccuggauccucuagucugguauccacuggguaaugauuccagaagugaccaugugguuaggagcaagcaugaagguguacuguuucuuugcaucuuggaauaaguuuccugucucacguuccucugcugugaaauaagaauuaugaccucuacuugggccuggcagugguaaccuaagccccaggacugagacaccaagaaugauggccaaugcagaugucuagguugacaucucuguguggcuaagaacagccauguggccaagcccgugacaugccugcccugggcccaguggaagugagugccuugaauggcaugcuaacacaugucacaugugccauggaagccuccacuugucaucauguaagcuguggcugucuguacacaucuggcuugaauuguacuucucaagaaaauguguuaaaucugacaaugcacccagaagggcacaacaggacugaauguaagagugcaggaagcagagcaaggaauuggugguucuaugguaagauucuugccugccauacagaaggccuugcuugguuccauuuccagccaaugcaugacucagcuuuagcagggcaugguggccaagaacuuuaaucccagcauauggaauguagaggcagguagaucucuaugaguuugaugccaaccuggucuacauagggaguuccaggcuagccaaggcuacauagugagacccugucucaaaaacaaaacaaaccuaacaaaaacccacaagauauggugugcuaaauugcugucccuaacauggucaccuccaugucucucggugaagauaagacacucacucugugguccuaaagaaaggaccuaguccccgaagggaggagaugccuggagccugugaaguaagaagcuguagaaagugaccuccacagcugucuccaaucuaggacuaugacaugguugugugccuuggucaugucaggcaaggccauggagugagaacuuggucaagaugagacauccagggacucagccacaaguggggagcccagaaaguuccaggucaucuucaggcugcccuuaaggugcccauucauggcaaugcuacaggcucucugcuuaccccuuccgaaggcuaugcugaauaugcuggccugauuucccaggacacagagcugugguggcucauccuguuagcaaggucuagagaggaucucagaggaaaggguagccacagaugcguucuggguacuaagucggacuaaggaggaccaagaagaacacuaagagggaguagauuccaggaggggcaaaagcuagggcucaacuugucaggaaggacaaagaaaggggaguuggagugggggaaaguagcaguauuugggggauggagggucaguuccugucuagucacuacccuaucccgggaaccuucuuuccuggagcaugugcccucagcagaaugaggaggcccagccacucagccauaccacuggcugccugagaacgggaaggaguuaacucccgaccucaugggcuggcaaacucugacucacagagcaauaaaauuccuguguuuuaaaaaaucaguauauuagcuuaauuuuauagauuucagaagugcuacuugaaaauaaaagucuccuaauuaucuuuaugaucccaacgugaaucuacuugacgccgcucacggcgaagaaccuuuguguaaacugccgggaaggcuucaugcggccucggcccuaacaggcuguaaaacaccggcugguggguccaagcccagcagggaucugaggucguggcaaagucccuaguaacaccgcggcacacgggacuccugggugucagugaguauggagccacgguucaaauggccaugggaggggcugucaccgucuugacauggccuauacauucagaaugugcaggaggcauaagcaggagacacaaagggcuuggcacccaugccacccagaggaggggcaucucuggcauggaaccaauacuauauccaucuccugcccuggacuggggcucaggaguuccagggggaauccacacccuacccugacuugaccaagcucuccaaaagcccaagcuguggccaaggcaagaaauuaaaaauauaaaccaaaggaaaaagaaauacuuccucugguagggagggggaggggauggaaggggaggcugaagugggccccugccaacuggaggcugggucuuuggggaccuuuccaauauguuccuugguagugagguggauggcuguguugucaggaagccaacauagucugggagggcugucugaggaggugaccuuugccuuaacuaugcaggaagauggaaaggccaccagccucuggcaaguugguaaguguaccacagggugaugggcaccucugagaugggcagauaaaucacugcagccgccuuggugugccucacccccaccugccaguagcagaaugugcuugggggugggugaggaggauacaaggaggcaaagccaggcuuggugggcccuccagggucuaagagugucacuuagccaggcaaggggcuuguggagccuuguugggggcugggagaugccgguuggacccaagcccugggcugggccgggcugcccucucagcaggccacaugcuacagugccagcugcacagacacuguggggauuguccuccugcccggcccgggaccucgaugugccggcucuccgcaggaauucagagcaggccgcgagggggccguaaucggacgccagcuccgaugcccuguuguuacaggugcagugugggugccagaggccaggugggaggcacagcacagccugucacucaccagaugggcccccagggaccccugguaugaguggaggcugggaauucauagaugacagccugacucccaaacuccauuuccauguuacuuugaacaaguacuggcuuuccugccagguccaucucuauggggggcaagggauauagaugacauuagcuggaucuuuugaaguggccuugagggucuaccucacccuguaccuccccacuaccaccccauauuccuacuguaucaggcauccauagucaacgcaggaacccaucccaugguagcuuggcucccuuagugccugcagguaacagauuuccagccuccaaauaaggcacagauggaccaguugaagugauuuaaggacagcaguggguucaagaucacuguugacugaugauaccauaugauaagcuaauccuggccaaagauauagcaugaugggacauguauaagguggccaguguuucuguuauacaaaggaagaccaaugacaaggcaacuuugcucuggucacacguggccauuucccuucuaaagggguuuaagcccuccucucagacuuggggagcugguggcuuaggaacuuguucauauucagccaggcccaccaucagccccaccccuugacuuuaagacagugagucccacagaucuugagaggagcugacacugguccagacauuaggcucccuuguggguacgagaugacaucuaccagagccucugggccacccugccacucuaagcacaccugguccugucagugugcuguccuuguucagucaguauuggauugaccaaaucuaauccagagaauagggggacaaaggaggaacaaguucucugaagcccucuuaggaaugagauuuugagguagaagcugagggcagcgaccauagucuucuuguguggaauccccuucuuguaucccagcaaccaaagacauggaacaaggguaguagacaaaacaaauucagugugaagccaccggaaccuacaagccuaugguuccauagcuaccgcccugugcccacagcucgguaggaauagagcccauaguugccgacuuugacuccugcuuugcuccuaaaccaugaaaaggcaccagcuguucucucuuuccuuugugagacagacuuccucagggugcuccucuggggacagugccaagaguaggguuggaagaugugaagaguauacuuucaucucucagcccaauucaaggaaaccugcguagauucagucaaaguaacuuuuaauuauguauguuucauaacuaccuucgacacaaagugacauuuucuggcuuuuaaaacauagucagauaaggaaauagagucuguuuaaggaacagugcuaaacaaacagugguacagguguucaaagauaucaaaugaguaguagauauggcaagggacccagcaauggaagggggagggacauguggacuuggaaguccucccuagaagucccuagauuuggugaacagacauaguaccucugggggcccugacuuugauggaagaucauucaacgcuaccuucacauuuccugugucaguagauacaagaccugugucggugacagaagacccaaaggcccaacuaggugguagcuuuaaacucuuagacuuaccauccuccaguccuggagaucaaguguggggagggcugauuccuacugcagacaucccacauccuuggauuaugggcucuguaaggauagagaugucagugaacacguccccaacuugccuuccuuaucuccuacccccucuguggccacaucuuugcuccaccaauuucuguauaaggaaggccuuuaugaucacauaaggcagcccauaguccauccaugcugauuuugccuccccaaaaucagcugaucaacaaaauuuauucuucguugacacaagacacaaguuccaaguguuaagacauggacauuuucagggaccaauaagauacuacccaccacagaacccaguucccuguauccccuauacccacagcuugggcucguggaccaauggggccuaccaugccucuuaugaggcuugaaggacaccacagugguugaaggccuauauaaggagcuucaggaugggggugggaaaucucuguaccuggggagaguggagacaguaggccaagaaggaugcaaagcuggacuuuaacucauuuggucuuugaggaacuaggggaccugguggaucugcugauggagaugucucaccugaauggugaugagcaggacacaggugguccuggacauaacuucuuccucaucucugucucucuguauauacucuugcuaggguuccauauguccucacagggaugcacauaaguggggggugggcuuggccccaugugauccugcaccaagccuucugucaauccccugccccauucuagcucugcaggcuuuuucaguuucuagcccaggccugagaucccuuugugccucagcucuuuagccacaagucccaucuguuacuaagggaacauucuagaagguucuguugcuacuuacauaccccaucucugggaguggagaagugccuacuuuagaggagccaugcccagccaccagagaagcugggcucuuuucauuauagccauggguauauuaauaguugggggauaagagcccagugcccccuuggccuguaauuuuucuggauaccccucuugagaggguccggccccuucacccaggcuugccaagcaaaaucagggugaucaucaaccacagagcugcugaguuccuagcagcacccuucuuacccccuaugccccugcccuggagcugccacuccuggccucuuaguuaccuccuggaacucuuggcaccggaguugagagugaguguugauuguuuaaccuguuuaaggcacuugcugugacaaugccagauuuuuccacuuuaaaaguuagaaggaaagaaaauaaauucugaaagaaauaagcuuugcccugucuguucugcccuugagauagagcguuuucauccaaaauagccaucccucuucucuugaucagcaaaagugucuuggaggacauuccuagaacuacuguuccuaggagacuuguuccugacuuaggcuauccuguaccuuagcucaggcaugaccaacacaucagggaagcaggagguaguggcagauagccuuugacuugagcuaguccaaugugcacauucucuguuugccuagacacucacagcuaucuagcccccuacaccccagcacuguguuagggaccauggagacugaccauucagcuaugccacuuccauacagaucuuucugaaugcaguugagcccaggcuccccuuggcccuuucucagggccguuugcacucugcagcugaaucaaugcaaggcagaaaugcauggcaggggaguguuuaccgguagaguuucugaagccaaggaugcucaauguuugucuaggcuccgucccacuggguccuccugagcuuggcaaacaagagccuuggaguacaaggggcccucaccuccccagagugcugaguccagcacaccggaccucggugcaaacagccagcuggggcucuucuauagcacuaaauaaacguaggucaaacaaagcaaaugugcccuagagacccccgugaguaggcagacucagaaagcucugcgugagcccuuugcuguaguccacaauuacugggaagggcaauguagacauuugccuuccccagguggcugccaggaguugagguacuugauuuuucucauuccuaggauccaggaaaguuagucuuuugcugcccuucccccugaacuuuuuacauucucugaguucuuuguggagaaggcuggccuggaugucccuuaguguggguccaaaccaaggcaggucucauuugggauaccuaagccagggucacggcuauuaugcugcagcagagagcagugucuuagcaauuaugggcaauugaagugauucaugggccuccagugauguagggacuauuuuuaucuguaagggucuugcaagccagggacccugugcugcuccagugcaggaagucuguggggguuggucugcucucugcugcuucagagccuucguucaucuggacccagcucaggccucaaggaagaguucccacccccuucuuacuauucagcuucaggguuauaaggagccacggcuuuuacucagacucaaagccugagauauauuugagaccuggacuugcugucacugugccuacucccuacccgaacuacccuucacucuggagccuauguucuguuggcucucccagccccaucccccaccaggagaucaacccugccugacuccccuuuugcugaacuuccugagucuguacagauggaccaugaugcucuaugucugccaguggugcccaagggagguggaauggaugcuuuccuaaccauuaucuuucuuuccuccauauccaccugaacaaucucuccaaauucccacucaguucucuccuggaacacugauguucacuggccagcuaugagauucagauucccucuaggccacacauaugcaaacccaccauauaacauacuaugauauuuccuauuuucauucagcuuauucuuuuaaaggcaaccuucauuauuauuuuaauaaccaucacacauguuucuuuccuuaccauggugucauauccugaucagucauaaguugaaauauuuuaagucaaaaauguauuguaguagcuggggaguuaaaacucuguaauguguucaccuuacaaacacaagcaccugaguucuagccuaagaacccauguuaaaaaacaaacaaacaaacaacccuaggcgugacaacaugcuugugaucccagcacuggggaggcagaaacaggcagaucccugggcucuuuuggccauccagcugagccuagccugcuuagcacaaacucccagaucagagacccuuuuucaaaaaacauccaccuuggauauacuugaagguuguccucugccuuauacccuccccaaacacauguaggugcauguacacacacacauacacgcacacgcacacacaggagagacggagggaggaaagaguguucaguaucuacuucucuuaguggauauaucaguacagcuuccuggcacccuguggaaccacuugcuccuagggccuggcuguagguuguacuuugacuccauccaucaucaugaaagaugaccauaaguguaacaccaagacuagauugaaauucaguacacaagauguacuuucugcugaauacacacguauuucguaccacagcaaagcuuaaaaaucacaaauuaaaauauugaccaucaguccaccauccucagacuguaacacagaauaguguagugaggaguaguaucuuacuguaacugcuuuuaagacccaguccucccccggcuccuuauaugccccuagacgugugucugcgagcacguguacucccuggguuuuugcuuaggugacugcauggcagugggagucagacuucacugaaagcuuagugggaaauucaggaagauaccagcaagguggcuaaacaugaaagggcaguauagcaagagauuccuggagaauuuguggucucauacaauuaccauuaagcacaguucaggaggauacagaugaggcuugcauauacaccugguuugggacaggccuagccuagccugaacucugagcucagagaguaccagucacccugucacuggcucuuccauauguggcuauauucugaauccuuaacuuacccugcccuguaacacauaccugguccaagcccagagcaagagcccuggggcuaggcuggaagaaacuaaacucuagagacagcaggacucaaggagccuaacuaggucuugccaguacuacucagagccucaaggaaaaacccucuucccuagugccacuacauguccaucuacccuccccuuacccacuucaauuuucuggacaucaaagagcauuuuugccagaagacuggaagaaaaagaagugacugucccuaaacccaacacucagaugguguugcauuaccguggaacaaaacaggagccuuuccaggcaugggggaguuggccgagaguguuagcuugcggcucacccacuuaggacacuccaugucuucuccaucuugucacaagcaggaggcuagguggguguugggaagacagcacagaaugcagagggaaggaugcuccagcgaggcaaacacugaauagaccaagcagcccagcaucucccacaggacaugagcccuuagauucuuuuaggcccauaggagugaaggaugcgccauuuaccacagcuuuggugaguguaggacacuugcacagcuacucggugugccuacuguaaaaagaagaaucuaagagcaaacaaccuacccgugcuccagaggcagagccgucgugcaaggguuuagggguuucucuuuuugauucccucacucauucauccugauccacacccaacauuccagguaccauauuagguccuagagaugaaaaaaaaagagagagauacaagauccucaucuguuuaauucagggucuugaagagaagcaaagccugucuaaagagagaagauucugcccagcaugccacagucaugaagaugaggccucaaagaugagccaacccacccucagcaugcuguauauaguauuccuaacucugaugggccuucuugugugugccacuuggagguauuucuugguauuuucucucauaucaggacccucgguaggugugccaguuaguuuuaagugccagcgugucacauccuagaauccucuuagaagaaagucucacuuaaggaauuaucaagggccaugaugagugccaccauucccuaggcuuggggcccugaacuagauaaaccaguacaacccuaacugagaagcaagcaagcaagguuguauuuuucucucuacuccugacugugcacaugugacuugccauuugaguuccugucuugacgucccugaaauaaugaacugugcugaaauuguuagccacauuaaaccaccccacccuuggaauuguuagcuacauugaccccuucccccaccaccccuagguuguuuuauuggccaggguacuugucacagccacagaaaugaaacuagaauauucugcuaucauucucagguacacuuguguuucaguauaaucagacaucuuuucccuuauggauagacuuuaugucaugucccgcccccccucucuccauggugguagauggagccauguuuguguucagcuucauccucaaggguacaaggagaaugguggggguacuuucuuugucugguggucagcuaaccaccccuaucucaagacauacugcugugguagggaacaaaguucuugagucuagaagagcacugauuccuauaguguuucaucccuuuagugugguguaaagguuuggacccaucguuccucccugucagcuuuggaguucaguuugcuugugaaacagaauuuucuccagauuaaguugguuuagcauuccaugugagaauccuggaaucuauacuauucuacccaccuacccaagggcaaggagucucuccgcacgauauugaaccacaugcuuggugccccacugcagucagaaggccuccccccggaaaguucacuucugcgacuccaggagaauguguccuuucucaugcuccauuggaauguauugauugcuggcauaaagcagcauuguacaguaagcagugccgauugcuuuagccagcucuaacagaugagcugccaguuuuuucagagggcagcaaaaauguacaguuucccccucuuuccccaauucaucacaguaucuucuuucugcuuccugagccugaauaucuccaggaccauccuuaacaguagagaccauggguacccuugcuccuucagcucauagugaaaaucccugugaugucuuuuugaugaauuguuuguuuacaaccuuugcugaguuaagaaaguuccuuuucuauuucuguucucuaaugauugccuuuuuaacuauaagaaauaaaggaugagcuggguguggcagugcacgccuuuaaucccagcauucaggagacagaggcagggggaucucugaauuaaggccagccugguccuacagagugaguuccaggacacgcagggcuacacagagacaaaaaggaaggggggggggcaugcuuaucagauguuuuuucuacuagcuggaagaauuguguacuuauccccuugaucugagaaucacacugagagacucugauauugaaccgucuuugcauuccuggcucacauccucauucaguuuucuauucuuccucgcugguuuaauauacauucuuggguuugauuagcuguuuccauaggacuuuugccucuuuguaaguggcauugcacugaaucuccuuuuucuuacauuuuccuugcauggauuugaaaccacaccuauuaacugggcagcguaacucuuguucuguuuucuggagccauguagauauuuuaugaaguuuuggaagaguucaacuacaaaacuagacaugcuuuaguaacauuuguauuuccuuuuugugugugugugucaggggaggaguccccgacgauugaccacagggccucaugcuugcuaggaaauuucuuccucacugggcuguccacccagcucuauacuaaauuucuuaaaugcuuaccuucuaguucugauuuugcuauaguucucaguguucauccauguucauugguguuuuugagcuuacgcaaacacagguguccaucagaccuaauuuucauuguuuugcggcuuucguucauuaaucuuugccauggguugcaaacugaaaagugccacuuauuuuuguacggcccaugagcuaauaguucuuuacauuuuaaaauaauugaaaaacuaaaacaaacaagcaaaaaaagacgaauaggaaaaggacacugggaaaguauaaaacugugaacacacucauccacaugguaaacuguacggauacacagcuguggcagccguggcauucauuguucacagcuguucccaugcugcagugcaaagccaagcaggugucugcccggcagauggaacugcacugcuguucacauuccacauauccugucauccaagacucagucaauccagcauuguugguguuucucaccccaccuaacuucucagcugucccuucccugucauccccaucuugggcugugccauauguaucaggcuucuagccaacuugguccaggcccaacccuguuuuucuccaggcccucugcuacccacucuguagauuaugcucaccaaauuccaugccccaggauaaaacucaguaauaagaaaaugacuugcagagucacgcaugguggcacacaccuuugguuccaacacuugaagggcaaaggcaaguguaucucuguguucaaggccagccuggucuacguagagaguuccaggaaagccagagcuauaaacugagacuguuucaaaggagaagaagagaaggaagaggaggaggaagaagaggaagaggaggagaggaaaaggaaagaaggaagggaggaaggaaggaaggaaggaaggaaggaaggaaggaaggaagaaaggaaggaaggauggacuuauaaguucacagacugcagaaacguauuccuaccugacugaccuugccuauccauggagcuacuugagcucauggugaucuucuuggcaauggcguccaucacacaaaauaggauaacagggucuagggaggggaggaacccucagaguucaaguguuagagcaggcugaauucaacccaggacuuacucuccauauuuucauucagcaugauuucaggccaagaguugcaugguugaaaugcccagggaacaucuuuccaugaggagugaguauagcuagcuucaggccuuagcaucucuugcccagugaggcucuucuuuccuucagguacuggguugcagggguacuguggagacuucagcaccuaauggguuguugaugaucuacuuuggcuuaucuccaucuccuagaugauguauugauuauguccaauucagugacagacaccuaucuaccugugccacaggcaagaaggaaugauacgaagaccccucuccuuccaccagccucuuaucucucccuauuauuguauuugauucauuugaagugaagcauauuguaggacaguuuuauaauuauaagaucauugcagagucaguacagagucccuacauguccucuccagugucugucaggaacauaauaucucagugucuauucauuaccgaugagcagcaguacccaccaguacccaccgugccucacacaguucacucuauuugaaucuucagcauccccucauauccccuuccugguccaggauccauccaggauuccauacaacuacagguccuaccuccugaagcuccucuagaccggaacuauuucuuucuaucuuugauaugaccauggguucuccaaagguucuggggugucuaagcugaguucugucacauuuuucuuaguauuaggugagacuauagguuaggaaaagaaguuaagccucucucuaucauccacuaagggugccaacuguuuacacaacuuaucccaaugccaggguuggcuaucuuggcugggcugugucuguccagcuccucaauguuuauauuguucuguccccuuuuucuauacuguccuccuaaaagccaacagggccuggccuuacagagcucuggagagaccccaagacauggaccauacuguugaccucuguaggcccuaguggggaccauucauggcgggacccccugagaaugaagucuggccucuuccuggaucaaagccauaggcccuguuccccggggaccgggaagcugagcaggcagacaggguagcaggccaucgccccaggcaggcgugggaauccacacauggccccuucucaaaggcgggugcugucccugggccccggcaggguccuggagccucucucauugggcacauccgcgcccagccuggcccaugguggaaaugcaaaucuaauuagucuggcauugagcccgucuuaaaagcauuaacagagccuuaaacugugcugucggaugggggugaagaaacgccuuagagagaaauuaccggauggugacaaagccccaauuuauuagucuucuccaauggggacugugcaaaggacauuaauuacuuuaaugggacuuauuuugcuucguugcccaaaguaauugguuuauuaaccucuccuucccuuuagggaaggagggaggggcuggggggaccgggugguggccccgggagggcccugcccacuguguugccucugcccagcaggucagcuuugcacccuggagcagucagcacucugucccugcugguuuugacugaagcaguaucaacacccccacugcacaccaaguuuuggggacacagcuuugaggaaacagagcccucaaaaaaaaaaaaaaaaaaaaaaaaaaaaaaaagauacacuguuccuaaggcugacagcucauggcuaucacagguaucugagcagaaaggucuaccucuggggaaauagaccuauagggcaggauuccuacagaagagucagguagggcaggaucaaguacauagggagaggaaaugaauagccaggccagguugugggaucaugguggacaguguucaaaggcuaaagggaagguccugggguagggguagggggaugggcaaggcuaacuuaagcagguaaggcagucagcccuggggaaccaguuuccuugugcuucccagaugggucuagauaacauuuaguuccaaagcaaucucucuggcuugagcaagcuaucuugaaaauacauggaaaaacugcuuauccacacugacagaacacccuggaagacagcuaagcccaggcucugagaacaguguugaguuugcagaacuucacaaucuacccauaaggaagggcagagauuacugcugggcaggaggccagcucuuccuucauggacuaggcccgaaggaggcccaggacuaggcgggaaagagcuaggcggggguagggcagcagcuccucuugacccagcucuuggauagacaaagaaaagaguuuuucccaccuuuggaagcacagguuggauuguugugccccuccccccacuucacccuagugaggggggccacauguagaucccagaagguguauauuucacccagaugcuauauuugacacagcuauauuugacugggcaacaugacaaguuagaauagggcugaggggucuucauguguuauguggucaugagcccccucagaauguccucagggguucccacagaugagccuucucagcauccugauagacuccuugccugcccuccauuuaagcccaugcccuggccaggcauauacauggagagaaggcacucagacucucagacaaggguccuaaccaaggaggacccaucuauagauauaagagcuccaggaagucugagacauaaggucuugggggccagcagagcucacaguggagacccucccucccuccccaaccccaaguucauuccaucaguguucaguagugggcuagcccucuagcccuuccuuucuggggauucuauuggaaacgaacagucuagguuaaccucaaccuuaccaagagccugggggcuauaaucaggcagggaaguagaagucaguagaccaacauccccaccucuuguuuagcuuuugggccuucacccuugggagagcuuccaucuuugcagauaucaccuuguccuugauucuaaccuuagcucaaggguaggcagcucuuggcccacugaacugugugacagaagacauuuagggauuauaggacucugaagugagaggagguuucaggccagguuaagaccacacccccauaccauucuuagagcaaaagcuaaugggagaucauggugaacacucaguccauaccagggcuuuaggaggaacgagguucugucucaggcaagccuuggucuagauccuucgucugauuuggaggcccauucauuccuucagcacccacaggaaggucccacauacuucaguuuccaauguggagccaggacccaccagccaagucuagaaaaguuuacgggcucugugggaaggggcuugggggauuagaguggggaacuuauaaaaugaggguuguucaagaggccugaccccagugggugaggcagagaagcagcuagggaugagacugagugcucugcucugcaggcaaagcgugagcacugagggcugcugggcuugugugacccauuugcuaagccucucuggccucauuuguacaagggagacaauucgagauauuaaaugugcuuuaaagcacaagaacagggaugucugggauaaaaaaaaaauguauugauagagguuaggauaaggggaacgaaccuagguaagaagccaauaaagaugcuaagcgccuagaaaaucuugcuggaagccuggggcagaguggaaucuguuggcucccaaccugaggccugcugggucuaggauuugaguucaguccagaggaagaugggauugaaacaugucagggaccucugcacaaggccaagcccuuggaaguuaguugccaggugagcuuauggguuaccuggcagguuauguauggagucuguggggaaaacaucuggacacaaaccaaaauguggcggagagacaaacccaccauggacacacuguggcagauuuacccgggacuuuuugucccacccagaaaggcucaggaaggcuaguuagaggugccagguuugccaguuguacacagcuucagggguuuuauguucugggguccgagugcucugggcugcuaaggcccucucuaaggagccccagagagcugcuaccuccugaaugccccucguuuaacuccugucuuuccccguccuacuuguaacccaaguggcugcagaggcccuggcugugcccagguugcuguguaguucacaaggaacuaugcacaaaucacuucucuagacauagccuguguaauucuucuuagacauuaggaguuucucucccuuguuuuaaucaacaaguccccaauaagccauuucagcgaggccauuaccaacggccccuaaucucccgggggcugcugagcgaaacgggaucucucggcucuuucgcugaaaacgcuuuucuuguuuucuuucuccaaugugcuggaaacuagccaacucgccaguuccauuaacuuaaugagggcugacagucugcagcaaacguccucauaaucuccccaggacugaaacaggguccucuccagugcuuguucauaccccaaccuuccuggcuucuccccaggauuaaaguggguccucugcagugccugcccauaccccagccuuuacuggcuucucaacucugggcaccagauccuacugguacaaacccagacaaagacgugucucucuucuguuucuacccggcaguuccccacagguuucccuggacuuucaggccaucagugacauuggggcacuggcaccccuguuaccucaauggguccagagccacuaugugauucucagagcuaccagugugucuucuuuuuggcauuccuuccucccaggaugcuccuuugucaacaugaaaacuuuaucuauucuuucuuuuucuuuuuuuuuuuauuuuucugggcucuuucgauccggagacucccaaaaaucaaagaauugacuggaaccagcugaggcucagggaagaaaugaaccuaggacuuuucugucaggaagguucccucuucacccuagccuauaguagcaacaggugccaccuuugggagaaggcccagaccuggaauggcagucucucuacuagcaaaaaaaaaaggacagggcugagcugauucucaaagcagacauccauccuaccccagcaaccccuuccccuggugugaaacacacgccucauuagugcugagagccguggggugggacuacagacucaccugcauaccccgugguccaaauucucagccaggucagcagcuucccaccaaccacccuuucuguccuuuguucauuuuggcucuaugaaacaaagucuuucuaugaggccuuggcuugucuggaacucaccauguagaucagguuggccucaaacuuguugcaguaccccugccucagacuacaggugugugccaccaugccugaccgaauccuccuuucacaggccacacaucuccucccaaaccaggcugcuguucuaagauauguguuuguccuggguaggcacucccuaagugucacccuuauucuuucacaugcaaugagugggggacaggauuggugaugccaugugccuguacaucuguggaggcuaccacacagggggaagccccugaacaugcagucugucugcaaaaggagugucugaggaaaacucucaggucagcaugaggguagggcacgcucauaaaaccaaggcaugaugcuuagcauggccgugcugccuggcaucggucucuggaugacuuauguguguguauugcuuuauguggcccuaguggaacuacacagagccuccucaggccagccugcuacccaagccuuauuucugcaggccaacuuacagcuuucaucuaccaccuuacacuuagcucucccauccugauggcgucaguccccuuggaugaacaguuucccgacuccaucuaguccuuugagauauccccuaagacagucguuguauggcuacaauaauucccucugucuucggcuucccuuucugcuuucuuaauuacuccaacuauggucagaaaauaugagauggaaaauucuagaaauaaacaaugcacgaguuuuuaauuguuugucuuuguaauacuguuaugagauucgugccauccacccccuaucccaccugggauaugagugaagucccugucaaccaaauccagaguguuuugcuaccuaccccuuagucacuugguaaccgucucaacaggucugccuucugggugucacaaugcuuaccuuuaauuuuacuuauuaguaaaauaugauacaaaauaguaaaaaaaaaauacaucagucaugaugcagguaugcugaagaggccacaaaguauguccuuugaaugaaaaaaagaagaagugucugcaaggaaaggaaacaguugcaugcuagguugccaagacccacaggcagaacaaaucuguaaaauuguaaagaagggaaaggaagucacugcuaauugugucgucucuccucuagcuacauggcucagaacugcccuugacuuugggcaucugauuggcaucuuggaacuuguuccuucuaguuaaagggaacuccuauauucauacaaguguuugguucauguucaucucauaggacagaccacuagugugucagacaggggccccauguuaguggccaggcccccacucuccuccccagacuuagcuaggagaagcuauugggggcauuuucacaaacugggccacuccuggcuguccuauuuuguccagauucugccuuuuacccccuugacguaucugccaauggcagcuuguucugagccuggguguucccacugacagucaggucccugccuuaggaagcucuuccacacaagccucccucacucuuaccaguucuuuucuggugucccccaaagacaaugcugguggcacgggauggaacuuacuuaggguuuucuaauuaucuuagggcuauuauggagaguagguccugguauacucugccuucuuuauccccagggcacacagacuggccuugaacucacuauguaguugaaggcaaccuugaacuucuaaucuuccggucccuaccuccucaguaguaaaauuauagaugaacauaaaccuggguuauauuaggggugaaacccagggauuuggggcaugcuaagcaagagcuugucagacccauauccccagccccucagacuucuuuuauaagaauacugaucccauucaugagagcucggccaucaggaccuaaccccuucccagagacuccacuucucaaugccaccacaccaggacugcaccauccaugcaugagaguuacagauggauuauaguauaaccacccagaucauagcauucagacuuagcucccucaaguucacugaauccccagagcccucaaagaucuuaucuuauuucaguacuaauacaagagucuccaguguccaaaaugaacgagucuuagaugagacuuguccuguggcagauuguucuccagaucuauuagccugugaaacugcaaaggccaugagcuuccaaauuacuguaguggagcugaucugaagaagacauccccuuucaaaggaagaaaugaacaagaaggaaagacuagcaggucucaaguacauucaaaccccaacaggucacauagcacgaauauguaagggcugagaaucauuggucuuugucccacuuuauggauccacuaagccaaaaccccacauaucaguaacacuaugcuuuaacuagauguaucccauaugucauccagguuggaguucaaugcuacuggcucugacucucuggauuuuugggacaaaccucccaccauguccagacuaggaauuucucuugauagcccuucccuacagcaguucugccucagcccuguaguucuuuggguauaaaaguuauuuggguucuuugucuccacucaguucugaaucugaguggagacaaaucuguccuuagcuccuaugccugguagacaagacuccaugaaggccaccaagacuugccacucacuggagggguagucacugugcuaacacuucacauggcuucugaagccccagcuggggcaucuuagagcugcugcacuugaacucgggaggcagaagcuugcgauguaagggauaaggugggcuaugcuuccugaaaugccucuuggucuuugugucaccugacgagcagcaucaacucccccgucugacauaccgaguucuaaccuccaaccuuuaucaugaacaugccucuuuucauugcuaucugccugguugguuugaaagagagucuuacugugcuucuugcuguguggcccuaccuggccugacacuagcccaggcuaacaugaacucugucuaagcagucagccuguuucagccuucugagugccgggguuagaggagugugccaccaugccuggagucauuucauucuuuucuuccuccugggagcugaguauaccuagacagguacauuuucuucuccuuacaacaaucaccggcuugugauucuccuuucaccuuguacuaucagcaaagagaagccaaucggcaccaucaacacuuugcugagggauagcuucugcuaaaccgccuuguucacuucucacaagugccauccuguacagagcacuagcauccuggaacacaaugccacuacguucuuugcuauuucauuacuccauauuucuacgaagcccucaccaguguauccauuccugccuccauuccuaccagcauccuaacuguaguccuuugcccaugccuaggaagacugagacugucccuaaagcucugaaggucugaugagcucuccucaaucucucuuucugugcuucacaggccccucucugaucccccuuccaacaccaccaccguaucuuuuaucaacacccuuucucagagucaaguacaguccuagcccuaacugugacaaaaugccuuagacuagaugauuuacaaauaaugaagauuuacuguacaaauucuaaagauagaaguccagagucuaggcucugagagauuuagugucuagugaggacuaugucugccucauagauagugucuucuguguguccuguggcagauggcagaagggcaaaaagagauaacuaaacccccucaggcuucuuguauaagaucauuaacccuauucaugugggugccccucucaugaccuaauguccucccaaaggccccaccacagucuccuuggagaugaaguuuuuaguguaugcagacacucagacccaagagccuugacuggggaaacagaaucacccuccucuuucagcucugggacaguugaaaugggugaccuuugcauugcagccaccugccccugagacccugcagaauguuagugccaaacaagaaugucugcuauggcuggccugggcgggggcccagcaaaggguggcucacauggauggcuaauauggaaauaauuugacaaagacauaaaaaccauccauugaacacucuacgugaugagacaucacuuagaccugccaagagagucaaaguucacuguccuguuuuuugauaaugaaccgagagcuacccugagaaugauguggguaucauuggguguagcagggagcuacagcaaggauugcagugugggguggggggaaucacaggagcugagcuuugucucuuggaagcauccccugugauccacugucuggggguugggcagaaggggcaaggauggacuguugugcacacagagaggaaaugagaccaacuucagggcccacugguugccugccuggguuccugggauacccgagaaagggguucuguccacccuccagagcuucccuaucucuccagcugagcucucugcagagaucugcaaggcagccacuccugcuacaaugcucugugcacacgucagcauggucacacucugugcagccaucaccacuagcuaaccguggagcguuucaucacccucaaaagccaccuucacccaucagcagucaccccguauccucccugccuaaaggaccaccgaucucaaauuuccacaaugugcuauucugagcauuucauagagcuggggcucuccagccuggggucagucguggcuggcuucuuuuaccuagcacaaugcccuguagguuuauuuguuuugugauaugugucaaaaugucaccacucuuaguuuguguggcugaaugauacucaguugcacggacaaaccgugcuugugugugucugccugcugacagauuuuuagaucuacucugaauugcacugcuaugacccucacaucuguguucuuauaugaauuugugucuucguuucuuagaauacauauguagagcugugguuaugaggggucacauuuuuaaggaacccccugccccagccugcuuccaccacagcagaggaagcacauuugguuccucaguguauagccaucacuuuaaaaaugugacaucaucucugaggugggggagucacaugacugguaugcaagggccugucuggcuuugcacccacaggaaacucugguacucagaccuugaaaagggaaugugugucccagcacuguccacaggccugagaccuagcacuagccccacccuugucaggggaacauagauguucaagcuaaggagaacuuuaugacagcucauguaacuguguuaauggcagacagcuacauaagaggcuuucagcaauggaguaauaccgagggcugaguaaccuuugcuuaaguuuaucuacuuguuuguuugagacagagucuuaaucucuggccucacacucacuacaacucuucugccuuggcuuccagagugcuaggauuauagguaugugcaaccgugcccaacucuuuuuuuuuuuguuguuguuguugaaucaccuaacuuaaaagauauaugauuuaaaauauauuuguguguguguguguguguguguaugaaaacagaaaccaagggauggaaauacaagauucaggcugguggcuaccacagccaaaacuggagguucucaagacuacaaucuacaaucacaguugaggaaggacccuucccagugagauacucauggaaucccacuuuucacccacuuucaggccuuuggagagugguggaaaaaggucagagucauaucuccucaagccaggccuggaaugaaggguuucaggcagccuccaguuugucaguccagcguuacuggaauuuuucuccgauggcucauguucccaggaguccauaaggaaaccuuuaccuagcccaaggcuaugcagacacucuauggccuuucacacccugaucucggcagcuuccuguucaaggccugacaggcuagcuuugcagcuguggugagggaggaaucagugucugucucuucuuauggugucuaagcacauuuacugagaacauugguucccgauggaaacagcuucgacgauaaagccaauggucacauauauguuuauaacgccuaaggucuugcuccaccccauugcccugccagccuuaaugcacaggcuuuaccaguauuuuucuuuaugcuguggaugugucaaaaguuuguuugaaugguuuguugaaguguuuaucgaaagauggccuacugaaaaggaguugaagaugccugauaucccuuggcuuaguguugacaagggauuuuaaggcucagggaaauugcaaugcuagaguggauacguuguauaaaaccuaauccuccacaaugggaaggcucagaagauaugcccuucacaaauccuauaagacgcaaacuggugagaaggcagcagcacauuugaagaauuuuguucuugcccuuuuccuugugccagaccuuaggguuggagaugcugcugcucaauuggauggauuaaaugcaauggguuuaauugggcccugagguagcaagggccagauggcagcauuauaucgccagaggcaaguugaucguaguuauuauaauggaaaguauagacaaaauaagguucacaaugaccuaacccguaauggucagcacaggagaugugaauuuuaauaaugacaugacuuguacggaccuuugguacugacuaaucaaucaugguguuuccaggcaugaaauagauaggaagccuacuacauuucuguuugaucuguauaugaagaaaaaacaaaucucaaacaaauggaagaaaggcuacauuggaucauggcaaaaggcaaucuuggccagugaaucaauuuccagacuugagccaguuugcagacucagaaccccuugaaugaagcuccccugaggaaggaccuugauaagacaccuaaacuuuuugcuguuagccuuucuccaguucuucacuguuaggaggucccacaccuccuaauagugccacucccugucccaggcauauucaaaccaccacacagguuuuuaaauuuuuuuuaaauauguaugaguauauauaugcaugcaugucugugcaccauguacaugcagugcccuugaaaucagaggaaggcuucagagccccugggacuggauuuacagaugguugugaacugccauguggaugcuaagaauuaaacccaggccaggcagugguggggcaugccuauaaucccagcacucagaaggcagagagagguagguggaucucuguaaguuccaggccagccugcucuacagggaaaguuccagugcuacacagagaaauagggaagagucaaacccagauccucuggaagagcaaaccagugcccuuuaucaaggagccgucucuccagccccaagauaagaauguguuauaaccuccaugaguucaagucagcauccgcuucucacuauccagugcuugucugccuauaagucucaccugcuaacaauuuaaauagcucuauuagcuuugacacuauuacaguuagugucuuuauuuuguggucuaauuacuuauugcuagcagauagaacgauaauggauuauuagcuuucaaccuuuaguaaaaccaggcuugcuccaucuuccaauccucauuuuuuggccuucagauuucugggauuacauacaugagcuacuauguccaaucccagcaaggucaggguucuccuaaauucauuucuuaauaguuuguugguuuguuugguggggguuuuauuucguuuugguuuuauuuuugauuuguuuuauuuuucagauaagaucucucuagcccuggcuguccuugaacuagcagagauauaccugcucugccucccaagugcuuuacuuuaacuuuuaauuauauuauauuuguggggggcagggguaggaagugccuaccacaguaugaaugaggacgucagaagacaaccuguuggaaucgguuucuucucccaacauauggguucugaggucaccaggcuuggaggcaagccuuuuuagccauugaacccuuuuggcagcccaauccuuccaucuucucucuccuuuucucaucuuaaugcacaagcugggacuuuacaaucucuguuagaaaauaugggacacaccaucucaggaacaaagugauuucuccaugacuugaugugugcucaguguuuaggauuuuuuguuuguuucaauuuucauuuuuguucuuuuuuuuuuuuaauuguguuuucuacuuugcuaggaguuguguuuuuaauuaggacuagggccuugaacuuuaucaagugcuuuucugcaucuuuugaguugauuauauguuuuuucuugcucuguugauguggugaguucuguugauugauuuucaaauguuaagccagccuugcauaacuggauuaagccacucugauccugcaucuugacuugagccccggaucucacuggcugcuggguuuuagacgcugcuuccacaugcaggacagacauugcccuugaguuuucuuucaggaauauccuugucagauuugagagucaaggccaggccaccucagaaaagcccuguaagaagcuuuguauauagcugggggcuucuuccuuacaugcuggggagacaccgccuaugaagucaucuaagccaacuucucuguagaaagaucguuaaaauucuaaguucaauuccauugggcaguuuguauuuauuucuucuuuucuuaaaacguguuuugaugaguuaucuauuuuaucuauauuaucagaauuauuuuuguucacauuauucucuaaauagacuuuuuuuaaugucucuaauuccacagugguggugcucauuauuuuaaaacucccaacauuggugauuugugauucgccuuaccccaucccaucuaucuugcuaacguuuuaucaguuuuauuagucucuuuggaaagccaaauguaagcuuuguugauuuucuuuaaugcaacauucauuuuuuauuucaucaacuuacacccuuaucuuuauuaucucuuuccuucgacuuccuuuggguuuaaauguguguguguguguguguguguguguguguguguguguguguguguguuaacuugaguuggaucucagccucuccucuaucacauuuuaggccauguguuaucuucuccucaauguucaucucucaauguauuuccaacguuuauuuaacuauaauuuugaagauacaauuuuuaaauuuauauuguuuauuuaucuguguauauguguauguggggggggugcaagugccaugccccauaugugguggucaggggacaacuuuugagaguugguuuuucuccuucuaccaggcgaguucugggaaucaaacucacaucuucaggcuagggcacaagcacccuuacccacugagccaucuugucauuuuuuaaaucaccaguuugcagccgggcgugguggcacacaccuuuaaucccagcacucgggaggcagaggcaggcggauuucugaguuugagaccagccuggucuacaaagugaguuccaggacagccacggcuacacagagaaacccugucucgaaaaacaaaaaacaaacaaacaaaaaaaaucaccaguuugcuaaauagcguggguuggccucaaacuugugaucuucaagacuuggccuccugaguugcugagauuauagguauacacuuuagcuguaauguuugauacauuuuuuauuauucaauuaaaacuauuuucuaauucauguaacuuuuuuccuugaccuuggguuacuuagaucauuuaauuuccaaagcacuuggggauuuccuaguaauauuuuugauuuguaguuuaauuuuauuguggucaaagacuauguuaaacaucauuuuauuuacuugaaauuuguugaaacuugcuuuuaaaaccuagcgcuugguaucuuuguaaauacuugugugugcuggccagccgugguguggcuuuugucccugucuggguggacugacauauagauuguucauauugggcucugcuggugcuuugguauccauugccagggaagcaagguggaugggaauccuggacaaccuuuagugcccuucuucagcugcagaccacuuuuuuuuguuuuucuuuuugagacagggucucucacuggccugccccaggaaucuucgugucccacucucuagccauaggauugcaaacacaaugcuacuaugccuagauuuuuggggggaucuaagaaaggaacccagguccuccugcuuguaagacaagcacuuuaacagccagcccagagcugagacuuugaaaguccgaaauuuucuuugucuagucuacuguaccuggugcuaguucccagcugcuguuuagaaagcuagacuagaccaccuuuuucucugccccuuucucuuuucuuugcuuuuagugaauucauaucaucauuuuuaauccugacugacaaucaugaucuacuuaaugaacuaucaauucacuuaaacccacauucucugccaccuuauucuuauccauucuguuuuuacuauuuuucuuucuuguuuuacuacauggccucuuaucaaaccaccuacuguauguagucuuaauuuccaccagugugcugcucgcucgcucgcucucucucucucucucuuuuccuucuuuaauucauuuauuuacuucuuuauuuuugagagggagacuuugaaugaggcugagacagcgucuccaguaacauaggcuggcuucgaaccucuguguccaagggugaccuggaacccccugauccucccgacuccaccucccaagaggugggauuauaggcaugugccaccaugccugacuuuuauagaauuucuuuuucaguauuuggagauaacuuuuaucaucuggugaaaucccucaucuucucaucuauuuuccugacucuauuuaucacaguuaucuuaaaguucucaucuagaaagucugaugcacagcacagccaacuaucuaccaaugacucuguaggucagacuugggcugcucugcugggcgcacugcugggggcagaacacucacuugguggcugagcagugucagccucacaugccugaagcugucagcugucauccgaacccuucaccuuucuuccuucacucagcuuuuccagcaggcuagcucgggcuuguccaggaggcagacuuuuuuuuuuuuuuuuuuuuuuuuuuucugagaggguaaaagugaagucugcagaucucuugaggccgaagcucagaucacaugaucugcuuccaccauggcggaacaaggcaggaacaagaagggauuuucagcuaucauuaaaagccauugcuucacaguccucccugaaacaaaguucuuucucccuccaaacagacuucgaggucuuacaacugcaaacaccaucacauaucccaaucuucugccaucugcucccccaccccuucccaguccuaaaaucaacgucaaaucuuuuauacaaaguugacaucacaaugucccagcucgggguucuaauuaauaacuuucuuuuucuuucucuuuuucuuuccuuucuucuuccccuccuucauuucucucuuuuccucggugcuagagauugaagccacggccuaguucaugcuaagcaaccacucuaccacugaucuguuuccagccccaauuccauuuuuuugagacagggucucacucuguggccuggaacucucuguuguaauucagacaggccuccaauucacagagugaacuugccucaaauuccugaguacugggauuaaaggugcauaccaacacacccagcucccugccuuucuccuucuucuucuucuucuucuucuucuucuucuucuucuucuucuucuucuucuucuucuucuucuucuucuucuucuucuuuuuaaaaguuuuacuuauucuauuguauauauguggauguuuuguuuacauguauaugugugcagcauguguguaucugauguccuuggaguucaggaaaggguauuggauccccugaaacuugugucagagauuguuggugcuggggacuggacccagucaguaccuuugggaguucaagcagcaaguacucuuaacugcugaacugccucuucagguaugaugccauuaacuuguucaggcuggcuugaaaucacucuguucacuagacagugccugaacuugugauccuccugccucagccuucuaaauaucugggaguauagguccagcuucuaauuucuuuaucagcuaucuauuacugaacagcaaacuauaaccaaauguuguggucuacuagucauuugucuugcuaacagccccaugggucaggaguuuggacucagcuccucuggaagguaguucugugguugugcuugggcugacucagacagaugcagucaucaguagcuugccuagggccaggugauccaagauggcugagucacauaccuccaaucagugcugacugaaggcuggucaccuccacucgucccccuucagccacuccagccacccucucaacaccuguggguuccacacauggagagcuccccagagcucuacagccacauuaggucacaaggucagcucaaauccaagcagcuagaaaaccacacugucuccuugcgggagggccucuagcaguuaagauugcaaaaugcaccacaccugcagaucucuaucuagggucuauuuuucccuuauuuuucaacuuuuauguauggacaaaaacaaaacaaagcaaaccccagaaauuccaaaauaucucgcuacagauuuucaucuaauacaaaaaagaaagcugggcuaguuuacgcuugagacaaugugaggcugugccagacucaaccaaauccucuggauguuuccaggggucccaugcuagaagggucugaauccuguccucgguggcaagagccugcuggcuucuauuuuuacucccucccagcagcuacuauugcucugugagaaccacagcuauuuccaaggggggaucgugugaaaaaaagauacccugauagccuuuguucuccggaaucuugucacuugucuccugguagcucuggagccuaggcuccacuguuuucuucacagcccaggaagucccaccaucccaucugguguagacauuucccacacuccucugagaaggaagcccagccuggagguuagucuggcuuccucuugccucuuguuuucuagggggugggggcagcuuccagucucccuuucccaaaggcucccagcagcucucuguugccaaugcgguguagccuggcuggucaaauuugagcuucgcagacagcagauuuucccagucuccccauugcccugucuuccagucuguuucugugcacacagaugucugaucacaggccugccuucuccagugauguuuauaaaaagacuuuauuucuagaaggagauuuagaagcaaaccaacaaaguauccaagccgucucaggaaacaggaucuucauuaauaagacuguaguacacccuccuccuagggcauucccugacuaugcuguuggaguuguaacccuugcaaacuagggguacagacagccaccccacuugugagauaaaagcaggaaaggaguuguucuccccaucuguggguagcauccuucccuguccccugcagaaacuccuuaugucuagcuucucuagagacagaacaaguccuggauagaauguucuuguuucuggagagacuacccauguuuggcagggguaccuuuaacauguguuguggggucaccaaugugaaggcugcucacacucugccccaccuccuccacaggcugcgggaucaccaucgggccaccaucaaggucaucaggcgcaugcaguacuuuguagccaagaagaaauuccaggugagaccauacccagcgcaguugaccccgagacgacuacaguaguaguaugcccucacccuuagaugccaucaugcugugacuguaccccuuagaccaucaccacuccccaagacagcaggcuccuccaaggguacuguacccagcccuggcccagggucccuuuaucgcucuauguugauuguuagaaguaacuuuaugggacuacuucuccuuccaugcaaggcugugauggugacagccuggcauugucaccaggacuggaagugacaucuguccuaagugacuuauguccucagcuagcuuggagcuuucuguauccuacccuaccaauacuggggccugauuagugaccagggcuccugcguuggcagagcugcugcugggguccauuuaguaucagcuguucugcugagaccccgaggguagcagguuguguuccuccucuauucugggacaguugugagcagaagucauggggaggaaagccuuauuccucacucugagaacaugucaguagaugcaguaagugcuggagagcauucucuuacuggaaagcccuugucacugagcagagaaggcuggggcaacccaccuuaguauauauagccugcccaaggacaaucucagugguggcccugugccuuguuauaggccacgccuaccauaccaggccaugagauuaacacuggcucccccuacccccucaucacaacccccaccccagcucuggggcagccaaaaccucuagacucugcaggagguagaggccaagguauaguccccaucccaaguugucaucauuguacugagaggagccuugggugacaugagucucacugucguccucagcuccucagcuguucuagcccuaagaacagccacagccccucccccugccaagccucugacacuaaagagaguagcauauagcuucucacccuagcuccucacugccacccuggagggacccuaugcccauccagcacauaacacaguggcacucugcuauaaaauuguuagccugcacccccuggaacugucacaacacaaauagaccaaguuaugcccaagcuuccacaaaccuagggacuucauguugucaaaaggaguaaaggucacacugagcaggggccagagccaagaagcaccuggaaauggauuagaaggguccaaaggccccacaaaaauuacacuuaaagcuguuucuccccccuaccuagaagccacgugaccuacagucccacugcugagacaccaagagagagauagggaguugaguaccuguagaaccagcucuucccaguuuggugaggaaccacaggaaccccauggggaguuauaucuugacaagacaaucucucaggggaaaaguggggcuagggugugacacucuuacuaggaagugguguagcuuauguugcuaguguuuaaagagucaugaggaauugcuaguugauggcgguccccaggcugagagaaauaggcuccgugggugauggaaaagguucuacaugaaacaguauaggaacugcucaguugaaugggguugcagcagguaggcucagggcucccugggguucacuuuuagacucuggguacccaguggaacacagggacccuuauggucccuuugagucagagucaucuuaguggccuacgcagacccaguuucuaugucacaaacaagggacauaguugguggcugaugaaaaagagacccggagcacuuugugucaggccucagaacauuagccaauguccuaagaguggcucaggaaacugccagaacaggccaaacugcuccugccuuccagcucgcugcuucucaccuauacacuuagcccagguggcagagaggccuuaugggguacagagaaaaguaggggugcuacagugagcuggcuuuauugcuggggacacaugggcaggugguggcaggccuccaggaaagagugaaguaguugaagagggauccccuguggggagggcuccacaggcuuccaggccacccuggugacccagcuuucuugccucagccauccacccuccugcucuccaaccgcuauacugaccugacuuuaggccugccugccugccugccuugcuggccgauaaagugcuuggccagcugcccuugugucuggccugaggugccagggccucuuagcucugaaaguuugccuugagcacccacguccacagccaaucagucuggacaggcagcguuaucuggcucaucucuggcucgugcugccaccaggggacauuggcccagggagaaagcuaagauugucucuuacaugagccuuaggcaaauauuugacaaaggcuccucaauccccaaccagacucuaaaggggagcuuaguggcuccaagacaagucucagcaggccuggagugcugcugaccacgggugguugguugauaggguaucucugauccuucuggguuuguuugauuguuuuguuuugugguuuuggauuuuuugagaccaaguuucucuguguagcucuggcuguccuggaacagacccuguagaccaggcuggccuugauuucagagauccacuugacucugccuccugggugcagggauuaaaagcaugcaccaccacuggucagcucucugauccuucuuaacuguuuccugcuuacagcccccugcccuccugcagccuggcagacucacuucuccccacuacauauucaacaaucacauguauguuugcagaggcuagcagagguacccauguucacuugggcacagaggcucucagacucucaggcuauccacagaccaacauaaggaucuguccugcuucuaauccaggccugcaccaccucaaacacauaguuucugccucccuugcucauucaccucaugugucaccaggcaugccuagaggugucacacaccuuagaaagcauuuucucccacaagucucuccccuauuacuuagggucacuuucagugugcccuuucaggaaggacucagacccuggacucagucaugaccaccuaugacugacaagguacugcaucaggauuccuugaccuuccucaucuagguccuauuuuauucucagucucucuuagaaguagcagcguagacuucagcaacccauuauccaggaaagaggaacaagauucaguguccuguuuuacagaagacagcgacaaggcucagaaacgcaucuuggagaagggaggaucagggcuuauaucuccaucuuacagaagagaguaagaccuggagauaucaucaaguguaguucuuaguagaaguucagagugauguauguacaagaccaaggaucugccuaaguauuaucccaagcuuggacucaguagucccuggauguguagaccacagaauauguggugacccuggugccuagaauggcccugagcauggcagguccuuccuucacgagagcugggcugucuuauggaaagucuuuguggcauugugagccaucuacaaccuguguuguuccaccuccccccucagagaagucuagggcccagaugaacuguggguaugcaggaccaugucuccagcccaugaggccaacucuucugaggaggccuggaaccaaaagggccaguaggagcuggcuaguccuaccagugaacugacagaagggaaaggcccagacaggcuaagccuuuggggaucaagccugcuacuauguauguucuaagccauuccucccuaucacugcaccccaccccaucacuguguugagaauugagcauacacgauucaggagaaaaugacacgugucuuucuggccugcagcaagcacggaagcccuacgacgugcgagaugucaucgagcaguacucccagggccaccugaaccuuauggugcgcauuaaagaacuacagagaaggugggcacagaaaggagaccucgccccagccucacagggaaggaaaagguucuuagugacaucucccucuagguuacccauccauccaugggucuuucugcuacuggguggagcuaaggauccugaccauucagagccaacauggucuugaauccuauuuccaucaaaguccccuggguccagcacagguauaggucuaggaggcuaguuucaugagcuagcuugcagaccuagcucuguauaucauggagugcagcugggagacugugacugucccuuccauacacaaggucaaagguucaggaccccacuuauccagagaggaagccuaaggagcccagauucugcuccucauuuuuaaacuuccugccuggaccucucaggagcaugagcacauagggucuugggugccucuuggcuggucuuggaguaacaguagcagaugccccuggagugggugucaugcuguccuccuggacacaauggccuaucucuguggugccucaggcauuguguaagcucauguuccucucuucucuccaggcuggaucaguccauugggaagccaucuuuguucauccccaucucagguggguguccacacugauaccuggagagagcaacccacaggggcucucuuucccaccccugucugucucuuaacuuccuuaccacaggucacuagggccuccuguguagaagcuagaaggaacauaccccaagcuaggaggagcaagucuggagccuagauacacucugucauuauaguaucuacccuucccccaaccccuggugucccagccacaaagaauuuuaaaggaagucuuguauuuucaagcauucaucccaccccacuccccagcuaccccuuccccaucuccugcucccuaggcuccugagcccacacccacagcccauaccccugacuuugugcuuuaccccauagaaaagagcaaagaccguggcaguaacaccaucggugcccgucugaacaggguggaagacaagguagguuccugcuucagcucugucagcuuuaauugccaccauccucggccagugcaguaucccaagugcccccgcuuagcuccacaccccucugaccuccuccgugaaguucuugagaaggagugugcacaguggcugggccaaaacacuucacaguugugugccugcaaagucagagaccugccuauuggcugcuucugccuggugucccaaggccuguggcccugccgcugcccugggaagguaggagugagauugcagagccagaugcacugaagucuuaaacaugaccuagcuuucccccuccacuccuuacccuuagagcucuaagagccuccuggcugugucuuagccaggagguggcugcagccagauucacacgggccuccccauaagccaauugucuaagguccuugcuuuggguaagccaaaccuucagaagaugcagaaccuggcugggguggauuccuggauggugucagcuucuacuuauccuggaccuggcuggugaggaagauccagcuugaguuagugugcuaggcuccucugucucugcccggccaggcuauuuuuaguauccacuacuguaggcucccauguacaguagagugcauacccuguagagugcuaccguuccgcauacucuggcugccgacaaucuuaugcuaucagaaugucacagcugguauuagcuaggcaaauaggcuccuccauugcccccuaccuucugugcccaccacccuaccuuucaugagccacuggaagcucuggaucauagggggacuuuucuugggcacaugguacaauccacugcuggucuucgaagucucugcgguuugaggugugcuguuaucuugccagacaacuugagucuguguacauggauuuuaucugaacauaacuaggaagcuaaaaauaguggaauuucaguugaguggugagugugguugcugcuggguugcucuagcaacauuugccucugacucucaauaugagcugcaacugggaagguaggcaaaagauagucuggcccacauaggauaaggcuuugaagacucccuacgcuuuguugacacaaaugccuacugucuccagugccagauaauuucuccaccacaaauuucuaccccauucuaacuguuccagcuuucuccuucugcucauuaccuauaguacaggcuaccccucaaacccagaccagaaaccuguuaucucuucuaagugacagaagaugauuguuaauagcuccuaaaaucaguguccccuuuccagacucaauauaugacugacuagcagcagucuaggguuuaagagcaggucacagcuuuauaugacuaagguggagcuuguacuggcccaggagcaggagcagggacaggggcagaaguacaugccaguacuucaucaggucaggacaacaaagggcugguuuuccagaguccaugguuucugggagcaaaguuuaggaacaaagcuaggccgauccucagagguccuggugaccuugacccugucugggcucugagccagguugucaagaaugcuggaauccugcagcaaacaccuaaugggcaccacucucacuuucacucccuaccucaagaugguuaagauggaggaguggguccucugccaaggccauggucacacugaaccaaggcuccucccagggcucuagccuggacccccacuguacaucaagaggcugucaagaugcacugacccaaacagcccauggcagccugcccagucccucccuuguccgggaccacugcccccuguggggacagacccugggaaagagcuuuguugggcccagagggcacgauggcauggccgggccccacguuaucacaguuaucaacguaaccaucgggaccagaaacaacccaagcgcaauccugcugaccuugggaaguaggggacaggaaaucccugggagcccagcagucccagagcagagccagugccagccagccuggcugagcccagccagagccccugggcuucccugcugacagccccucccucccaccccuccaggccagcuacagacuggccaaagucaagucuuuagugcccagcaacuugccuagcucagcuuagucccucagcugugaaguguaucccaccauagucugcccacaucacagggacugaaccccacuuacaaacaccuggaccccauggaaggagaggaucaagcuaaggaccaaagauauugagugugucuacuuguaagggauucuuaggggaggccagcugguuccugaccaggaguucccuaaggugccagccaggcuggcugagcccagccagaguucccuaaggugccagccaggaauucauaccagggagagcauacccauaggcucccuuccuguagccauuauacacucucagcuuuugucguagauuauggauuguuuuguucuagaaaucaggcagucuccugucacgcaguuaguuauacaaagagcugguccugauggcagucacagaugugaguaagagaagaacauuucagaagugugauaguccuuugguaaggaggcuagaaucaacucugagagccaaggcuggguggaggugguggccuuguccacuggcuauaguagucaggacuaguggcaauucaagaugguacaagccaccuugucaucccuguaauaggaaccccggaguucugguuccggcaccccucuucuguucccuggccugccucggcuucccuaugguucccugucucucugcagaacucccacccaccucuuacccgugguguucuuagaucuucuuggaccuggaccugcugcaguguuuauuuuacaagccaagcucacacugucgggcugauaugcagagcacaguggggccaagagacugacuuucuuguuuucugcaggaaauguuuguggcuugaagccggacacaggggcacucugguuuccagacccuguccacagggcaucugggggcagggagcauggguuggagggagaggccccagugcccagcauuucugccuaguucuguccuagaagccaggccaugcauacuuauuuccuguuagaggauaccacccagccuccaauaccugccuuucaggguccgcuucuauccaugaggcuuacaagcugcaccaugagaccuugucaucccaggccgaucccugggcccugcuccauccuugcucuccagcugaguauuugcuaagcccaggucuucauguucucugccuggggaauuauuacauagauaucacugcagacuucccgaccucaucucucacaucccacauaagucucaaaugcugcccaaauccaggugauccuacucugccaucuuugcugagucauggugucucacagguuaaguagugagguguucccacccauccuacauccuggaauacuuucugugagucucucucucucucucucucucucucucucucauuuguuagaauuucaaggcaaagccauccaggcugcaguuuccuccgugagaauacuuuuaacuacuaauuacagggucugagguucaugaacuacuagggcucuuuauuucuucuugugucaguuuugauaagcagcagagcugaggaguuuguacuuuuuaucuugguuuucaauuuguugcuguuuacuuggugucggcggcuucugucuuuugccccugcuccccauugucauuuaucaacgcuggccccauuucccacggcagcccagccugccaugcauucuccaguuuuacugcuauuuucaccaaacuuuuggcuuuguggaucuucccgccuguggguuuuuaucuugcuuauucuagucuguuuaucucucuuucuuucuaaucacuuggccuuaauauguuuucccucccucuaacuucuuaagcuagauaauuauuaaucuccagauuuucuagauuucgaagcccgugaagcuuuuuuuuuuuuuuuuuuuuuuugucuguaagcaucacuggaaaggcacaugccacuuucguugagccagaaucucacucaguagcucaguuuggccucaagguuguccugccuuagccuccuucgucacaggggugacaggcacagggcccugcaccaggcucccccacacuccggacaagggagcuuuacuuucgcuuucaucugcuuaugguguauuuuucuaaucuccaucaccucuuguuuauuccaagaguuaugccacggcagcauaacuaugugguuuucaucauuguuauuacugcgguagaacuuucuaguaacauugcuucacugucagagcaagugguccugggauaucaaccccuuggaauguuuugaaggauguuuuacagcaaaccaugcgcugagccuuuguaaggcgcccccgaguacuugaagcauauucggcagucacuggaugcagggcuguguuuacaagcaccagaacaagcuuguucauuguuucauucaaaucuucucuauccucgcuggaaucucuuuaucuauuugaucuaucauuuccucgaagucacagggugaauuucuguuuagcuuucuaggaaaacggcggcgagacucuuuucuaaaguuuuguuuuuguuuuguuuuguuuuugcccuuguuuucccaucagcaguguguaaacggcccacuuucucucagccuugcaaccaggcgguaugcuuggguuuucuauuucagcccuguuagugaguauguaaugguaucucauugugguuuugauuugcauuucccuaaugacuaaugauguugagcaacuuuucaugugcuuauuagccauucauagucuucucuggugaaauguuuauucaacucucuugcccguuuuccaauuagguacuccgcucuauugucgaguggcaggaguuuuuaauauguucuggguacaaguccuccaucagacguaugacuugcaaauacuuucuccuaaucuccggcugucuuuucauuuucugaauugucuuuuaaaucucagaaguuuuuaauuuuaaugaaguccaauuugucuuuuguaugguuccugcuuuugacgaucuucgaucucuuuccccuaucugaggucauaaacauuuucuuuuuuuauuuucauuuuuauuuuuuucuucuagaaauuguagagagugagcuuuuguauuuaggccuagauuuuugaggcaauuugagaguauucagugagaugagaucuaaguuuuuguuuacuuggcuuuguaugugugugugcuuguaugugugcagauacacauguguggggguguauauguguuuagagaccaaagaaacauuucaacaguuguuuuucagaaccauuuauuuuuugagaaaaguucucagauuaaccugcagcucaccaaguaugcuaggcuggcuggugaacgaacuccagggacccaccaguuucuucuuccccaacuccuggguuauaaauaugugccagcaaugccugacuuuuuuaugugagaucugggaacuaagcucugauccucaggcuugcacagcaaguaccuuaacaacugagcuaucuuccuagccucuuaaagguguauagcucaagggcuaagcaugguuggacaugccuuuaaucccagcacuugggaggcagaggcaagccuaugucugugaguucaaggccaaccuggucuauguggugacuaggucagucagggcuccauagugagaccuugucucaaacacuaaaaauaaaagcaaacaaaagaagauguaggccaagcccaggcugaccucugacugguaucuaauagucuucaauaucugccuacccgcaaguaccacacaaacagcugcuuuuucauucacucgcacagcaccauuagucaaaaaaaaaaaagaucuuuuauuuggucaaacagcaaaggcaucuuucuuaggaacuaauuaacuaagccaagcauggugaugcacacuuuuaaucccuguacuugggaaacuaaugcagaagagucaggaguucaaaaccagacucaagcauauacaaaguuuaaagucagccugggcuaccucaaaaaaaaaaaaaauccauuuaccauaaauguauggguuucuuuguggaccuucauucccguucucuugguccauaugcuccauggucucuugauuaucggaucuuuacaguaaguuuugaaauugaguagugaaaauauucugauuuuuuuucuccuacccuggucugauaccuagauauuuucaucugaauuuuuagaugaacuuguauuuuuuuuuucuuuaaaagagaaauuggggguagaaaaggcaggcagguaggguggugggcuucugggauuuucuguugaaucuauggauccauuuggguaaacagacaucuuagaccaugaauaugcuaucucuguuuuacuuccuccaguucuugggaggugagguuaugacaagguuuguuuuuguuuuuuuuuuccucuguagcucaggcuagccuggaacuaguuagcuauacugugaaauuaaaaauccaccugccucagccaaagucugggauuagaaauuuugauaauuuuuuuguaguuuguguacauuuuguguauuguuguuguuguuguuaacuucacuucuguuuuauucaccauacaacugcuaaugggauuaguuuuuuuuguuuuuuguuuuuugguuuuuuuucuuaauuucacuuugggauuguauguuacuggagcuagaaacucaaucuuuggccggucugggaaaguccaaacuugcuauucuuagucuucauguuuuguucuugcuguugauucuguuagauuuuccacuccugcuacagauaaugaaggcaaacuuacuucuuccccuccggucccaaugccuuucauuuccuuccuucccuccuuccugcucucgccgccuucccaccacccuugcccuagcuugaacgucaguaauauguaggaaugacuagagacucuccugggagaaggccuccugucaccugucauuaaggaugaggauggcuuuggaguucucaucaaugcucccugugaguucaggauguucuccuaugcugagugcacuaagagcugagcaaaaguaaaugugcauuuuccccagcuguccuuucugagucuaucaaggugaccaugugauauuuaaccccuuauucuauuaauacaguaugauauaguaacuaauuuugggggugcuaaauuaaucucacguuccugggauacaccccauuuggucaugguagaugaaggauuuuuuuuuuuuaauuuugcagggcucggguuguuauacugugguaagaacauuacuauuuauguauauaaagauauauauauacacacacacauacauacacacacacacaauacaauacacacauacaaugagagggggaacuagggguuaauacagagucuccuuauauagucuaucccaggcuggccuggaacuuacuguguaacccaagcugaucucaaacucacuaugauccuccugauuuugccccccacauacugagauuccaggaccaccaugccuggcuuguaucuauagucauaaaggauauuguacuuuguguucuuuauguguguguguaucugucugucugucugucugucugucugucucugucucucucucucucugugucugucucugucugucugucugucucucucucucuuucucucucucucucucucuguguauguguguguguguugugcauauguggguuuuaaaaauacaaucagcaguuuuaucuacuucuuucucacacccgcugccuugucugaggugccugauuucauucccucuccuguugcuacacauaugggcauacauccagccuggccuuucaguccuagacucggagauuuuccagaccacucagaugauaagaguuugagcucuaaucagagcuguaacuagcuugaggauguaacuucccagggcaaaaacuguucccuuccucuuaacaguuaaagccaucuugacagucuucucagggagugggcuaauuuuguugacuuucccauugagcuauuugaaggucugagcuugcugacaguuucugccuugagacucccagguucuaauggccagagucacuaggaagauuguagaaucuaaagcucguggugcauagcugccuuugggaagcucuuaccucagucucuaguguuccuacugucugcucagcuccuggcugcuaaacauggauauuuucuuuucaaauagcugcccuaaaaaguaauaugguaaaauuaaagucacagucauuuauuucauuuaauuccagaaaccccaaauacuaugacuucaauauaauuaauacagaaacuauuaaaacgguugcuucucuucccuuauuccgaguccucagaagccagaugaauuuuguacacauggcccaucucaauuugaaagcuggguuuucaugagagcuucugggacuguauuaagacuucauaaaauuuacaacuuggaaaggacauuuggggcgguugucuuuguuuuuaagacuagauuuugcucugcaauccaggcugaccuagaacucacguuguagcccaagcuagccuguaaccuacuguguagcuaagacuggcuuuaaaacuacagugauucccuugcuucaguuucccagaugcuuggauuaugggcacugagcuaccacacccagucuaagaaaguagauucuuuagauuuccuuaaaacucaguuaaggaucuauguguaauucaauuuaaauuuauuaaaauuaggucauuaaaacccagugcuucugaagauaauaugggguaagggcuaagcuguuggacaugcuguuucauaugacuuaacaggaagaccagaagcucugugaacaccagcaggagagugggaaggccaaguggagauggcauggaggggaagagggacgagaggcagccucuaaacucccaucuauccaggaaagcauccuuauaagacuucccugggcuaccucuccaaagccuccuccccaguccauggcccacccucuccaagucccagagaaccauaaccuggaacccacaggccauacuccaggcuaauuugccagccgccauuaagagccuugcuaccugcacgggcugguuacauuagaaaguggggcggccuaggacacagcacagcccuaccucccccacugaguucuccuucuuacuuguuccccagccccacuccaacaccccucuuugccuugcugcugggcuacucuugagugacagggccguaaacaggcaaaggcauggggcuccagacgaucaaagagcucccuucagaagccggcauucguuugcuauucugggaacugguuauuuuaagguucguguauuuuuucuuuccugaggagccgucuuaguggauggugaaguccugaggugcugguccuuuagucaaaccacacaagcccuguuuugucuaggguuucaaagauaaaccuauaaugaaagcaccauuugacacagcgccccaccaccccagucccgggcgggagugggcauggcuucuggggagucccugugcccagcuaacacucugagggaggccacucaugaagagaaccugaaaucccagugcuggaccaaaggagccaggccugcguccuguuagccacuccauucugccuucaggcuacccccggaguuugagaaggguccuugcaaaagaccccaguaaagcuauagggaagugucugcugcuaaccucucccagaaggaagucaccaugucagaaaaugaccacagccacaauggguagcauagugugagucacgggcuuccugucuuuuuuuaguggagcagguugccuucagccacaggcucaguagaaaagcuuagggaagucugugagaacuggauacccauguaccuuuucagccuauagcuugaggagaaguaccagguccagcagagggcuggauguauaagggcacuguugacuguuagguugcaaccuugagaaacuaugggagaagaggaacuggucacacugaacucuuccugacacagcucucugcagcacuauggccagcucgacauaguauguggcucuguagggauguugcugguaccccaggcagaccuggggugcauagcuagaggccucauagcccuucucuucccagaugacuguggcauagcaaaccauaagcagacuaucagggcaguagauggcucucauuuugcucaagcaggagacgcacaugccuaguggccucugggcacuucucccuggacuggcauuggaaggaaagcuaugucugacucccaagaguugccucagaaacaagguagcugcaaucuccagcugguuuccuugccccgguccucuaaccaucugacugcagucugccaugguuccaggacucucccagccugacaacuugcaugcuaggcacucucugcccccgcucuucccaacaauaacagucagcaugaaaauggccuuauacccugccuaucuugacagcaagucucagagcccauuucagcccaugacagucuuuugaggggauaggauucuucucucucauccauaugacaagaacagcaucuggaccucaaaaacuacagauagauauggggccuggauggcucucucugucuuuagcaacccccacuguccucauugagccuaaguuuucuucucuauccaaggcagagaggauacuuuguaucaguuaccauuaauuuggagaaauuaaaagcauguguccuccagggucuucugucuggccugauccgggggucauuccccugugggagaaccacacugguuugcuguagacagaaucucagugcucaucucaagccuguauuaggcucacccagccccugagccccaugccaagggucauccuaguuccuuuacuugaaugcugcaucuguguucuguccaccgugcacacaggcauaccacaaacccugcaccaucguugccugccugugucacgcaucccauaaccugaaccuccuucaaugccuuuggagccagccucuaggcugcaagcucugcugccgcugacacucagcgcugauagaggauccccaggcaggccagaggcccauuauaugcaagggccuuguggcaugggcaguacugugugaauauucgagagccaagcggcccaggugugaccacugagcugauaacugaccaccaagcucacaaugugagcaugagaaagugaggagcaacuggcuccgucccaaccucuucugcaucccugagcaguccucccaaaucugggucucaguuucccccacugugacagugaccaguccucagcagcccccaccccaaagucauccuuucccuccauacuccuuucuccugggaugguucucucccugucugugugggagacacuuccccgcccuacaccagcucuccugagugacucuauuuauaggccucaaauauuggcuggagaggaaauuuacauuuuuugaaaauuuagcucaagcccgugucaacuucugugggugugacugcuucugagaggcagggagacgggcaggcagcagacagaggcacaugugucagccugcagcagacgaaggccccaggccucaacagggcuguugggugaucuguaaucaguagcuucuguaaagggaggcaguggguaccguccacaggggauggggcgugaggguggugugaaccuguguccguguggccggcccugccuggccuccuuggccaaccucagaaaaacauguauuuuggucaaaaugagccucuuuuuaaacuugucacccuagcuugccccagcucugcauauuaagcagcaguuuggucaccaccaaaaauagaucuuccaaccuagagccaucccucccucccuaggaaaggaccagccuagaaaggggcagccagccgugccuggcccuggccuugucccugguagcuccggaaaccaugggcugguuaaagcaggcaguggacagagcggggauagcaggcaugaggcgcacuuaggggcaccccucaggguacacagagaccauugagaacaccugguauagcaaaugacagccagggccaugucaugaauggugucacagugggccucucuugauggggaaagccuucucagucccaauguggcauguagcucacauaaccccuacugaauggcagguguauccaguagguccuugccagugaaaccugcuaauguagcaagcaccuucuccacgcucacccacggaaggccugcggugcaggugggaccuggccuggccugcagggccucaucuacaaaauggcugacucugccuuucagcuggggccgcaagcacagggaaucgcugcgcacacggaggccuguuugcuuugcugagggaacggccuuuccuugccuggguuccaagggcuccagaagcagauggaaauuuuuguggauuaaaugcugggcugaggcacgcugggcuguuuggguuggcagcaugcugccuccccgcccgcuccucauccgcuguuucccguccucggcguauccauucaugccuccgcuccugggucucccuccuccacugcucuguaucccuucccucuccuauggccucgagggauaacuccacuggcccagaacagggaaggccgaggcccuccacggcagcuccuugcagggacccuaagcuaaagguacccuucaccuccagaucuccaucugugaaauagcaaccugaauuugagccaggugaggcagugugccuguggucuaguacccagaaagcaccgggacacgaugaggcugucacacuggcuacugugcucccaagaaaacaaaagucccaggcugauguggggagcgccacaccuuucuccugcaccgaagcuucuuccaagaagaucugggcuuuugcaaagggguucugagggagggcaggucugucagggagccagaggggcaaagggcucuggggacaaaagguacagugcaugccugucauguugccccacagcaaaagauggguuaagaggagcagaaacuggaacaaauagugaguguggcugugcacccuggagccauugaagguuccccucugaggagucugagagacagggcuuaggugcgcagcaccccaaugcgauguucagcaagcccauuugauguguuccuaugagcugcagagggugaggcccacguguauccucucuacucacugccccaccucugucucccaccucaccccauagccaaggacacagguugguuacugugcacagcgcccccucuguucccaggcagccaggagccacaagucaggucuggagcauaaagagacaucuguguaggcauugagguggccagcugccggcugcccgcacagagauacuauauccagcccagcggacgucccaucagaccaccggcacccacccucaagggguggggcuucugagaaaggugugagguccuggccuagggccuagguagccuaugucacugggucacucuuggcugccugugugggaauagugagaggcccacagcuacagugggaggaaaggggucagccuaccagcaccauguaaaacaugucuggguaugcccaacaagcccacagacuugguuuacaugucuaugaaaaccccucuggcuacaacgggccaccuccaacaacccagguggacagguaccaccugaucgugugggguguuucuuccucagagcccacagaacccucuaaaaugcagccuuucuagccaagacagaggggcagagggcccaggaaagcaugcaggaaaccucugcgcacugcaugagcucauucaguuggccggucaccucccacccauugauaccagccccauagccagugcuaccacuuagaguagagugggcuggcucuugaccuuggaacacacaguccauuggcagaggaggggacacccauagugaccuguaauuacauauuucccaugguggagaggagaaaguauugaagcaggguuucccuagucaggaagucaggaaccagaagccaaaaagaagagggccagguggaaggccagagaggccaggaacguaucuugugagcagccuguauuaaggcccuggggcguaaaggcugugcuccucuaagucaaagaaaacagcaagauagaaccuagccaacaagggauaaaccggccagcuaugucccaggagaguccucaggggagaccccagagaacuaugaggggcugcuaugggguuagguggaccagucccgcagacugcuggccccuuccaagacuggauaggcagauagaggauagagaguaucaagagccccaagccuuggagguaggcagcuggaccuccgaugucuggagcuuagguggaaaggaaugaagagucagugcaagguugagaggcaagaagguuacaaagccauagcuaaggccuaagaaacaggcuuuaccugcuccucagaggggcaggaagaggaggcuggcccugccucaggcuggugcucccaaguccaauccagagcugaacucggggcuuacuccaaggaaaaggcgaaccauguuugugagaaucuaaagggaacagaauccaggcaucaaguuuccagagcaaaugacucugggacucacuguuccuaggaagaagacaaagucugacaggaugaggaacaaagcaggcucaucucccaguagugacuggaccauagaaggaaggccaggugaccaguggccgccauagcucuucuaucccccccuuuuucaaucccacucuuugugguggguagagagucaggaaaguguauggaauacauauaaggcaugaccccaaggccucugaugcaaggucaguggggagaagggcaagggacccaggaccccucuugguaaagagcauccacuuucuccuuuguaccuauaacccugcauacauccacagaccccaggcacucacagucaauaugcauacuucaauggcuguaggagagaaagaugugacccaaauccagugccaauucagaaucccccaccuugauaauagcugagggcauaggcagcccuucuccccugggccuugcuuucccuaccuuuccuccuugcuacuugggugugauaaggaugacgugagcuaccuacagcuagggcauaauggcuggguucacagagugggcccuguuccccuccugugcuucagguccuccuguggucuucugucccugacaaggccccuggugggccacgcuauccaucuuaguuuuccucuuuguuaaucucuccucuuguugugacaaaguucuuagcagaagcagcuuaagggaaucguuuauuuuggcucacgguuugaagagauggagucuagcauggcugcaggagucugaggcagcuagucacagaacauccacaauuagggugcagagaggugaaugcgggggcucagcuugcugccucauuuuuauucaguccaagacuccagcccaugggcuaggacuguccacauucaggaugggucuccccugaaacauucuggagacacugucacagaugcacacagagguguuuccaaaucccaucaaauugacagucagaauuaacuaucacauacuuguugcccucaaauuggaaucauggaccugaaucauccccugggcacuaugacccaggaugucacccaauugucaccaguugucacccaguuauagaacaaguccagaaguaauagcaacuugcaggugccagcaagcgcccaucccccaauuuaaccuggcucccagccugaugagaaagaagaagaaaacuaacauaaucuuccuacucuccacccaccaggguucaccaagguuuuguaaugauccccagaacacacuauuugacccuaauucugcaggauucaaauauucaauuguuacaaugacuuuaccacucaagccucagaaacuacccagugcucacagccaugagcaggagaaaauaucccucugcuauauaguggcaaugcacccaucuucugucaguuggugaagaagcccaugagccucuaguccuauccucucucccagcuuccuuccccagugacaggguggguagggaagggaggcuagauagaggcccggggcaauaagccucugcugucucagguccuagagcuacaacagagcauccaauccuucugugcuguucugagugccuccauaaacacaaaggaucuacaauccucaucccaagaagugacugacacucaugaagccauagcuuucugguucaggauggucuuuuguaccuugcacugaaaugcaaacguagaugcuaagauacaggugauggcucaaguaccaccuaaagcuauuauucuuucaaaacagaagaccagcauagccaugguggccacagccuggaagaggcuuuucucaugauaaauagccaggccaaguccauguuggcucuuagaucccuguucuuccucaaaagcuugauggaacagagacccaucucuggcucugaacuaaaagcgcaagauggugugggacacagcccacugauugcccccccauccucucccagguguucccagccccucugcuucucgggcuuuugaacuagcaccuggcaaggccaaagccaguccuccuccauccuggcuugcucauuaauguauauacuaacaaagggcaaugucuucacucagccuggucugguguccucuuugccagucccucaggaugcaugcucuccaccucagagcuggauccugcaauaguauuaucccacugaagcacaagcugggaagccagggaggugccauggacuucacucacaggaagagcaagacuguaggcccuucuucccuguaguggcugcugagguccuuccuugcccucacaugagcccccauugcugugcaugccgccaccugacagauguggcggugacaaaacgauggggccgggaaacguuggcccuucggugcugaugaaggcagccuuuaucccagccguaaaugguuucuguguggaguggaacugcgccugucccgggccuaaccccucaagggccggagaggcgaaauuggauccguggggagagauuuuacagcauaggggcugguggcaagugguggcagaccguccccacggggccacaauggggcauuguucccagccucaccugggcugucuccagcaucccaggauuuacgagguucagccgcagccucaggccggcugcucugggcugacugggggguagggggguugcaguaaggaagaggacagugcccagcccccagcccucuagugacagccagccagggacaggccauaacgugucuacagaccacagcgggccacuccaugaauggguccucuuucucccguagccccacagugcccaggagggcugggaagcaaaaggcugagccaguuucuucagcccaccuucucagggcuccugccuuacagaggucugggccaagcagccuccuagacccccaaggauuucccuagcacccauguccacacaggcagaaccucuucuaagcugcccaccaugguccacccugacuuaggagucuguaggacuuccuauaagcauccuucccuccaugucuguucucugucuuuaugaaggguacacauggcccuuggcacugguagccuggcccaacuccuuucucugagugcagcuuccugugugccuguagaaauuucuuacagccucucacccuugcucauacugcccuuuccucccagcaggccugcuucaccuagccuccagcccccagccauagggccaguucuuagcaggcagcuggucuccuguggaugcaccuuccagucauuuugcauggucugggcugauggagaucaagggaugaccuguagggugcccugugggcaaacagaacucucgccaagcaucucagucccccuugccccacagucaugggacagcauuaggucagaguuaggauguaucuccugccugaaagcgaucucuucucccccugaauguccccaccuacagucuccagccuuggccaguaugcagugugugcagaggggcggaccaucauaccuggcuucccugcuacccugaucuucuuagaucccuucuuuguagauaauaauagagagagugcauugcgggcgguccauccuccugcuugucaccagcucauggcccacaacccaaccugggaacacacccuggaaaucaccaccagucugagagucauucuccccaaagucuuccucaggguaccuggcugucugcauggguucccucacuagguucacccuaaaaauagccacacagagguuugugguggccauggaccuuuuuagaccaauuuauugcuaaggacaaaauuaugcuugaguucccugaaaaaagggggggggcacucuccucauuaacauaauugcaaacagaacgaaucuuucuugauuucauguaaacaauggauugaaaugguuuguaauccuugcagguaucaaauuaaguucuuacuuauggucuggaaauuaauuacccuugcagcgagauaaaugugaaaacuguguaauuuugacaagaaaaugaagcagcuauuggggaaaauguaacuuaaucguugcagagaaaauuguuuguaaauuggucgaguuguuugaacucucgccucuaugcugugggcaggguugauuugugugcgccccuuugccuaauuugggacaagagaaggggucgaagauggcagaaacaaggcaggaaagggagggguguugagagaagguaccaugugcagaagguaugagcagcggcaaacuggguacaggugaucagcaacguguacccaacagaggacaucuaaaaucuacagagacagaagagcaaaggcccugggacaggugggacagaaagaaagccagcaccucugcauucaagugagagaagagcugugcaagggacccugcucuuaaugauggcaguggagcucugccuggggaggggaggcugucccgacguacucuaaaguggcaugauaugugguacgucuguacauuugaaagcauuguguguguuucugcaugugcaaggaugguguguguuuauacauaugaagguguggcgugucuguaaauaugaggauguugcauauaacgugcuuacacucgugagggugguggguauuugcauauauguaagugugugucugguauguuugguuggguguuucuguguauuaugugguguguuuguaaguauguaggugaagguuuguccuuaggaccuguggugugggugagaacccacucacuaugagcuugugaugugcuggauacugauguucuaaguaagguuuucucugguuuuaaccguauaaccuccaccucagucuucucaagaauagaccaucaaagcuacagucagaugccucauucauuuuugccaaguagaagugagugccugcuugagagcagugcucaggccaggggcagcggacaugaggaguauguuuccugggucuuuguccugaacuucaagaguuccacaccuggugauaaguucuguguucaucuguguaacccuauuuugaaggugaagagcuggagcccagguagauuaggucagcuauccaagaguggccuaagucuagggccagcagagccaucccauccaggaaugggaucuucaggguguccuuccaagagauacugcccaucugaccacucaccucagacucuguuauacugagacuuaccaggcuuucuacugacccuccacuagccuucugucuuugggaugucugucuauccacagcaagcccugggguuccuucucuuucuuugaaaaagaaucugguguuuucuggagaagagaggguaucaggggaagcgauggggcucucaguguggggucuacuuuucacaccacugugacaaaaugcuuuaugaaagagaaccucauagaaauauuuuauuuuuagcuaauguuuaaggaggaguacaguccacucugauggaggugguggcgaugacguauagaugcccgagauagcuggccacguugcaucucaagucaggaaucgggaagcaaugaaugcugggacuccucucacuuuuuuauucagucugggaucccagcccauggauagugcugcccacauuuaugguugaucuuccuuguuaacuuaaaccucucuggaauguccuccuggucauggcuugaaguauaucucuuaggugguccaaauauagccaugucaacaauaaaaaaagaaucaucaaggcuaaauaccugagcauguggcuuaccucagcaggagucaaugcccccugagcaggaucuguggcccuccacccggcacccaagggaguucaggacccacugucucagucgaggauguauaaggauugccuaggaauaggaaccaguuacagcccuuggccuuaguuuccugucaucuccuaagucccuuaccugccugagagucacucacuacuaacucuccaugagaucacaggcagcccagcauccuggaagcuucuguuuucucaucuaugaaauguauagaagagaagcgagccuccagaguaacccugcucuggcaugaagaggggcucucuaccaucacugcuacacaggaaguucagcugaggaccauucucuucugccugagucucauagacccaucugagcuucauaguauacuagguauuggaggauacagccagcaggaggaugagccuggcccuggcuucagagcuauccuugucucuaucccuguccucagccagugggacuucccagauccuguuagugucaagaucaucucaaaggggaccuagaagauggcauccuuaaguggaaaaaauaccuuuauggaccaccucauauauguuaaacccacaaggaaccugccacagcaugaacccccuuggucuugcuacacuuuccuugaauucuacucuuugggguugguggcccucacaaccacccuggcucucagauaccauuacaaugccccagguucuucaagacauggauauaacacaaaguaggcuggugacaaacaccuuaaaaugcauauucccuggcuaccccucaggcuauuguuuggggucacagagaaguggaguagccaccaccuacuuucaaccaucacccuaguaucccaggauccacauccaucccacagcauaucauaacaagaggauagauacauuauccccuggauuccucaaggcugacccccccccgaccccccagcccuagccucaaguucucacauaauggaaccuuaagcagaaaguagacccacaaggguuccuggucaaauuguagcaugagggguagccagcugcccaucagugugaccuccuguaagaccagagccugggaaaagucaccuguguaaagcagcucugccaggcagcuauguuccccuauggaacacacuagcagacuagccuuagccagaauacugucacauaacuauccccaguaaagaagcagagugcucaaaugaggauuuccugaggggccaaggcaaugugggcacaaacagaauauccugggcagagaaaagaacuggaaaccuuaaagauaggcaaggagauaugaugaugucuaugguauaaauaaauaaauaaauagauagauagauagauagauagauagauagauaaauagauaaauagauaaauagauaaauaaaaugagguuuccucugugcuacagaguucugcagacaucagagaacacaucuaugucucuagguuguggaggggguguucauaugaagccaugguaccccaccuuguuccuacagguucuggcaagcuguggggacauaggacuuaagagaugcccgccaggccucagggacacaggauuaggccuguaccccucuaccaacccccuuccugcugccugccccagccugcccauccaagccugcccccugcgugcccggagcuacugcuugcccagacuugcccacaaauuccuagggcccucuuucuucccaacauucccugcuccucucccagccucucuccuccccacucaucuccuauucagucccagaaucucccaccugcuacccgugagaaucucagaaucagcucucguauucagagcccuacugcagccauuggcugcaguaccucggaucaccuacccccaucugucccacucaaaccugcccacagccucaagggaaagacagggcuuugagaggucaagaccaaggagaaugaugaaccacucaaggcagggacaagugugcccugaauagagacagaaccugaauccaucugcauccuaaguagaaguacuauggcugucauucauucucugugguggcugcuggcugauaaguagguacaagggacaaaaauguuuacagggacaagaauaaccaccacucagcagagacaauuggcagcuuucuguuggcuaugcaaaugcccugaacacauuggcaggcacggaucuccgagaaccucgcaguuuggaucaccuguaguauuauuuuacaggagggaagccgaggcacuaaucauuuuacacccguggcccugucaucuguagauccugcuuaugcuggaacugggacuuuaacuuuuucccuaaacaaucaguguuguuaggaccacacuaguuugugcuauugcuucucugccccaggaguuugugggcaaguguaggcaaguuuggugacgguagaugacugaugcaaggugaacaguucccacagaccuugggcuccuagggucacagacagcugcugggacuuuggcacuaacuagaauagcccccucauuauuauuccuccuaacugcuuucaucuuucugggcuacucuguugucucaggagccagccaaggggccacgggugguuauguggaugcggccaugauaaguauguggcucugcucuggccugcagcuuccuaccuucaucucacgaaguuccauuucccagacuauuucccagauuggcugacugcagcaggcaugcuggcaccauuugggcauauuugcccagacagccugaguugagaucagccccugcuuugacaagcuauuaacagcagauggacaugcccacuggucucagaaggucaggcugagucugauugauagcuuggacugacagcuggaagcaggccuuugucucuaaaggagaaugaguucacagaugcuaggggcugucacagaguucccuccagccucggccuggcuagcagagcaaagaggcccucucugcugacuaggcuguaccagacagcaagccaugauggagaagggccauccuuaguauguaaagacuccaaaucuauggaaaccuauagugagaaggcccaagauugaagaaauacaucucaucucaucuaucuacugaaaaaagggccaggaaaacacaguucacgggcuugauccagccuaacaccugucuuuguaaguaaaguuuuauuagaacagagucacauucacucacagauaugcaagcuuuagcaguugacauguugcaaugauagguuugauaauucucaacuuauagcuuggcugucugagaaugugagcaugauacguuaguaagagcuguacucuguguguguguguguuugugccugucuguguguuugugccuaugugucugagcaugcacacaucugugucugugcauuaugugugcacuuauguguguauguacauguauauauguguguaugugcauauguauauugugugugcauauguguaaauguguguguacauggucauuguacuuuagauuuugaagcuggaucuuccugagcuaguuauucaguucucucuuuaggugccaggcagcuucaggagcaguuucucuucaguccccugccuuccagggugaaccucagacccucuaaaauaugcugcagcuaagcuaugaugucaugggucuggcggacucggugcauuuccagcauacuuaugcuuuucagacuggaucccaccaucaaaguaagagcgcugggcuugcccagcgaucauguggcccacaacagagcuucacauguuugcucugucugcaaaggaacaaaaaaacacugugaugaagacacugaggcugcaggggacaaugagccuagccuguuucccauauugcaaggauaaaacauguccaagguacagaucaucccuccccuaacucugugaccccuguccaggacucugucuccaagcagaguugcucagggaguuguaugcaagcaaguuaauggcagucuugcuuaucacagagagggguuagaaagagacuccaagucuucgauggccaaugguugguuguguuacaccuaguaugcuugcagguauccuucagugaccaugggaaauacuuaaguacagaacuauagcagggaaggcaagucccacauuggccugugugugcauacuauggcacuuuguaaauggcguccaacugcacaugccauuacuucuguuuuacccaaucuccaucaugagugucuuacuuuguaaacaacaaaugcggaauaagaaaaagaggaagaagcaaagcaagguggucuuggaggcuccugcugaggaccacucaaccuuuagauucagccacauuugaauuuauugcugcucucuggauuguccagggcuaccucaggcuacugucaaaaguugaaccucccuguuagcagcauggggaaggguggaugacucucagcaggagaccagccugccuaugacccucuugucugucccacacuuguugcaccagaugaacuugccacucugcccauuggccaucaaaguuaucaacaucuagggacacagccccuggcucacucugagcucacccuucucaauccauucagcccucaacucauguauucccccaacaucucccuaagugguaucuucucguuuccucuucggagucucugauguaccagggcucugcccuugauuaugcuaaggcucagaucaccuaccuguuggcguucucuucgucuguaccuguucugaagcagagccuacaucugauacccucauucucuuguaucuuagaguugauauucucccagcauggugauggcccuaacccucaggccuccagucucuaaccaaccuguuauagauagauguacaaggaggagggggccuaugguugcaaagcaagggagguggcagagauaggcaggaucccaaguugaacgcagcccucucugcaggccccccagcucccacccagcuccacagcccugccgucaccacacagagccaaugccgagacucucggcuccuccccaaggcgccagaguuuccuugucacaaaauguaguaaaugggacgauuaaggggggccacuucuaaauugcugcuuuaacccauuuggaagucugcuaauuauucucuugaggaaagaaaugcagguucauuauuuuaaugagcuuugggcaaaauauuucaucgaguuugacaagccgcugcgacuccuucagaaaggggcucgucucugaaaggccucucacccuacuuagagcuaauuggccuggggucuuccgccccggugcuguguguaugcuauuuuaauucauuuaugaaaagcccccgcuuugauguccaggaccagauaaggacgggagaggacggccagcuaacgaauaggccugugcacccggccagccgugcggggccuccucggccgcucugcucugggcccgaggccaaggcgaugucaugaaauaacuguacaaacaguccugccuaaaaaauaugcuuuuguuucacuaauaaaucucuccuuggaacauuccccacaggcccagggcucuccucagccuagcagccagccuucccgcucaauguguguccccagauccaccccagggacgcacgcauacaugugcauacacacaggcucaguggcaggcaugacacaggccagggagugcucugcccuccccucccuuacccgcugcugagccuccuacuccaggccaugccccagcccccuuuuaccuccagcugccccuccucccccucacuuccucccacucucuccagaacucucucuccccucucuccaucuaucauacuuucuccacagcccaccacuccugcccaccccauuccuggcccccugagacccucuuuuggaaagcaaagccugaagccagcaaaccgugguaccucccaucucugaggcucucugccuccccuugccuacucuuccucagugugacuuucuugucuggaggccuaagggaugaauguugguacugcuggcuagagcacagagggaccuggguggugacccuaaggugacagacuagccagcuugccucagccaccauucuggcugaaaugucacacuuggucccuucuccauacggugagaucugcuggcaauguggguagcuugagcuuagguacugccggggccuggcaucucuccaagcuucccuacccccuccuggcucucugcccuuaucucaggagcaucccuuccccauggcccuccuacuagccaccacccacuaggauucccccuuucuccccacccccucaccugccccugaucuaguuccacaucuugaggccccaucuguccucaucccaugccccugccucagugcagccccuaacaguggcuaggacagaguuacagaaaagagggccaaguuuggagcccccaugagucccuuggcaucucaauucccucaucuagaagaagauaagaacacuuccuccaggcucaugggcuacauuaccuggaaccuucccugcugagcaccuggcccagugcccggcacguggcaaguggaagcaccugcuuccgccuccucuuaugggcaccacuacgggcacugucaggcuugguucucccugcccacugccaaguaccacacugaggcuagaggcuggcugcuugggcauugagggagaaucccaggcugcccacgguccacuccuuccuucccacaguccccacugaagccccugcuaugucccagacagcagacaguguuggaggugccgcagggacaggacagagcuccuggcacuacgaagcggccccuggucgaaaauacaccacguaauuacagacugggaaaauuaccaugcagagacagagcagggcacugugccgggaggagccaggguggucagggaagaccucugagggaggggcguccaaaaauagugagcugaggugcuauuaauaggccucagugcaaagccaaacagagaagaaagcaaaagaggacacagaucuucacagguaucuguuauucaugucaaaaguagagggggaugggugauugacagacacauacauacauacauacgugaaugauagauaaaugaauacuuagaugaugauaauaaaaauagaguauugauaguugauagaugauauauggagauuuuguucuuucaaauucuagcaguagagcaagaucuuaauaaaaaaaaaaagugaagauucucaugauccucucuuuuuccuaaagaugauccuuguuuuuccagaaagauccaucuucagcaugaaagaaacagcauuucugguaauucuccacauauggcacagaaaauaaugcauagucagacaggugaauggauggauauuugcauuuguaaagagcuggaggauugagaggugaguggguggauacaugacagguaugugaaaaggugggugaaugagcauguacaugugugagggugugguugacugagugagaagacaggcugaaggaugaauagauggauggguggguggauaaauagauggguggauggauaaauggaugaauggaucagugagcagauggauugguggaggaaugaguggguauauaggaugaaugguaaaggagauggauggauagaugggaggagagauggauagauggaugaguggguguaugaguugaugaaugaaugcauacauguauaaguacaaagauggaugaaggaauaaaggacagggcagguggacagauggacagauggauauaugagguauggauaaagggacacauaccaucaagaacuaucuuaggcuugguuucauaacuuuugaaucaauuuuuuaaaaagaaaauuagaagugaaguggaagaaaugaugaguucacauaaacauaucuuuaucaacagaaaaaugucacucccagguuaugagggaaaacuguaagauaugggaaaugggacucacugugggguuacacucuuagccuuccaugauugccagcucuacuguggccaaaggcuauccuccuauccucaguucugaggcccuguuucucauugccaucucucucaauucuaugcaaagcuggaggcaggcucaaguucaucacaauccacugaacagauguauucccuucgguucuuuguguuuggggguguuuguuuguuuuaggggguugugacuuuugguaugugcaugugugugucugucugauugugcauguaugugcauguucauggaguguuucguguguguuuguggguauggaugcauauaugcauguguuuagggaggccauaugacaacuuggauaucauuucuuggcagcuuaguuuuugagacagggucucuuauuggucuggaaugcaccaaaaaggcuagguuagcuagccagcaaaccauagggauccuccugucuccuccuagccaguguuggaguaacagcugcaugccaucauucccuauuguguucacacagguacugggacuaaaacucagggccucauacuuucacagcaagcacuuuacauaucguugucuccacaauuuuuacuuugguuuugacuuaacuccuaaugggacagaguucuuccucaauuacccuuccaaaagaccccuuaguucuugccugcugcccacuguccacucccuucacucuuucagcuuacuauuuuaauugucaggguguccagacugaugucucuuucucaaacucccuuugucccuauucucccagaccucuucuuucuugcuuuaauuagcauuuauuuucuccagagacauccuaaucaacaacccuuaguuugggaguacagcugcuuggaucuuaccuccuacucuugucuuccugagaaauuucaaauaccuuucuaauaauuauaugaaagaacacuaucuguacucuggguccagaaaacaucuucauuacauugccaugcccuaguaauagcuuagcuggguauagaauuucaaauaggaguggauuuuccuucagaacuuuaaacaccugguccuguggucuuguaacacccaguauugacaguuagaagucuuauucacacaccuuuuaaccugucucuucuuuccuuuuuccuggacauuuucaguagcuauacugucauuuugggugucugaauuuccuagccaaaauauucugugaguaauuuuaaccacagauuucucugaauauuuggugaauccucaaguucuaaaaaauuccuuuuauuauuuaugaucauuuccuucacacaauuauuucugaugugucuuucuagacagccuuuugacuguguuaaagacauuucuaaugagucuuucaugcccuuccuaauuuccuuucuauguucugguauucuguuuauacaagcacuuuaccuacagcugucuucuuagccuuuacuuuggucuuaucuccuauucuugacacccuauaacaugcccugcccuuuaacauucaccauggccuacagggccaagcagcuccuaggccuuucuggagauuccaaauauggcuuacaugucaacagaccuucugugucugcuuagcccaccuguccuugcccucuucuaguguuacaaaguguuuuccuggggccuguauggagucagacccugccauccaucauuuagggaacaacagugauggaaaugccagucauuacacugaggcaucccgacaucagaccaguaagacugaucccagaagacuaccucauuggcagaaaaguuaggauagagauugguguguuuauacagaguaagacccuacccuaguggaguggagagacaaccacugucgaaaucucugccuaacuuagcaagaaccuggcacagagaauacauagcuuuggauguuucccugcuuuuaacuuauugugggaggaguggucauaaguucuaugguucgcuaaguugccauuugagguccagucuuaagcaauagucaguuuugcugaguaacaaacaccggauuuccuauuguuuauauuuguucaggugucuacugccugcuguggguaugccagacucuguucagcagcuguugggcugggucucuuuauugccuuuguccaauagggaagcaaaaacacauuaucaaguuaacccccaguggccuuuguaaccucucuccagauauuccuaaacuagguuucuugugugagcuuagcugugcuguguuccugacaaguggcagacuuuaaucaggggaaguuuucugggccucaguguccucaucugaaauagaugugauauacugccuaaguucccucccagcaacaauucugaggacaaguggagugacaauaagauguaucacaugagucuagacuugggaucccuggauguuaccacucuaccaguuggaugaccuuaaaacccaggcugcucagagcccagcaguggcucagacccagcccaggacacccacucaacacuaugagagccccaccuuuacauuauacuggugcuggcccuuagcuggaccaucacagccccucuaagccacugccuccuucagaaagcacccaggcauucuacccuuuacaccagaccccagccucuagaaaugaucuuuauguucucucacacacgcucugguuccagagcuggaaacgcugcucuaaaaugugucugaaugguaaugucauguauugacucacacaguugaaaagccacaaaggugacagcuucaggaguagugagauccagaagcaagcaccauagcuccaugacuugucucuggccucgguggucucuguguuguggccaaugacucuuagucccagauuuacaaccuugaagcucacaacuacaacuucccuauauucccagaaaaaaauaccaccagcagacauucacuagccagcuugagccacaagcccaguaccuacuaugauuggcagacagcuguacucuguaccugccucagagucguguaccuagccugaagcuugggcaaccuaaggaaaagggucacccaaaagaagagguucugcuagcucuagaggacugaaggaguggcaguggccaugguggguacuacagaggaugcugaccguccugucaccaucccacauagcagcaguaguucuagacaggcacagcucgacugcuauaauaauaaaacccaaacauggcagccaaugaaggacagcuaccucccaugauaagcauuugaaguccaaggugcagcuuccucucucccucccucccuccuggugacagggcucuuuucacaauaccaccccuuacagugcacccaacuagaucauagguguggggagauacgcucgaaccucuguucugcucagucuuccuguucuucccaccauggacucugccagggccagaagggcauuuccggcagucaggaacggcauguacagagagacagaguucuucccuaucccaaggggcaccccggcuuccacucucccccccccccacauuccugucuucaugcagcagccagaaggaugucuaaaacauaaaccagacccacggcacucccgcucauggccugucggccucccuccucccuggaaggcaauuccaaugcagccccaccccuggccagucucccuagcagcaccuuccuggagcuccucucaucccugggccccugugggaacagcaacccugacgucaagcugcaacagcuucauaaaggcacuuugaccccuuccugguauguugucucuccaaugccuuggguuccugaucccagcaccagucuuuuaacucaccaucccugugcuuggccaggcggguucugcuuccccacuagaacagaagccauuccuguuacaguccugugccugcacagaaccugacacauaaaacaagccagagaaacuuuguaagcucucgucucccccuauuacagcagagucaucugccuaggaugaggaccagcccugggaaugggcaauaagccacagcaccuaacugugaaucagcuccugccuacagugacuugggaagaguagacacaaagaagaggucugugucauguccaaauacauagugguaacaauggucaauuugacucuugguggccuaagucaugugucuguacacaucuccauucaaggaacacuggaucucauguuuguaaugcuuccuucuccaacaaaccugaccacuuguuaaacuagcucucucagaaaugucccaacuuacccacuuccacagucccaugccuagucaccuagucuugaagauaaccuaucccugucuccauaguuccauuugaucuagacccaucaccacaugaguguaugcccuuuugauaggaacaugagaucaagagacaagagaaagcacagaaagagaacuugcuucuugauuggucuugaucuauuuuuagacaguggcaagcugugacuccaagaccagugacugcaucauccacaccauuugaucuugucauugcugcaagauacacaggaaacagaagcaguggaaagaauggaggcaggcauacagccugauggggagaacuagaugagaggacugauggaugagagaacaaaugagaggaaaaggaugaauaaagcaagauagugugggcgaauagauauuuugauggaugauagauagauagauagauauauagauagauagauagauaauuaagugaauggauagauagaugaauaaaaaaugggugacauguaauggaagaaugaauggauggaugauggcuagauauauauagauggauaauggauggauggauggauggauggauggauggauguuaauguaugggucaguagaugaguauguguauagaugaauagaugaugguggauaccugaauggguaaugaguugguaaauggauagauagacagcaaugauagauagauggauagauaaaugagugcuugacagaaaauaggaugaauggguaccuggagauauauuagugggugguaaugguuggaugaaaggauagauaggcaguagaagggaauaggugaauggauagaugaaucugugaauggauuacaaaugcauagaugaguuuguaagacaggaaagaagugggagucacuacauugaaaggacagaagaagcaaguuuggaggaguagugaaaacuucaagcaaggguucuacucuuuggaacauguggaccccaaguccucacugccggcacccuuucuuuauuccaucagccucugguuaucauuuuacuauacugccaaggccuaagucauuccccuucuaagcuccuccuugcauaugagaagaugcuaauaaagccaaccaccucccucuguuucccuggcucagugcuccuugggccuagugugggguuuggugagcaagagcccauguaaaacuccagcagggccuauccagugccagcugacuacaaacccaggucuuccucauagccucauagaccuugggaaggcugaugucauagcaacucuuccccacacaccuuuucagcacuggagaaaaucuuguugguguuaucuguaccaacucuuucuuaucccacauuagucaacuuucuguuucuauaacagaauucuugagggaaaaaauaacucaaaaggaagaaggaguugcuuuggcuugugguuugggaggcuucagugggcaaugacuuggugcuguggucugugggcugcaauaaggcacaguaucauggugguaggagccucugguagaggcaagguuauuccccuguaguagcuagagaacagagaacaaaggcaaggggcuaggggcaagaucuagccuccaaggacccacucccuucagcuggaucccaccucaucagugcccaguaccuccugucaguacacuaaaaucaggaucuaccuauggguuucucuaucugcaaguccaucacuuccuccaaaccucacgucuuuaacagaugagccuuuggaggacaucucagacccaaaccauacuaagaucaaugaaggaccaaagcuugcuaugaacaggcuguaccuuuaaggaaaccuggauagccagccaucuccaggacccuggucacaggcuacucaggaggugggaauccagcuagcauucucuuuuuuguuguuguuguuguuuuguuuuuugugguuuuuguuuguuuguuuuguuuuucaagacaggguuuuucuguauagcccuggcuguccuggaacucacuuuguagaccaggcuggccucaaacucagaaaaccgccugccucuaccucccgagugcugagauuaaaggugugcgccaccacgcccggccacuagcauucucuuuagaggccuauacauggaacaacuagaccccuagguucaaggauaagcggccucuggauuuguguaaggcagccugaaguccuacgggcgguucugaauucaguggaccuucagcaggagccuugcuuucuguagaccauacccccaaaccuaccucaggcuccuacccuuguucuccuuauggagucucuagcagugugaacaggguugccaacacccagaugauggaagcuugggacaccuauguuagaagcaccauggugacucaauuaccagcuggcaaacagaaaacccaaagguaaaggucccuguacugaccuuacccaugaaguacuggauagaagaacucuuccaccccucccuucacacaccccaagucccuggcuuuaauccccuaucccaucccagacaaacuguacaaggguccccaggcuauguccaacagcugccugugccucugagucaccauacuugcuagggugaaggggccaggcaaccuggaaagcagaccaacuggaugcauucuuugguaggcagguucuacccuaacauauacacagcccugggcaauagggccaugagacagagaagaacaucuggugugggaauuugcaggaaguugagcuccucaugaaaggaguaagaaccaggaauauguggcccuccacuagcugggguuaggguuaugagguucaaaaccacagaauauagaaagcucccaggaggaagcccuugugucgaagauucauaguuggaaucaaagaguaggcagccugacgacucaggugggaagggagaucccaaaggcagagguuacaaaguagaggaacacuaagugcuggagacacaaccuccggucuccagacagaccaugucuggagagugucuccaugguucaugacaaaaugaaggcugcuuuuacccacugguccaaacacccagcccucuguguaucuguccccaaguaggaaccagcuucauggaucuucauaaugguuaaaaacugaccacagacugccugucauggugaagggauaagaagccccaucauaguaaaaaguagcuaauaggggcacuauggagucaagucuuugacaugaggcauagcuaugauggacuaagaagcaaaaaauguugucugucaucuauuucuggaacauuccagcauguucccuucucuuccuuugacuugcccugaggugcugcucuccacugacaccccccagcuugugaccccagaagcugcuugcucauaagacuucccuuuucaggguucugcaucccuuuucacugucugacauauguggaugugguacaugguuacugcucaucuccucacaacccuaauggucaccugggggaggucagugcuuuauugaagguuauaugccuuccucaacaccucagccagguaauguuugcucauuuccaagaaugaacagauacaugucugccuacuacauguagaccuugggaagugccaguuuccagccccuggaagucccuccuaauaccuuaguuuuuauccccggaagucacugaagccuaaggguuauuagacagccuuagaggcaaccaugcccaguggcaccagaaauacucaagaaucagucccucgcucauccuggucuggccuaauucauagcagaaguccauggcuccaguccugcacaggcuccugcacacacccuuccaaggguuaaggcaaagcucuccgcaccgcacguuugcuaagaugaacggucucagcaguggccagggcgccagcauuuuuguggucacagucagauguuucuaaccacguuggauggaacccaugacgggucuuuccgcgguuuuagccagauucugaacacuaccuuaaagcccugucacaucccaggaugagggcugugauagugcccagcucccccagcuuuacacagaugcaguuacccccaggcacccagguacccaggaagaagcugaccccuguggugguaggcaagaaggcugggccaggacucugcaucugagaaagcgaggccuaauuucguugacuggcaccugggaugccgcuuuggaagauucugacauaguccucagccaagaagccuccacggauggcugcggugcaguaucuugaguacuaacagggccggcccuacuccacaaaagcuuggagccacccugagccaagggaacugugguuauagacccaaccagggccccuucccuugccgggcuccuccugggguucagcccuuccucccuggcaggggccaaacacuagacuuaaagaaacacccaauccugaggauacaaguggcaucccaaggagggaugcuggacucagaaucuaacauaacucagaaaccucuauaaguuagggagauggcacagacaguaagugcuucuccgcacaagccugcaugaaagucugaguucaauccccaggaucuaaguuaaacauuuaaaaacaaaacagccaggaauggagguaguacaccacgucuguauucuaggcaucaggaaacaaagacaagcaggcccuugagcuugcugcagagccugcuagacuaaucagugaacuccaggccugugagagacuggguuucaacaaacaagguggguggcgccugaagagagauacuccaagucgaccuuuggucucuacacacugcacacaaaucuauaggcacacacacucuucucuaaagcgcucccuccccauugggcacucaccagcuuuguagaaauuguguccauuugcauuuuaaagaccuugaaaagggaccccuaaggaccuacgcagcgucuaaacaucuuccauccccccaggacuuucuuucagaauaugcagauaucuaaaacccaccugccucgcagggacuagcaagacugucuaaaacaacauccaacaacucccagccacacauucacaccauuaaaccucagcaucuccggcuuagugugaaaugaaacugcccaccucccuugccacccucaggaucugucuguucuucccuucaagucagauggcaaagcauguggaaaucaggaacagugcccuaaggacaucugugaacacacauguccauuucgggcaccgggggccauaccaaccaaagcauuugcucagagucagacuguacuuugugauccuguggacccaguuugcccaguguagagugcccaaaagcccucagaaaagacaaagaaagagaccuuucagacuagaaaacagaagcaggauacuuugacauaugucaccaugugccugggccacuuggcuuggcuacccaagcaagggcccaagagagugcccccuuugucccuucuucacaaaugcuguguaucuacuccacacaugugcacacagcucagaggcucuugccuuuggaaugcaguccaccccaccuccaguuuuccccuaagcaguucagcugcuaagcccugaacucucccaccugccggguccuuagcaccagcugcccagagcuccuggacccaggcacagcuggaugaccaccccuccgagcuggcuaggccugcugucagcugccaguaaagcccuccauccuucccaacagguguccccacaacugcuggggggguugcuuagcuaggcagcuauuccacugacccaggccugcagaaugaugucacacuuaccacuguggaaggagguagcccgagggaucugacagacuccacggaaguuauugguucuagagaaacggcacaccagucauacucagcuccagcuggguugggucagaccuauccuuuuaaagaccaacuggacauuggccagagaaguuuggcccugaagggucuggggugucuuuaccuggcauucauccagccuuugaccucuguccggccaacauugcucaagcacccucauguccuaggcucccccacaagacaucauuuaaauuuagaauuuucuugugcuucuguacccagcucugguuuuaaguuaaaugcuuucuggcuuagccugggcccugaagcacauuguacaggugugaucugcuuuuuaaaaacauccuaaaaaucauuguaaaaucugguccaagaacauucuagaggugaguagaugguauaacccugaucucuucggcauccuuauguguauuaagauuuucuacuucgaaaaccauguuuaccaauuuuuuauccugaaauuuaucuaucauuuuaaguuuucaauuguauugcuauaaaauuucuaucaguacuagguuugguggugcaucucugaucucagcacugggaaagugaagaaggaagaucagggacucaagacuagacugggcugccaaacaagaccuggacucaaaaacaguguuucacaacaguagcaaauagacaccuccauagguaucuguaguuguuacugccuuugaguuuuuaauuuguuaucuuacuugcuuaauguuuauuucauuggccauucuaacagcuaggauuuacuuuccucaaugauucugccaucagaauuuuucuccauuuugcuaguauucuccugcaucuuggucaauuauuucuuuguucuuucucggcauuuguugcugggccuguucucuuuuagauuccugaguaaagccugggcacacucuuuuuuagucccucuguuccucugacauggcugugagcauuccucuaaaugucccuuugacugcaucacgcacauucugcugcuacgucacgcugucaucgugagccugucuguaaacugacgugccucccauuucauuuccuuuuuuaagcaugggauuguuaggggguuacuuuugaaugcccagugugucuguugguggcuacuuuccaauuuuauaucaauguucaaauuuucuuucuuuuuccuuuuuuuuuuuuaaguuuauggaauuuuccuuggaugcccagagcugccucugugaccuucugauguacacgggaggcaguggacucugucaggaguucaacuugucaugagucacccagcgccugacuuccuuucugagcuuauuuaccuguuugccuuccccuguaguggugguuucucagguaugggugugaaaauucucaggagugugguggauuccuugauuuauugguuucuuugauuuucuucuuccccuucaagcuccagacacccuguccuuuuccccccucccccuccgcuucuggaagauucccuuccccacccaccaugaggucugcacacucagucucuacucccuugaacuucucuucauugccugaggcuucuuggcucccuguccaucaguacucacauguuuacagccguucugcaccuggauaucucuggggccucuuuuagccaucauagaagcaggggagguccuuaggcucugggcuccaauuaugccugaccuuugcaucucucuaaggacaucagaacaauuccugcucagccaguccuucugaguucucuuccuggauggggcucuuggcacucuggguggcacagacauuguaaccucucugcaucuggaucaagacugagugaacucuuuccuuuggcacuguuguggcuacagggugggcuuucuauguaaauccuaccuccucauucccuagcugugucauaggugcagcaggaacaguauaugcaaaccuguguagggcgugaacacagcuaaucagaagauggaaagccugcugaggcuuagauggucauagcuaucauuacaaggggucccuacuugagggggcaguagguauaagagaugggugcuagagcagaguccaaagagggaggaacugugggcuacuagcuuagaaauagaggaagagccaugagccaaggagucaggccauucuggaugcugaaagggccagaaaacacuugccccagaccucucaggaagcagucagcccugcaauuaucaaacugcagaccucccagacaggaaaaucaagguauaugccccuaaggcuuuagugacuuguuaaggaaacaaaagagugagacaaugacaggagccugggccacagcagaggacuagagagcucagcaguaccaagcagcuacuagucaccgcagcaggaaucauauauguacauauauguguguguguguguguguguaugugugugcgcgcgcgcgcgagugcgugagcacauguacgugcacuauaaagagcuaugggaaugucagaugggcugcuaaaccagcgaggaaguuaacagagguaccuaacgaacgccaugagcuauauaccaaagaugcaggcaaaugggcuaagccgaguacagagaugaaacaagaccucuaggcagaauguguagcauacguaaagacccuggcacaggaaggaaggggccuagcuugaacugacaggaagucaaaggcugaaugggguuagggaaggcaaaacacuaggcaggggcuaaccucagcacauggauaccagaaagcagggaaauguagguguuaagggugcauauaggauccuucuguuuuaaggcuaugcaaucauuaaacacacacauacuguuaaauauucagaucaaguuugaaguaaaucuucccccaaaaugggauuaaaaaugagaaauuaagaaaauuaaccaagaagcauaaacacucaauaaauaaauauauuuuuaaaagaaaagaaaaacucacaggcaacuuuuagccccagagaaaacaaaaaguuauacucacaaaaaaauccaugaacaaggaaggcucaggagacaguaaggcucuugcaacacaaauauaaggacuugaguucaauccuagaaccaauguuaaaaauaaaaauaaaaacaaggcaugguuucaaauacuuauaaucccaguagcagggaggcagagguagagggcccuuuggacucaaugcaaucauuaaaaacacacacaaauacacacacacacacauacacacacacacauauacacacacauacacacacauacauacacacauauacauacacacacacacacauacacacacacuauuaaauacucagagcaagguugaaguaaaucuccccaaaaugacucccugaaccccuacccuuacuuacuugauagcuagaaguuccggggagagcaugggacacggggcuagagagauagcucaguagcuaagugcucuugcuauucuugcagaugacagguuccauucccagcacccauguggaggaucucagaugccagaaacuccaguucuagaggauccaauacccccucuguacagcacuacacauguacuauacaugcauaggcucaggcacauaugcauauacaaaaaaaaaaggaaauagaaggaaaagccuccuaaaagccccaucuaggaagagcaccccucguggcagucuguccuuccagagagacugggacaaagauaauaccacaggaccaucucagagauggcaagugagguaccaguccauggaucucucaauauuuacaaaagucugaagagagaauucuaugcccagccaaaguaucugugaagggcaagaagacacuuacuaauucauaggauuugcuuuucaugccuuuccuuacaaguuucucuagaaaauacagauccucuguagagcaagguugggcaaggcugcagcccacacccgaggcagaggggcugcccaagagaacacugagagaaagaagagccuguuacugagagaaguauacaucccuuggaugguacaugcaguugcacacauggacacaccuggcacacagaaccaugccuguauaagcaaucacacacauauauacgcagaaugcagacccacacaaauguagucuuucucauaaacaggcuccuucaugugugcauaugauucuuucccagugaagucgauuccccagcuggcaagauggccaggcagguaaaggcgcucaccaccaagucugaaaaccuggauuugguccucagaaccuagaugguauaagaagaaacugggaucugcaacccuauagguggaacaacauuaugaacuaaccaguaccccggagcucuugauucuagcugcauauguaucaaaagauggccuagucggucaucacuggaaagagaggcccauuggacaugcaaacuuuauaugccccaguacaggggaaugccagggccaaaaagugggaguggguggguaggggaguggggggagaguaugggggacuuuugggauagcauuggaaauauaaaugaggaaaauaccuaauuaaaaauauauauauauauauaaagaagaaacuacacucauacaaauuaaccuccaaccuucacacacaugcacauacacauacacagggaaauagguaaacaaggacuuggcaagguggcuucauagguuaagagcaucuacuacucagacagcgcucaauucccagcaccuaugucagaugacucacaacacauauaacuuuagcucaagaggugucuaaugucuuuggccucugaaagcacauacacucacaugccuauacacucacauacacucacaugcacauacacucacaugcacauucacucacaugcucagagacacacggacacauaauuaaaauaauaauaaaaaucuuuuaaagauaauuaauuaaauaaguguuuaaaaaaaaaaagcuaaggcaaacccaaaggcaacccuuaacuacagagaaaacagaaaacuguuaucacagaaggacccugugaacauaguauuuacacuuuuagagcuacauguuucuuuggaaugcaagugcuaaacauuuggacuaggacugugguguuacuacacagaaggacugcugaggaggaagcugugggacaaaauguugguggcucgucucccaugacugucacuagauagugccuaagauugccaagagcaggauacagagaguuaagaaauaugacaggaaaacuaauaaaucgaaggucagugggguagugcuuguaagaggguucuauaggagaagggaggcaaggauggagguugaaaggggcucuguucugcuugccgugugacugggagcugagagcuggaacagaugagguacccacauggauaugugucuacucagcugugaacugagaaguuaggcuaugagguucagagaugcuaaaagugggugcuagaggacugcugccaugaaggggacccuacaaagggauguggucaaggucacuugacaagaggcuauagagaguagugugcgugggcgaugagaggacugagcucauacaggagacuagaggguaggcagaaaaaguccaggagcucuugcaucccagaagucucagggacuucaaagaagaggcaggaaagcaaggacugaguacccacuggguucccucuugguaccacauucauuuggcccacaugggacaugacaagagccaugcugccuguccgcugggucuucugagcugagugaagaacaacagaugaacaaggucugaaggacuagacagggaaccugaggucagcaggucaagucugccuccaaaggcugguuugcaaagaaagcaguggugugcucaacucaugugcccacgggugucuuuguacucagagacucagucaugaagggaugaaaaauccagagauauacagaaggaaggagggaagcucccuccccaaucccuacuaagcccagucccaggcuagguuuagauuagacaugagcuagacucuucccucauacuaucccagcuuucaguggccugacucagcugcccaguugccagagggaggcugagggagguccuuccagacacaaaccuucccgauccuugccugcuuagcucagcauccuuccaggaaaaugggcggguuuccuguggaagagucccagugccaggagaaugagcccugaagggugacagagcaccuacagcuccgcuacccucccugucaggcaccccucccaugugccugacuccaccccacggacgcuugcuuucuucggguuagauguccuccguuguucuuggcagauauuuccugaaugucugcuauguacucugggaacacggggaguggggagaggcagggggugcaguauguggcccugcccuugaggaagucauguacagugagccauggacaguaaacaggcaauaaauuguccucugugaggcugucaggagaggaggaggaagcacccaaagcagucauucacacuccaguaugaaugagcgccucuggagcucugcucaauagcagaccagacuaggguggccucccauuuccaaggacuaggacaaggguggggaguauuguagagaggaggcagggcaacucccucccuuaccauaguugcuucaucaacaccccgaguucccuagcugcaucccugagacuccugguaguccccacaauaacacccuacccccaccuuacccuggucucugccccuucugcccccuguacccucuccacaaggccucacccuccccaccauccuggaaacgauuuuguugucuacagagauuauguguaacugacugugaguuauaagucuccggagcgagcgagcagccuguuaccuaaccaggccuggcucgugccaaugucuugaguaauuauuggggaggggggccucagcccgcagccgaaccucuccaagggaaugcuauuguuuuucacgucagcugugccuuggacagaaaacuguaggaaugagaugggguggaggguggcuuaacucuuugggcccugucugcccuagcuucucagggcugccuggcagagagcaggcccugucgggggucagaaccccaggccgagccggcagccgccacuuggcagagccuguggaaaccaccgugcagcucugugcagacaguuguggaaacuugggcgggcugucaguucacccagccagcaucucagcccuuucucccgcuccugccccugcuuccacaaggcucaccugcaagccuacagcugucauaggaaauaccgugcuuguuuggggcccaauaaggcucaaaaaggaccaggccuggggcagcaggcaucacuagguccucagccuccccccagcuuagcuggaucucugccugcucuagaggaacccacaaccccuuccuacugguauucucagcccacuggcaccacaugguuacagccagacccacugagguagggcacaguguucuuguggcaagccuuaaggccagggagaaagaggcaggguggguaccaccaagcaguggguggcaugggagcugcauccuaaggauucugggcuuuguggucacucagagcuagucauguggcuuaaaacacagcucagagguaacuuauauguggauaugucaagcuaggaguagaaugugcuaggucucaaggagcaagcagagcaucggccaugcugugaggagggcagugcagauugguugagcuuuggcugagaugaugacuguggugucucaguuaagagcuuccaggggccuagagcagcagucagaccaggaaucgccucugcucucuggaugcuucucugucuacaaaguggcaccccuauggcuucucccaggguugccaucaccucugcauuucaguagcaggaagaaggaaaauaccugaagaacaaccucccuccccacacagccugguuaccugagaggccccuguuagcuuuucuucuguccaaugaccagagggcaguguaccacuacacggacccccuagugaauuaaguggcuaauucaagguucuuuugcuaaaggaggaagugcuuugucuuugucugagagcaaacccauguguuucagagggaaagaauucugauaggaacuggguguuggaaagagagcaaggaguucauagacccuugggggcucagucugagucuuaagagacaggcucagcaggccugauucccugggauaaagacaagacugacaggcaaucugcagagcucagcuuaggauaggucaaaguuaagagccucucagauuccuaaguggugaggucagacaccggcaacuuugugacccagggagccuugagggugcagacuggcaucacuguuguauagaggcauuaaaguuuggcguggugaagccaucagcaaagguaugagggcaggacucagaagaccuaggaggagguggugguagccaaccuggagauaaaagacccaggaaauuugccucuuuagagucugaggaugaaaagggaaaaacccaaaggcgagucuuaacuccagggaagacacaaagcugagaucacagaagaccuugugauucagcuaaaauucaucucuacuuccucaaaacccacaagaaaaauggcaguagaauuaccaaaggaggaaauuacuuguauaaguuagcaaguaaagacaugagaagagcauaagagaccccaaaaguuuggaaaaguagauauagaucuauuagcagagacaaccauagaaaugagaacuagagaucggccuuccccaggcagagcuaccauuaaagaugaaguagcuacuagcugggauccuagaagaacuuuauaccauccuaagggcagagccaugaaaagaaaacaccuacagaagcucagccugaguggaaagcacuccgucacucuccccccagcccaugacccgagguacuugcugacccccacccaaccacacuacacuguaaagaagcugauccuuucggcucugaacgugacgauacuaggaacagcuguggguggagcugaacacuuugaagcugaaaaagccaacuucuagaaugucccacuggguuccauuauuguuucagaacagaaauaaaacagacauccuaagucuccugagagaagaauauaggucauacacagaaaauggagaaucaaaacaucaggaaaugagcaagcgcaugcuaguacacuaacuucaaacuuugggggugggagggcggggugauuuccaaucuaaaaucccaaguauaacugaagaauaaagauauuugccaagaugcacaacacacacacacacacaaaauauauauauauguauguauguguauguauauauauauauauauauauauauauauauauaucugccauauaccuuuucucagaaaaugaccugggaaugugcuccugcaaagugagagguaaaacagacaagaacgcagaagcugagggccagggagaacaaucacaccuaaaaacuggaaagaaacaagcccugcaaggacuccaacagaaagaggaggggaaggagaaagaaagggaggggugcugauucauuaucaguauucccaacaggaucaauagaaaaaugucauaauucuugcagaaaguuaaagaauggauugguggcagauguagaaaaggacuaggggugugucacagugguaaagggcuugccuaauauguacaaaaccuggguuugacccccagcaaugaaaaaaacaauagcugaacaaagauuuuaaaauaugaauucucuggggcugaagcuauggcucagaaauuaaguacacucacugcccuuguagaggaccugaguucaauucucagcucccacaucaggcaguucacaaccaccuguaacccagguccaggagaucgaacaccuucuucugaccuccauaggccuccaugagaacacacauggcauauacacacacauacauaaauaaaaauaaacucuuuuaaaauauuuuuaaaguaaaggauaagcaaggugucuuagcagguaaaggcacuugcuaccaagcuugacaaucuaaauuugaucucuagaaccuaugugauggaaggaaagagccuuaacuacagagaaaacagaaaacuguuaucacagaaggacccugugaacauaguauuuacacagcagucuuuuaaagcuacauguuucguuggaaugcaaaugcuaaacauuuagccuaggacugugguauaacuacacagaaggacugcugaggaggaagcugugggacaaaauuuugauggcucgucuuccaugaccaucacuagacaaugccuaaaacuacaagaacaagaaacagagugucaagaaauauggcaggaaaaacagcuaagauaguugaagacuuuccucugggaacuguugaggacuggagauguaaccccagcaagggcuauucagagauggaagagcuucuggcaugcuuauauaacauugacaagaaacuucuaaacugcagggaagggaauauuagugccagaaaauagacacuucugcugguggccuggugagaaagaagagaggguccaacagggagcugugacucagaaggaaaagaugagggcauguuagggucugggauggcaggagaugaagggcaaaccagucugaagcucuguccugcaugcagugucugggucaauuagacccugguugggaggaauaaauaggucuguggucaugcgggauaggucaguacuaagagaagacagucagcugacaggugucccauccuuuaaccagaggugauagagggacccagguuccuccggaagcaguccugaagguuacuuuggaugguuuccaaggcuccaaaaaccgggcucauaauaagaacuugaagaccagggugacuggggcuuccuggggccugugaaccacacccagcuugucaacaugugccccuuacccgaucccuggugucccgggugaguucuuccucccagccccaagcacaggaagggcgggcugggaacugcaggauaggccugagucccucaucagcugaaggggucaggccaggucaggcgggcccagggccaaccagaaccuuuuuccuagguggaaguuucucuaccuuuuggcuuaccuucugagaauuauagaccuuccugagggccccacaaccuguuugcccucauccuugggccccagagagcaccccacaugcaauucuaggcauggcaugagcagaacaagaauuuagugggguauacgagauguccaguucucuguaggaaugaggcagucagggcucuggccuuauuuacaagguaaaucucaaagucuaccagauacuuuucugcacagaguaucugugaugucccccucuacagcucaacccugcccaccagcuucugccaagaacacaggagagccacuacaggauaguauguguaaagccacaguaacagcagcuuucaggaagguccuucuucaggaucacuagcccgagcugcucaacaucccacagugcccaacaucagaguaaaggcuccuagcagcaagauaaaugucugucuuuggcugcaggaugagcuugggggguuacaggucagagcaaucuccaagguggcagaaggccauugccagaguugggggcugggacaugacugugauguggacccuggacuacagugaaaauaagaguuccuauuggugcaaggaaaggugguaccugucaccuacacuguacaugagucccccaacccccccuccauuccacccccagugcaaaucccucuuaucgcugcuuaguacaggaugcuuagggaaggacugucaccagaaagggaaagaaaaugacagcaaugccuaccaccaccuccagagauaggacaucuguuggaggcaccuccuucagggcccugagaagcuaggaggauuagcugggugggcaaugccugggccuugccacuauagucaaggcugauacaggagcuaaaucucagaaaagccagcagggccaggaucaaauccagugaugccugcuacucagggguugaguuaagacuuaagcagagaugaccagugcaacaugggucacccagauccacggcaaucuggucauggagggacuugaucuaccagccagggggcuaggguccauaacuacacccacuaggguccccacugagguuacagaaggccagugaguagcccagagucaaagagcagguucacuccccuuacauccaauaccuuuggcaccucagucugcccugcagugccugucacggaaguuggagauggacaaucccaagggccugaaccugagcuggggaucaguaaugccacuguaaccauagcaggguggcccgaggcauugggagcaucacaaagugggcagguagcagguaauaggcuagauaguguccauucugaugagccugggaacauagggaagagaaccugccaaauaugucuaaaugggcuggagcacuggggccuagcuugaagccccaacaacuuccugcugguccaacucuucuuacccacuuccugaacaggccaucagagaccagaggcagccagagcuuagcccuacacacucugaucagccaugugaggaccagcacagggcaccugaugggugaccucagagccuuguguccauaugacaggucauggagaaggaauacccagugucacaaugaggaggcagcccagacaccagagcugagcacagaagacagaguaauaggggaaggguggccaguggugaggugcuguggcuaguauaaagugaaacaucauugcugaauguggaaagaugaaagccaggagagcuggcagcccuuuuguucccagucacuggagggccagaaaaaggacauggaaucucagcuuccuuuauucauaugucacccucuaaaccuuguucacugccagcuccauuggagcccaaccuugcuucuccaucagguucucccagucaacagaggaaaggcugagccuaccuaugagauacugaaauuucugucccaagacuguguauguggagguaggacacccuguguugaaaggaguaaggacgagaacugaguucugaggcacagaggaccagaggaagcaguaugggaagccuuguccugucccuaaguaaguaaguaccccuaugcuccagccaggccucuacuccaagcagaauacuaggccuaaccuagcugccaggcaggagucaauauauugaguaguuagaaacauucuaacucugugaccccacgaauuucccgugccaggagagacacaagauucuaguuucuaggccuagcuacccagcccccaucugcagcccugggccuagcuuccagccucacucuggccucagggguccugacuucagaaaauccugucucagaguagaagcaggaaguaggggagggagcgggccccaucccguuucugcaggcugggcugggggcugccugcccaccugggucagccacagcugcagcuuggaugacugacuggcugagucauggggccccuucaaucuccagacugggacagagucugaacagccgugaggcaggauguucaggccccaggagggcaggcacagcuuaaagggcuugggacaucagcuggauauugcucaccuuuaccucaaaacuugcugccuagcugcucaaaacucugcugccaacagguuaucugccuuccagaagcaacucccaguuuccuggcuucuagcacauagccacacucagcuccauagagccugugcccagugccaugcccacagccacaggugugugcauacacaguacacacggauaggccaggcucuucaguuagucccccuaccagcaaaguucuagaucauucuagccuaugauucuuguaucucguccugugggucuuguaucucauccuguguugagagcuuacugaaaguggcgcugaguccuugagggaggggugaagggaacuccuuaaaguucagcagguguagagggccuggagggucccagaagaccaggagccagcugacuggggucagucagaagucacucuagguuaagaguuauaaggagcaugaaggccaacagucagggaagggugagagcaccuaagauaaaauagcuacagccaucucuauagaguggcaauagagaauaaggcacagugauuuguaucaggcaggagggcaaaggaacacccagguuggaagucuugaagaucacuuauguugaagagaaggccaaagucuggguagauugggugggccaugagauacagaaggcauccucuaaaggccccagauucaaagugggagauaagggaaaggaagccaggaaguaaucuggaaagagaauagucuguaaggagccaguaacugggaaucaggaagccuugcccagaaggcguaucccagggagaccaggucauagguagaaaaccuggagcaggggcagaugcuuaggagcuauggagggcuaagggcagugggagccagaggcaagugaaggggucacuggggguacagcucuugauacuagcaugucauccuucaguagaagggucuacuucaggcaugcuguagguccagggcguucaugggcuacgguuguccccuggguccucuuguccagcaugggaucccagcggguccuuucagggaggcccacggcacguacagccaccccgagaagcaagcgcccuuggcauguucuaaccagcgcccucaaagccugaguugagcaaaaacaagcaaguggaccgccacaccuggaucguauuacugcugaugucaaaacugccacggagggauacagugucucaugccggagcuaggcaggguaaacacccugucgcuagccaagcaccugguacaggaggccccaaggagaggaagggaggcagcauugaaugucuuuauuuuacagaauagguuacuauagagagcauguagauccacacaaccuuguagagaccauaaugaaagcugacagccaugaaauccagcauccaggggacacuaagggacaugggggaccaagcucccagugcuccugguuguuucuaggauagggcaaggaaagaagccauuaacugucaagccuuguauacacagauacucaaguaucaguggggcaugcacagcuguugcaaagguccauuucaaggguaguccugggcuaagggagguauaaaggaaauacaaggauguagguguagccgauauuggugggccagggaagcacucuuacaguaaaaggguauggagugacaguguucagaccagaagagggcuagacccccuguacccugagaggcccuugagaugcaccagguaccagggaaaaccucggauggaagcaaaaaacuggggcucugucuaugacaagauggcacuuggaaauguucaacaaagaagcacuuugugggaagaucuaggaugaacuaagucagacuauccacagagaguacgcucccagcagcacccaggcaaagcaggccccaguccguguggccgugggaauggacgccggccauagucaagagucccaguaacgggcagugguggcgcaugccuuuaaucccagcacuuggcaggcagaggcaggcagauuucugaguucgaggccagccuggucuauagagugaguucuaggacagccauggcuacacagagaaacccuguuucaaaaaaaaauaauaaaauaauaaaauuaaauuaaauuuaaaaaaaagaagagucccaguaagguuuuucaccaagaagcaagggcgccaaaggagagagaaagcaaaagccaagaaguugaacauuucuuucccccaccuggcuccugaggggucggagaaaaugugugucaugugaacagguuagcuggucggauauguguauacgugugaagggcugggcugagaacagcucaccaguguucacaucagcagauagcucccagagcggcuggcagagguggaugugaacaaaggggcagacagaacaagcugcaggucuagggaggcuggaacaggaaaaaggagcugaagccccuuuaacagcagccacagaccggcuuguguuugcuugggacacgggguauagugcaggcccaggugagcagcccugaucaacugcuugaaccccaugugaccccucucuaccuaccaccauugcccaccuaguuuggccaaaggcucuggccucugguacaacauguucugucuggaguucucaagcuuccgggacuccaucaggagagaauccaaugccgguggggccugugccugacgccagcacaaacagggccucucagccuccagaguccuuuuucagccugucuagaagaacguccagccugagcagcugcuauagaaucugcccauggggggagaaaugagcagacagagcagcagcuuccuagucacccugacagggagcugccucugcaaacaggacccuuugaggcugaugagaacuggcuggucuuuuggaaaggguggaguccccauucugagccuagguccccuccccccaaccuucacuggcaggcagaggccuccaguauugucagaagcuaggggcuauaggaccccacaccugccacugcucugcucugggaccuuuguccccaaagcugauaucaguucacacagagcagggaaacuauggggugggcaguuccaagcaacagggguagcuaggagggaggagauggcccuguguucuguaccuugaggccacaugaugcuagcccugggauauuaacugugcaucugugugagccagcacagucugaagacagggugaagggugagucacaugaacaccaagggugacuucagugguagcagaagaagcagaagggaggcagcccaauaggaucauaugggagaggugacaaaggcucccagcucaaguuagggagucaggagcaaagucaacaggguugacugggagggaaguauugcucucaucacccugcaagauuccaccacagaaccaccaccugcagcccuguaaaggacacuccuggccucccauaccaaagccccaaggauuaaagcuggaagccaaguguguggucacaggcuugggagacugaggcagggggaucauaagugucaggcuggcuugguuuacauagugaaagccaggauagaagggagcuguuuauagugaacucuagaacucucauaugugcugagagcuuuguauguagaaaacaccccccccccacuaugugaaggaucagcugcuacagggaacccugaagcaaccacacacacauaaaagauuuagggguaaaaugcaaaccuaaaaagcacccaaaaaauucacauuggacugaagaagagugauccaagcacacccugacuuggaaaccauggagaaaaaaaaaaaaugguacuucuauuuggaaaagcaauggucaccaucauugcagacacaaaccaaaugcaugcaagagaaaacacuugugaucuacaugucaaaagauaagccuucacauacaaagagccuuuacaaaucaaugaacaugaaaggacuugcuggcuaaccucauuggccuuugcccaggucuuucuagggagcagggcucuugggggcuuccacccccucauccaagagaaaggccagagauuaauuaacucccuccacaaauauuuguacuggaucacaugaguuuacuaagcaccuacugugugucauacauuaaaagauccuaauaauaaaagucccuaauaauagggacucaacaggaauggcacacucaggaccugaucucaggagccucaaguuugaagaagaaacaguaaacuaguaaauuaauaaacucaggaagucuguggagaggcaguggucacagaguaugcuaggggaagcgggauaggcagaagcauuugcuaaagcaauaggcauuugaguugaaaguccacaaagaaguguagagugggguuuccaggcaaaggggccagugagugcaaagguccucagguaaauggaggauguguucaggaucugugugagggaaggguuggaggagggcugcaaagagagagggcauucacucguguagugggaaaucugagaaaaggcacagaacuaagcacaaaggucagccaaugcugccuagagcaaagcagaggagaggagaggaacacaggcaccugggucagaggugagaaggcaggccuagccacgcccuguccgcagagguuggaagaggcuggauuuauaugaguacuuguguggguguguguguguguguguguguguguguguguguaggcuauuugggugcaggucuacaugacaaagcaccuccaaaguacauauaaaguaagcuaaguauccuagacaaagcccagggacuaauucucuugugugaggaggcucuugaggaguaacuggcugggugaauaguagggguuccuaccacaucucagucuuagggugcucuuuuuagugucaugucccaucugguguggcugaugaauucacucuaguguugcugauaaucaggaauauucauuuguuggaauaaauaauguaucugguaagcuggcuguggcagguguuuaucugcauaaacaagaccagaagucaaguuguuauuucuugacuuuuuuuuuuccuuagagacagugucucuuuauaucaucacccuggcuggccuugaacucacagagauucgaucaccucugcugggauucugguguguaccaccacgccuggccuuuuugaccuuuguaaaaugaauaacugagguugaagacauugcuuuauuaacuggaggcccugggauugguacaaaaagucaauguucuacauggccuggaagcuuccaguuuggccccugccuggauucucagguaugcucagccauguacccuguggauacugggagccaaagacugaaggccauccugucagccagagauccagcaugcaggcuuuucuacaaaagcuggagcgcuaaagcaaagucauaaauacgguaacuguaagcacagccucucuuggucaccgcaccuaaugugagcucacaugcaguccacaagaccagccuucacaagcuccaacugaccguguacaauucaugggaguucuucauggucucaccaugcagaugcauguugggugaggaugggcccugugggcagcacuccuuccccucacacuuagacucuggaaugauggugcucacaugucuagcacuggcugcguccuuucaugaacuuaaaagaguacuauagcaagugugugcagagacccgcaacugacagggcccaguuccaaugagagaaacaggugacuaacaaaagacagcuggaacccugaggaacccaugacuaugagcugacagggacacagcagaggaaagaaaaagccaagaguggagagcccugagacaggcacaugcugccacauuugaggaacagcaguagguuuggaaacaagagaauaagaaagagaaaagguuucguggaaaauggaaguaaguuacaaggcacuccuugggccagcaagaccgugauguuuuguguuuacaaaggacuaucaugcauaaacccacugaagugagccaaccaguagacacuccuguaagagacccagaacuggggauagauagcugggcgagaugaacuggugaggugcagcucagcugugucaggggugcuggccuccugcugaagggauucugggagacaggaggaaaguuacauugcagaaggccagcaaaggguuugcaaggagaugaccuguagaagcuccacuacauaccugcucucucagucccucucuguggguguuuaagaugaggacuuguaauacuaccuccugagaugugcgugagcuuguuuguguuuggaaaggaccaucauguauaaacccacuggagcacugguacccaauacauaauaaaggccuuaauaaaggucuacugcccauugcucucuugcaaccugacucccaacuuuugccccagcucuuccuucucccauaggaccuuaggcagacuucuuuccuucugcaaaaaguagggucauacuuagccuagacgguuaaagaggagucuuucuggugguggugucagaaugaugaggagagagagagcagagacuaagggaugggcaggcagccuagaggaggacugaaaaucaucaaguucugccaggcaguguucuauccagacgguaguugccugaucauaagaugcacaaauagaggccagugggagcagggucaacugacccagccagggagcagcccaacugggcucuggguugcugaguacccugccuucucuacaucccacuggccaacuccccacaggcccuucuagggccagguuggcauccaaugacucuucauuggguaucaaacauuuuuaauauggcccugaaauuaacccaccaaugucgcucaagucaccaaaggccauccucucaugacccugaacugaccaacaaggaugcccagccugaauacaucccagagccuuacacccugguaucccccaccccagguuaagcugguuuggggggggggguacugaccaaggaucaaggcugggcagguucugaaaaaaaaagacuuuucaagauuuuccuuugaaaacaaguucauaaccacaucaaacaggaaucccugucgcuuugagucugaucaccagccgccgcaggcucucuaacuagcuguuauucuaauugcuuuuuucucuucugaggcccacagaagucaucuaugguuucuccuuuagugagcagagauggggcacaacaaggcuuuugucugccuugcccuguuaaucacuaucaaauugcaaauagugaugagaucugagaucuucaaaacugaucugucccgguggcucuugaagagcaccagcccagagcccagagcagaucuucucuucccugaaggugguggcaccucucagggcaccugugugacguggcucccugccuucaccuacucggcacugggcaccaaugcucacaagcucucuagcugaauuccaaacgccaaaaggagaaaguagagccagguggcuucaagaacacucacuaaaaguugucuuuggagcugaguucuaggcagaggagccaccauacaccaggccaguacccuuccugcaguggcccagcaagacccaagacaagcuugggcaugaagggccucucuauaugcuacucugggagccuaaguggcuagaaaggaugcagagcccagaagaacaagcuaagaccacccugugcccugcccucaaggcaagaagcauggcaggcaaucuccccaggcuccuugugcaacacauccaguggacagcagcauguuccacuucacagcuagggaagcagaggcaacaaggagcaugcauggccacgugcagucccaccucacagggcaaccccugacccccaagcuuugcuagacagauuagccagcaagcaccguggccagcuaccaagauccaggcuagagcauaaaugaaguacagacaucccgcuggccaacucccccacaggcccuucuguugccagguuggcaucuaauggcucuuuguuggguaucaaacauuuuuaagauagccccugaaaguggccuaugaaugucccccaaaggcuauccucucacaauccuacagaagguccuaagcucaccagcaaggauuccccagguuaaauauguuccagaccuugaacccaagcccugguauucccaccucaauccaaguuggcuuaggcaaucuggucugaacaaggccagaaaagcuuaagaacucagccacaacuuacuguuccucacccaugacagccagggcaagcaagagauucuauuuaugaguagcuagacaagcuaggaagauccuauggauggccaagaagacccagaaggguccuacacaugaccaugaaauccaggcaaacucugaggcgacuggagaguugaaggagugggcacauucaaaggagcccuugcacuguuugcugucuucaaaggccugucaaggugacaguggcacagugagguccuagacucuagacacucuuaagacucuagcccauauccugccccuagcaacuuggccaauacgauaucuuugaacccacacagacuccuccaaaccccaguugauucaagugggauccauggggucauugugagcuugggaaauguccagggaagcuucagggacacccuugauuagcacacacaggcuugauagacccuguggcagcugucccauaggagguuucaaacagccccacccccacucccaagaacucuccuuaaggacucuauccacuagcaaaugagauguguccacaggugcucaauuguggguuaggaaacauucaugaagccauccaucuccaugagccaacugaugcuuuucuccugccuacucagauuagcuguguguuuaaaguugcaugaagcuagaccaagacuagccucagacaacccuccuuugguacagaacucaccaaggccuuggaccggucauggacucuggcuucaccugccaggaucaaccuagcuuuagcuuccacccccuguacucuuaagcccuggcuucaguuuccccacgugagcccuccagccuggauaauccuauccagcccuuucagacuacaaacaaguauuaggacagagaagccaguacagaaagcaucaaaagccugccugggacacagacuucacucaugacacacacuuguccaggaagaugggauccauucccugccugccucuuguccucagggcucuagucacccagguuuugaggccagcggucagcaauuggcugagucaucccaugguuuucccuaaagcagcuuugcagguuugacaauaugacgccaucugucagaaccucuggcuccaucccugcaucacaggcauucccuuuacacuaguuccaaauauagacaugaggaagaccccugauguacugacagagcaugcuggaggaaccaccccaggugcucagcagcugagguccucucucucccaaccccugcucuauugcuucugcuagguagguuccuguauauccccccaacccugcccccuccaugagucucccagcugcccuugggacagcccugcuuccuagguuauuaugcuaggggcucuggccucucuggacaguggguauuuucuucuaggagagaaaaggaaguagcugagcauuucaggcccccagggcugggcuccagccccuugcacaauggcuccuucuuucuaaggaguucuccaauggcucuucauugugucuccuacaagcacagcaaguguggccucugucaagggccuacucagguucugcccugccuuugucuccccuccaguuccuuagcuacccaccuagugcuuagagcaaaacaagcccuuuccaggcaugggguaaggaccacacagucaagaaaucuacucagucacuguccugacccauggggaccuagaaaggugguguuguccuaaaguaguaccuuugaguuaccuuuaaggguggacauuauuucaugaaaccacccagccucugccugcucaacccugagcugucccaaucccucucuccgggugccaaccccucccacaaagcuccccucccccccgcacuguguaagguuccaaacccauccaagcugagcagauagcuugggacucuggggucccacucaucaugccaccagcccuaccaccucuuggccacaggaacccagagacuguucuaggagcuccauaagguuuguccagagucucaaagaccaaaaggcccgggaaggggcuaagaggugacucucagccacuaggucuaccuagaaacaagagauaacuguuaagcacgcccagguuuaugcauguauggacacacacaagaacucaauacuauacuguacccccuguaccccaauaacagaugcacaugagggugaccaagggccucuaggcaugguacacacauaaauucaacccacagcuauaaagacaugugacauacucucuuucaggcuuugaaugcccaggcccuaauauggccugcacuaggcugucucuagcaccagguucaucucuguuucuguccuuacaggugacacaacuggaccagagacuggugaucaucacagacaugcuccaccagcugcuguccaugcaacaaggugguccaaccugcaacagcaggucacaaguuguagccagcaaugaagguggcuccaucaacccugagcucuuccuacccagcaacagccugcccaccuacgaacaacugacugugccccagacaggcccugaugaggguuccugaaggagcucagaagggagguccaggguaaaccccccacaggucugccccaccucccucucaacaggggcacacccaccugguucucacccccuugaaggccugauaugacagccuagcucccuaaggccccgaaacccaugggccaagccacuggccuggaucuggauaucaccaacaccccucugcccagccagugggaacuagaacuugucugggcaugggguuccucucaggccccuaucaagauguugaugcugcucuucugauggcuggaacauagggauggggaguauauguguaaagcaggaugcagcucaggcagagggaagcccauccagguaugccaaguggcuuccuaaagggaaacaggaagagucugggguuuccacccucagcccugaauccagagaccaucagggaacgugcagggcaagacaggcccggcccacacuaacugcaggcuguagcccagugggagcucagcaggcuagagccugacuccuucauucucuagugauguugaccacaacaagauacuagcgggauuuucacaccccccccaaaggauaucccaagcaagggauuguccacuguccacccuagccagguauggacugacaacuucuccccuaaagugaaaagcagggcccucaagcccuaugagccccacaugugcagccugccuccuucuugcuggucagaggugcuggaccaaugcucagacuccagccucuuucacgccacauugaaguuaggggcaucaccgauucuuccaggauugguuccuugggcuugggcaccacgccucacagaaaucaagauaauuucuggugauucagacucuuguguuuuaaugaauuucguaguaugaucuugauugagagacuuuuccaaauaaaguugggacgucccagguugaucuuggcacaaugcuuacuucugagagagucugggggaucuuuagcacucaccuuccacccucugcccuacucuaccuuccugucuccuguugauccccacagacagucucaaucuuuucgugaacaggauccugcaguucccugggacccaggugcccaguggccacagagugagaaugauuuguugguccaugcagaaaaggcucaggccccaagggcucagaggaaccaugauaugugugaaagguugagccagugggcuugggguaucccuggggcuuccacuccaaguauaccugccuacucagugugaacaggauguaauuaccuccacauucccagaagacccugagcccuaaagguagcugagccugggucaggaucugacuaggcugguacacacugauauacgcacaggaagucacccucagacgugugcccgggacucucaucuguccuuuccagccaagauggcucucacuggugacacauucaagagugcuucuuuuccagggccagcucccaaggcccuaagacuuucacuucugaaauagaaguauacaaauaagugcugggguucuugggcucccuucaaagccccgguuucccuguugggauuaugauguuccucuggcuguccagucaguccucuaggcugcaggguuauucuaagugaauacugcccugaucaccuagcccuguggcuguuacucuuugugauccaucuacugagaauggaaacagagcccugugagcagggauuuccccagccaauguccacugucucuacugaucccauucuguccuccuuccaaggcccacccuauaugcuuggccaucagggccagaggcaucugugauuggaaggaugggggugcccuggucuuuggaggcagaagguagcaaucaguagaaucaaagagccaagugugagggugcagcuggaggccccuauaggaggggaaagccccccaaggcucucuuaccugaauuucuuagguagcagcucccuccacaaggucuuagugucgggucuaacaagcacuggccagcuuuugaagggaaggguggaaaggcagcugaggccucaggcuucccggccucaaccccccucaagggggguucugcagcaacaauugcuggaaggcagaagcuguuguuuccuuguuggguaaauauuuguggaagccccaggcuguggcuggcuauagccagggcccucaguauugcccaggcaggcuacagcccacugggagcugaaggccauccaucuggguaagacacggucccugcucccugccggccucggugccguguuauggacuguguagaguggccaagugcuguucucccgcaaggaccauugcagcccucucgggugugaaaugcaauuuaccugaaauaaagcccaauuauggaauuaccuaauuaaagccggggagaaggcugggccuggcaggccggacgcucaaugcccgccugaugcccauggucugaaggaacagauggugccccggccugccgagcuggccacauuccuucacucugucccccuauaagugaccuagacagcacacgaccaucuggugugugacacguccugcaggcccuggacaauggcccagcagaccucuccaugagagggccgucgcccgggcaacgguggcaugugcgggaaggcccauuugcagccccucccgaggcccuuucuucgggcccuuugugggccucuccuuggcucucuagcggcugggcugacaauacccauaaguauuuguccccagagcugugccuuuguccccuuaucgaggcccugguguccagugggugcuaggagcauuugcuagaagaccagcagggcuccaguuucaugggacugccucugccacugcccucccuugcucccuuucugcccugacuguaguucuggagcacugagcuugacccugcccagaucugaacaucucccaccucugagccugcauacagaggggagagaccccugccacccagcuauaaucuuucaccagcuacccgcccccugucugugacauaggacaguaaaaguguccuaucacaaagggcugauuaagaagagacaucuaagccaaagaagaagauacaaccauauacuuaaggcagcuggagaaaucuccuaggugggugaagcugguucuuccucccuccugcacuccugccugaucuucuagcucuaaaccccuugccugguccaccaguauccagccacaccccuuucuggccacaccccucagcaucaagccccaccucuuagcccugccuucucagagccaagcaagucucccaaaggcaggaagguagcuggguagucccucccaggaccacccugacucaacaccacaacaccacauagccaacccacuauuccugguauuuaagcagcuaugauuaccugaauauuccucccuccccugcaucuagcagcccccauacacauauacacacacaugcauacaugcaugcaugcaugcauacauacauacauacauacauacauacauaccacacacacacuugggacuucuagugugaugggcagguacaagaaugggacagagggaacagcuggcccaggaauuucccaaccccaacugagcucaagcaaaacuaguuaaaucaguggauaaaauaaaggcacugacuggccacagaggcaucuggacccugcagaggaacuaggcuucuaaccugaucuaggacacugcugucccggcuuuacucacucagccuccggagugcagguugguuaagaguucuugguguugacuagagaugcgucccuaagaaugaucuucuuuaauggaagguccaggaaaguugagcaauggauccuacuauccuuaucccuagcuucugggaucugcuccccucccaucaaagcucagaugcugguugaaauagcaaaugaaguucacuaggacacaagaugcuugcuuuccuggccaguccuucuaugaccugaguuugguucuguuaccugcccuccucucaguguucuugugaggcacuccaagguaccugggaucagcaaaguucuugucacauccccuccuacaguucccaugacacaucagggauucacacuccuuucaauuccccaugccugcggccccagagaacagguccuucuuaacucccagagcucagcccagccccuagucaucuguuuccaggacugggcucaaacagguccaggcagcagcuacucaacccaagagaacccaggccaccuggcugaugcucucauugccucugagauguagaguggaguguagggaagggggacaucaagacauacuggggaccaucgugacacucaaacuuucucacccuccuaaccccuccagcccuacuccagucacacccacagccucaucuuccugccaagccauaacagugaauagcagcuggguguccuucgggaauaagaaggaagcacugggaagaacagaugcccaggacagaagggccuucaaacaauaaggccccuccuccuggaacaugaggacaccaaggguagcaccuguaaguguaaagaaccauagcagauacuagcaaccguguugauguccaugaucugugcugccaccagcuacugugggcagggaggugucuauagacuuauaagcugggaaggagagacacugaagacauucugugccaaccucucaccaaaaaagaaauagucuggacauaaagcuauugaagaaagucaauaaugagcauuuaauaaagaugcugaaguguagcucuucacaguugaugguuucugugggggcggccagugggaguuugaccaggucccagugacuagauaugggcagcacaaguuggaccugagggguuuggggggcuuggguucuuuucuuuuuugaggggguguccaagggugggaaggaaggugggccugagaggaaugggaagugugaucagagugcauuauaugaaauucccaaauuaauaaacaacauauugggagagaaauaaagagccauggcagagaaguuagaugcuuagccuagaauccucaggacguggagagaugaaguggcugaggcagagcugccuucuagggucuugggaugucagagagaccaggcugaagaaaagauggagaacaguucucagguggccugagcagagaucucugucagcccacacaagcuagaagucacuauucaccaugccuuacagaggcagccacagcccuucagggcaugcccacugguuccaaguacgguagcaccuaccacacagaggucacuuggauccucaaaaugcaauuauauacugacaacuaaugagacuccccaaacaccauagaauucuuucugguuguuucauaaggcuuuauccucucuuaccaucaaacacacacacacacacacacacacacacacacacacacacacacacacacagacacacagacagagaggggggaagauauauagacagaggaaggggcaggcagaagcaugugagauagagcacuuucuggugaaauagccagauugagccucauccagugacaguucagacuuccagguaaguauggcacccaugucuaugcuaagacaucuugugucacagcccaggcacccuaagggucagaggaucugccaguggggccuggugcagaggaacauggagaacccacaucccauaauguagcucugaggaggcaugacugagaagacucgaaguuagaagugaucagccaggcuugggagcaaguucacacuagggaggguucuccaaggcaugagagugcuguggggcccaggagaggacaaaggagagagacucuagccucacucaucucucaggagccaagccuguccuggggauguuggaggcuccucggcaggggcuuccuugauagggcagugcccaaucauuauggguccugucugaagacuuguuccgguguacagaacaaggacaguuagucaaccugggucugcuccaaaccaggcuggcucagcagugaggcuccuagugcuguggugcccaaagcuaggccuauucuucuccagcucuccagcucaucaccauauggccuagacaaaccugcauggccugcucuauucaggaagcugauaccaccuuccaaaccuucaauagcugagaaccaguguuuauggacuuacagaaaaagaaagugaggcaccugugagcuuugccuggggagggaggcuugucacagccucuggaccaugcagaucuuuucguuguuuucagggacaagaaaaaucuaccaaguauauaggaagaaggguggcucagaaggcccauugucccaucuggccagaucuuuucguuguuuuaagggacaagaaaaaucuaccaaguauauaggaagaaggguggcucagaaggcccauugucccaucuggccuggccagauccuguggagccacuuaggagaguuggauaggagagucaaauaauugagugacucaacccaaaccacccaaaacaguggcuacacccuucagugugugugggggaugggggggagacagguacagcccaggaagugaggagggggagcccuuauggucaagggcuuugagcuuauaaagcauuugccacacauucccccauucccagccuccacaacucucacuggaugcuguuguggucacucuccauucaauaggcggagcaaggccauuuuaagaacaggauguaaacugaauaccuggaagaacucccugggucccuguagcccauccaggaaucucugcccuuugccaggauggaggucaggggcugacuggugaagcagguggcuuucauaugcugauagccuccaggcuacaggacacaggagacuaccuccacacagugucccucaaagcucugaaagcuggaaggcuaccucugauaccugaagucagcuccaaauagcaaaacaguuugccaacccacacaacaccccucaccucaggggcucugcccccugcucagccuuaaagucagcugacucugcagggguguguauacauaucuguaaaaucaaaacgggguuccuuugguuaaucugcuuggcucaauuagcacagaguucaagaaacgguucuaagagacuggaggaagccaugccucccucccauacaccacccagaccacgaauagcucugucaaagugcacagagagggcaauccucuagagcugcagcugcagaagggcaacagaagccaaucccacucccuuauccccagauacaaaucccucuaaccuccccucagccaccagccugggaacuguccucaaagcacucuaccauuccuguguguccuaaaugcaugcaagggcuucaguuaugcagcacccagcuggcccggcuuccagagagcccugccaaggccuggcacccuugccccgaguagucccucuugcugccaggagcagagaggccucaggucaccaccagcagauugcuuucuugcagcacucugggcccuguuccccagggagccagccuuaugagccauaaagucccgcggccuccagaauccaccugcagccauuccugcucuaggaaacugaaucccagcagcagaugacagccgaagguggcggggcagaaugcccauucagcccucagaggagccagccugccaacucggcaacugcuuccgcacguaggaccaguaccaccaaaacccuaaggaaauccuggggcccacaccaggagcagagaggaguaggauguauuucacccugagacccaggacaacagggagcaucgguaaagaaggcagcuaccuccagaacuucacagacagggcagcccagagcaggauuagggacuucccugcccugccccugccuugugcuaugaucuagaacuaaggcugggcccuuauccacaggccuaguuccucuggaauagagcugaaaagagcuaacucuacccaguguucaauucaccauccucccuaagugggcagaugaauggaggagaccuagcucaaaggcugcuuaccaguugggcaggaagcaggaggcuaaaagaacaggagauaaacacagacugaagccccugaggcacugcucaccaguugaggcaggccuggaugcugagaaggugcccuuucuccauuaccugcugggcugccccucuagcuagauuccacccccaagucccaggcucccagacugccucuccugaggauugggaaaacugggcuggcugccucuccucucagcucuucugugaggcugaugguccugcagccauaccuguccacucuagauacccugaaaagagaacccuguggguaagagguaggaagcagggacuugaaacccugggaagaacccagucaaggccuggcacccuguucucuaccuacugcaguccugacuugcccaaugccaccaccucagaccaaauugccccuuccuuccuucucuauuugccaaacuccugaccauccuacagaacugaacacaaagccuuccaauguggcucuagacucccugcuuucagcagauaucauccucuauagauaaaguaguauccucgaacagaugacagggauaguugacaaggagaacccuuggagaucaaggaaugcugacaugcaggaagccagcucaaacuggaugcaagaaccccugaagacaacuaccaaggggcuguggucacucacauccuugagcacaccagacuguuuucuggaggccugagaccuggcuggucaagaguaggaggugccuaguaugggcaaagaggaacuggcucucccuguucuccaccagcccuacugccaggaccauagcucuacuacacagagcaaagcccccuauaccauucccauauaggauccccugugugcucacaccccagggccccagacaccaaauacacccaggauccuuguuacacaaacuccacacccagcaagcauccaguucauuauuguuauuuugugugucauuauucagauguaagugcacacauauguuccggaugcacaauauguguauaugugugugagagccggaugucaaccuugaaugccguuccuuggucuguccacuauguuuuuuuuuuuuuucuuuuucagacagggucucacaugggccuggagccuaucaaguaggcuaggcuagggacugaagacaggucuucaugcucucaagacaaagacuuaaugacugagcuauuuccccaguucuuuaucaucgucauuuuuauuuauuaauuauucuacugcaaggccauguccagccuagucuaugauuuacuuuguuacuccccucccccccauucuccgccauccucccuuauggccucccucccauuguuucccagaguuucugcuucuauuuuccuaccaucagugcauacaugacuuuaugucaucucugaagucuaggacccacaaaggacacuugccacauuugucuuucugagacugacagcucacuugaugugauuggcuccuguugaauacauuuucuuucaaaccaccucacuucauucuuuucugcaacuaggggggaaaaaagucccauuguauauauaaaccaccuucucuguacucaggcaccuuuucucacauaccuaggcugcccccauaccucagccauuaugcauaaugccgugaugagcggcaacgugcagguagguaucuuggugauguguugacuuagaggccuuuggguaaauaaccaggaguguauaguugggucauauggaaaacccguuguuaguuuuuugacaaaccuucauacugauuucuagaguggcuggacuaguuucguuccccgccagcaguguaguguacaagggaacucuuuucuacagccuggccaguguuuguuauuguucuugaugacugccauucagaucagaccggagucagauggaaucccaauguagcuggaguaugcccacaugcaggacaccccaggaugucacucuucaugugccuguccacccugucuuucauugaccuaaagcuagcagaucaggcuaggauggcugggcccuguuuucaccuguccagugugggauuacaaacuugggcuaccuuuuuuaaaaaaaauggguucuggggauugaacucauaucuuuaugcaaauggagucaucuccccaacccuugagcgugccuuuuauuugcacuuccccgguaacuagugaaagcaagcaaugcuguguguguuauuagccauucguuccucgucccuuaagcacugaacgcucgcucauucuacuagucuguuccauugaguggcuucugcuuucacgguuagcuucuugaguucucuauagauaucaauccccacaaacaggagagucuuaaaccuugcugucacaggaugccuggggaugccccacaaggcaggucccccgccgcugccaggaccugcugacugggccuguccuggccaucucacccauguugaccaggccugaagcuauuuaucccuucauccaccuuagugucaggugccacucuccccacuccccaaucccaggcugcucucccagcuccucagggggcagggcuucuccagccugugcacacagacugaaaggccugggugggaguuccauggcuccaggcccagcgucucuucuccaccucacacucagcaagccucaggaugccaccuaucgccccucccccaucucugcaaugccaagauuacaaauaugggccacuauccuagcuucucccacccccaccuaacaugaguucaagagauagaacucacaucuucaugcaaacuaagccauuaucuuccccauccccacuguggguuuucuuugcacuucugaacaaaucuucagacguuuauaggcccacagguagggauggucccagacaucacugauaagagaaccacaaccccuuggcauaccuaugguucaaugccaggcugugccaggaacugccacgugcccauauacccucacaucucugaaca

SEQ ID NO: 30 - RNA, 339789 nt, Mus musculus
uguucagagaugugaggguauaugggcacguggcaguuccuggcacagccuggcauugaaccauagguaugccaagggguugugguucucuuaucagugaugucugggaccaucccuaccugugggccuauaaacgucugaagauuuguucagaagugcaaagaaaacccacaguggggauggggaagauaauggcuuaguuugcaugaagaugugaguucuaucucuugaacucauguuaggugggggugggagaagcuaggauaguggcccauauuuguaaucuuggcauugcagagaugggggaggggcgauagguggcauccugaggcuugcugagugugagguggagaagagacgcugggccuggagccauggaacucccacccaggccuuucagucugugugcacaggcuggagaagcccugcccccugaggagcugggagagcagccugggauuggggaguggggagaguggcaccugacacuaagguggaugaagggauaaauagcuucaggccuggucaacaugggugagauggccaggacaggcccagucagcagguccuggcagcggcgggggaccugccuuguggggcauccccaggcauccugugacagcaagguuuaagacucuccuguuuguggggauugauaucuauagagaacucaagaagcuaaccgugaaagcagaagccacucaauggaacagacuaguagaaugagcgagcguucagugcuuaagggacgaggaacgaauggcuaauaacacacacagcauugcuugcuuucacuaguuaccggggaagugcaaauaaaaggcacgcucaaggguuggggagaugacuccauuugcauaaagauaugaguucaauccccagaacccauuuuuuuuaaaaaagguagcccaaguuuguaaucccacacuggacaggugaaaacagggcccagccauccuagccugaucugcuagcuuuaggucaaugaaagacaggguggacaggcacaugaagagugacauccugggguguccugcaugugggcauacuccagcuacauugggauuccaucugacuccggucugaucugaauggcagucaucaagaacaauaacaaacacuggccaggcuguagaaaagaguucccuuguacacuacacugcuggcggggaacgaaacuaguccagccacucuagaaaucaguaugaagguuugucaaaaaacuaacaacggguuuuccauaugacccaacuauacacuccugguuauuuacccaaaggccucuaagucaacacaucaccaagauaccuaccugcacguugccgcucaucacggcauuaugcauaauggcugagguaugggggcagccuagguaugugagaaaaggugccugaguacagagaaggugguuuauauauacaaugggacuuuuuuccccccuaguugcagaaaagaaugaagugaggugguuugaaagaaaauguauucaacaggagccaaucacaucaagugagcugucagucucagaaagacaaauguggcaaguguccuuuguggguccuagacuucagagaugacauaaagucauguaugcacugaugguaggaaaauagaagcagaaacucugggaaacaaugggagggaggccauaagggaggauggcggagaaugggggggaggggaguaacaaaguaaaucauagacuaggcuggacauggccuugcaguagaauaauuaauaaauaaaaaugacgaugauaaagaacuggggaaauagcucagucauuaagucuuugucuugagagcaugaagaccugucuucagucccuagccuagccuacuugauaggcuccaggcccaugugagacccugucugaaaaagaaaaaaaaaaaaaacauaguggacagaccaaggaacggcauucaagguugacauccggcucucacacacauauacacauauugugcauccggaacauaugugugcacuuacaucugaauaaugacacacaaaauaacaauaaugaacuggaugcuugcuggguguggaguuuguguaacaaggauccuggguguauuuggugucuggggcccuggggugugagcacacaggggauccuauaugggaaugguauagggggcuuugcucuguguaguagagcuaugguccuggcaguagggcugguggagaacagggagagccaguuccucuuugcccauacuaggcaccuccuacucuugaccagccaggucucaggccuccagaaaacagucuggugugcucaaggaugugagugaccacagccccuugguaguugucuucagggguucuugcauccaguuugagcuggcuuccugcaugucagcauuccuugaucuccaaggguucuccuugucaacuaucccugucaucuguucgaggauacuacuuuaucuauagaggaugauaucugcugaaagcagggagucuagagccacauuggaaggcuuuguguucaguucuguaggauggucaggaguuuggcaaauagagaaggaaggaaggggcaauuuggucugaggugguggcauugggcaagucaggacugcaguagguagagaacagggugccaggccuugacuggguucuucccaggguuucaagucccugcuuccuaccucuuacccacaggguucucuuuucaggguaucuagaguggacagguauggcugcaggaccaucagccucacagaagagcugagaggagaggcagccagcccaguuuucccaauccucaggagaggcagucugggagccugggacuuggggguggaaucuagcuagaggggcagcccagcagguaauggagaaagggcaccuucucagcauccaggccugccucaacuggugagcagugccucaggggcuucagucuguguuuaucuccuguucuuuuagccuccugcuuccugcccaacugguaagcagccuuugagcuaggucuccuccauucaucugcccacuuagggaggauggugaauugaacacuggguagaguuagcucuuuucagcucuauuccagaggaacuaggccuguggauaagggcccagccuuaguucuagaucauagcacaaggcaggggcagggcagggaagucccuaauccugcucugggcugcccugucugugaaguucuggagguagcugccuucuuuaccgaugcucccuguuguccugggucucagggugaaauacauccuacuccucucugcuccuggugugggccccaggauuuccuuaggguuuuggugguacugguccuacgugcggaagcaguugccgaguuggcaggcuggcuccucugagggcugaaugggcauucugccccgccaccuucggcugucaucugcugcugggauucaguuuccuagagcaggaauggcugcagguggauucuggaggccgcgggacuuuauggcucauaaggcuggcucccuggggaacagggcccagagugcugcaagaaagcaaucugcugguggugaccugaggccucucugcuccuggcagcaagagggacuacucggggcaagggugccaggccuuggcagggcucucuggaagccgggccagcugggugcugcauaacugaagcccuugcaugcauuuaggacacacaggaaugguagagugcuuugaggacaguucccaggcugguggcugaggggagguuagagggauuuguaucuggggauaagggagugggauuggcuucuguugcccuucugcagcugcagcucuagaggauugcccucucugugcacuuugacagagcuauucguggucugggugguguaugggagggaggcauggcuuccuccagucucuuagaaccguuucuugaacucugugcuaauugagccaagcagauuaaccaaaggaaccccguuuugauuuuacagauauguauacacaccccugcagagucagcugacuuuaaggcugagcagggggcagagccccugaggugagggguguuguguggguuggcaaacuguuuugcuauuuggagcugacuucagguaucagagguagccuuccagcuuucagagcuuugagggacacuguguggagguagucuccuguguccuguagccuggaggcuaucagcauaugaaagccaccugcuucaccagucagccccugaccuccauccuggcaaagggcagagauuccuggaugggcuacagggacccagggaguucuuccagguauucaguuuacauccuguucuuaaaauggccuugcuccgccuauugaauggagagugaccacaacagcauccagugagaguuguggaggcugggaaugggggaauguguggcaaaugcuuuauaagcucaaagcccuugaccauaagggcucccccuccucacuuccugggcuguaccugucucccccccaucccccacacacacugaaggguguagccacuguuuugggugguuuggguugagucacucaauuauuugacucuccuauccaacucuccuaaguggcuccacaggaucuggccaggccagaugggacaaugggccuucugagccacccuucuuccuauauacuugguagauuuuucuugucccuuaaaacaacgaaaagaucuggccagaugggacaaugggccuucugagccacccuucuuccuauauacuugguagauuuuucuugucccugaaaacaacgaaaagaucugcaugguccagaggcugugacaagccucccuccccaggcaaagcucacaggugccucacuuucuuuuucuguaaguccauaaacacugguucucagcuauugaagguuuggaaggugguaucagcuuccugaauagagcaggccaugcagguuugucuaggccauauggugaugagcuggagagcuggagaagaauaggccuagcuuugggcaccacagcacuaggagccucacugcugagccagccugguuuggagcagacccagguugacuaacuguccuuguucuguacaccggaacaagucuucagacaggacccauaaugauugggcacugcccuaucaaggaagccccugccgaggagccuccaacauccccaggacaggcuuggcuccugagagaugagugaggcuagagucucucuccuuuguccucuccugggccccacagcacucucaugccuuggagaacccucccuagugugaacuugcucccaagccuggcugaucacuucuaacuucgagucuucucagucaugccuccucagagcuacauuaugggauguggguucuccauguuccucugcaccaggccccacuggcagauccucugacccuuagggugccugggcugugacacaagaugucuuagcauagacaugggugccauacuuaccuggaagucugaacugucacuggaugaggcucaaucuggcuauuucaccagaaagugcucuaucucacaugcuucugccugccccuuccucugucuauauaucuuccccccucucugucugugugucuguguguguguguguguguguguguguguguguguguguguguguguguguuugaugguaagagaggauaaagccuuaugaaacaaccagaaagaauucuaugguguuuggggagucucauuaguugucaguauauaauugcauuuugaggauccaagugaccucugugugguaggugcuaccguacuuggaaccagugggcaugcccugaagggcuguggcugccucuguaaggcauggugaauagugacuucuagcuugugugggcugacagagaucucugcucaggccaccugagaacuguucuccaucuuuucuucagccuggucucucugacaucccaagacccuagaaggcagcucugccucagccacuucaucucuccacguccugaggauucuaggcuaagcaucuaacuucucugccauggcucuuuauuucucucccaauauguuguuuauuaauuugggaauuucauauaaugcacucugaucacacuucccauuccucucaggcccaccuuccuucccacccuuggacacccccucaaaaaagaaaagaacccaagccccccaaaccccucagguccaacuugugcugcccauaucuagucacugggaccuggucaaacucccacuggccgcccccacagaaaccaucaacugugaagagcuacacuucagcaucuuuauuaaaugcucauuauugacuuucuucaauagcuuuauguccagacuauuucuuuuuuggugagagguuggcacagaaugucuucagugucucuccuucccagcuuauaagucuauagacaccucccugcccacaguagcugguggcagcacagaucauggacaucaacacgguugcuaguaucugcuaugguucuuuacacuuacaggugcuacccuugguguccucauguuccaggaggaggggccuuauuguuugaaggcccuucuguccugggcaucuguucuucccagugcuuccuucuuauucccgaaggacacccagcugcuauucacuguuauggcuuggcaggaagaugaggcugugggugugacuggaguagggcuggagggguuaggagggugagaaaguuugagugucacgaugguccccaguaugucuugaugucccccuucccuacacuccacucuacaucucagaggcaaugagagcaucagccagguggccuggguucucuuggguugaguagcugcugccuggaccuguuugagcccaguccuggaaacagaugacuaggggcugggcugagcucugggaguuaagaaggaccuguucucuggggccgcaggcauggggaauugaaaggagugugaaucccugaugugucaugggaacuguaggaggggaugugacaagaacuuugcugaucccagguaccuuggagugccucacaagaacacugagaggagggcagguaacagaaccaaacucaggucauagaaggacuggccaggaaagcaagcaucuuguguccuagugaacuucauuugcuauuucaaccagcaucugagcuuugaugggaggggagcagaucccagaagcuagggauaaggauaguaggauccauugcucaacuuuccuggaccuuccauuaaagaagaucauucuuagggacgcaucucuagucaacaccaagaacucuuaaccaaccugcacuccggaggcugagugaguaaagccgggacagcaguguccuagaucagguuagaagccuaguuccucugcaggguccagaugccucuguggccagucagugccuuuauuuuauccacugauuuaacuaguuuugcuugagcucaguugggguugggaaauuccugggccagcuguucccucugucccauucuuguaccugcccaucacacuagaagucccaagugugugugugguauguauguauguauguauguauguauguaugcaugcaugcaugcauguaugcauguguguguauauguguaugggggcugcuagaugcaggggagggaggaauauucagguaaucauagcugcuuaaauaccaggaauaguggguuggcuaugugguguugugguguugagucagggugguccugggagggacuacccagcuaccuuccugccuuugggagacuugcuuggcucugagaaggcagggcuaagagguggggcuugaugcugagggguguggccagaaagggguguggcuggauacugguggaccaggcaagggguuuagagcuagaagaucaggcaggagugcaggagggaggaagaaccagcuucacccaccuaggagauuucuccagcugccuuaaguauaugguuguaucuucuucuuuggcuuagaugucucuucuuaaucagcccuuugugauaggacacuuuuacuguccuaugucacagacagggggcggguagcuggugaaagauuauagcuggguggcaggggucucuccccucuguaugcaggcucagaggugggagauguucagaucugggcagggucaagcucagugcuccagaacuacagucagggcagaaagggagcaagggagggcaguggcagaggcagucccaugaaacuggagcccugcuggucuucuagcaaaugcuccuagcacccacuggacaccagggccucgauaaggggacaaaggcacagcucuggggacaaauacuuauggguauugucagcccagccgcuagagagccaaggagaggcccacaaagggcccgaagaaagggccucgggaggggcugcaaaugggccuucccgcacaugccaccguugcccgggcgacggcccucucauggagaggucugcugggccauuguccagggccugcaggacgugucacacaccagauggucgugugcugucuaggucacuuauagggggacagagugaaggaauguggccagcucggcaggccggggcaccaucuguuccuucagaccaugggcaucaggcgggcauugagcguccggccugccaggcccagccuucuccccggcuuuaauuagguaauuccauaauugggcuuuauuucagguaaauugcauuucacacccgagagggcugcaaugguccuugcgggagaacagcacuuggccacucuacacaguccauaacacggcaccgaggccggcagggagcagggaccgugucuuacccagauggauggccuucagcucccagugggcuguagccugccugggcaauacugagggcccuggcuauagccagccacagccuggggcuuccacaaauauuuacccaacaaggaaacaacagcuucugccuuccagcaauuguugcugcagaaccccccuugagggggguugaggccgggaagccugaggccucagcugccuuuccacccuucccuucaaaagcuggccagugcuuguuagacccgacacuaagaccuuguggagggagcugcuaccuaagaaauucagguaagagagccuuggggggcuuuccccuccuauaggggccuccagcugcacccucacacuuggcucuuugauucuacugauugcuaccuucugccuccaaagaccagggcacccccauccuuccaaucacagaugccucuggcccugauggccaagcauauagggugggccuuggaaggaggacagaaugggaucaguagagacaguggacauuggcuggggaaaucccugcucacagggcucuguuuccauucucaguagauggaucacaaagaguaacagccacagggcuaggugaucagggcaguauucacuuagaauaacccugcagccuagaggacugacuggacagccagaggaacaucauaaucccaacagggaaaccggggcuuugaagggagcccaagaaccccagcacuuauuuguauacuucuauuucagaagugaaagucuuagggccuugggagcuggcccuggaaaagaagcacucuugaaugugucaccagugagagccaucuuggcuggaaaggacagaugagagucccgggcacacgucugagggugacuuccugugcguauaucaguguguaccagccuagucagauccugacccaggcucagcuaccuuuagggcucagggucuucugggaauguggagguaauuacauccuguucacacugaguaggcagguauacuuggaguggaagccccagggauaccccaagcccacuggcucaaccuuucacacauaucaugguuccucugagcccuuggggccugagccuuuucugcauggaccaacaaaucauucucacucuguggccacugggcaccugggucccagggaacugcaggauccuguucacgaaaagauugagacugucuguggggaucaacaggagacaggaagguagaguagggcagaggguggaaggugagugcuaaagaucccccagacucucucagaaguaagcauugugccaagaucaaccugggacgucccaacuuuauuuggaaaagucucucaaucaagaucauacuacgaaauucauuaaaacacaagagucugaaucaccagaaauuaucuugauuucugugaggcguggugcccaagcccaaggaaccaauccuggaagaaucggugaugccccuaacuucaauguggcgugaaagaggcuggagucugagcauugguccagcaccucugaccagcaagaaggaggcaggcugcacauguggggcucauagggcuugagggcccugcuuuucacuuuaggggagaaguugucaguccauaccuggcuaggguggacaguggacaaucccuugcuugggauauccuuuggggggggugugaaaaucccgcuaguaucuuguuguggucaacaucacuagagaaugaaggagucaggcucuagccugcugagcucccacugggcuacagccugcaguuagugugggccgggccugucuugcccugcacguucccugauggucucuggauucagggcugaggguggaaaccccagacucuuccuguuucccuuuaggaagccacuuggcauaccuggaugggcuucccucugccugagcugcauccugcuuuacacauauacuccccaucccuauguuccagccaucagaagagcagcaucaacaucuugauaggggccugagaggaaccccaugcccagacaaguucuaguucccacuggcugggcagagggguguuggugauauccagauccaggccaguggcuuggcccauggguuucggggccuuagggagcuaggcugucauaucaggccuucaagggggugagaaccaggugggugugccccuguugagagggagguggggcagaccugugggggguuuacccuggaccucccuucugagcuccuucaggaacccucaucagggccugucuggggcacagucaguuguucguaggugggcaggcuguugcuggguaggaagagcucaggguugauggagccaccuucauugcuggcuacaacuugugaccugcuguugcagguuggaccaccuuguugcauggacagcagcugguggagcaugucugugaugaucaccagucucugguccaguugugucaccuguaaggacagaaacagagaugaaccuggugcuagagacagccuagugcaggccauauuagggccugggcauucaaagccugaaagagaguaugucacaugucuuuauagcuguggguugaauuuauguguguaccaugccuagaggcccuuggucacccucaugugcaucuguuauugggguacaggggguacaguauaguauugaguucuuguguguguccauacaugcauaaaccugggcgugcuuaacaguuaucucuuguuucuagguagaccuaguggcugagagucaccucuuagccccuucccgggccuuuuggucuuugagacucuggacaaaccuuauggagcuccuagaacagucucuggguuccuguggccaagaggugguagggcugguggcaugaugagugggaccccagagucccaagcuaucugcucagcuuggauggguuuggaaccuuacacagugcgggggggaggggagcuuugugggagggguuggcacccggagagagggauugggacagcucaggguugagcaggcagaggcugggugguuucaugaaauaauguccacccuuaaagguaacucaaagguacuacuuuaggacaacaccaccuuucuagguccccaugggucaggacagugacugaguagauuucuugacugugugguccuuaccccaugccuggaaagggcuuguuuugcucuaagcacuagguggguagcuaaggaacuggaggggagacaaaggcagggcagaaccugaguaggcccuugacagaggccacacuugcugugcuuguaggagacacaaugaagagccauuggagaacuccuuagaaagaaggagccauugugcaaggggcuggagcccagcccugggggccugaaaugcucagcuacuuccuuuucucuccuagaagaaaauacccacuguccagagaggccagagccccuagcauaauaaccuaggaagcagggcugucccaagggcagcugggagacucauggagggggcaggguuggggggauauacaggaaccuaccuagcagaagcaauagagcagggguugggagagagaggaccucagcugcugagcaccuggggugguuccuccagcaugcucugucaguacaucaggggucuuccucaugucuauauuuggaacuaguguaaagggaaugccugugaugcagggauggagccagagguucugacagauggcgucauauugucaaaccugcaaagcugcuuuagggaaaaccaugggaugacucagccaauugcugaccgcuggccucaaaaccugggugacuagagcccugaggacaagaggcaggcagggaauggaucccaucuuccuggacaagugugugucaugagugaagucugugucccaggcaggcuuuugaugcuuucuguacuggcuucucuguccuaauacuuguuuguagucugaaagggcuggauaggauuauccaggcuggagggcucacguggggaaacugaagccagggcuuaagaguacaggggguggaagcuaaagcuagguugauccuggcaggugaagccagaguccaugaccgguccaaggccuuggugaguucuguaccaaaggaggguugucugaggcuagucuuggucuagcuucaugcaacuuuaaacacacagcuaaucugaguaggcaggagaaaagcaucaguuggcucauggagauggauggcuucaugaauguuuccuaacccacaauugagcaccuguggacacaucucauuugcuaguggauagaguccuuaaggagaguucuugggaguggggguggggcuguuugaaaccuccuaugggacagcugccacagggucuaucaagccugugugugcuaaucaagggugucccugaagcuucccuggacauuucccaagcucacaaugaccccauggaucccacuugaaucaacugggguuuggaggagucuguguggguucaaagauaucguauuggccaaguugcuaggggcaggauaugggcuagagucuuaagagugucuagagucuaggaccucacugugccacugucaccuugacaggccuuugaagacagcaaacagugcaagggcuccuuugaaugugcccacuccuucaacucuccagucgccucagaguuugccuggauuucauggucauguguaggacccuucugggucuucuuggccauccauaggaucuuccuagcuugucuagcuacucauaaauagaaucucuugcuugcccuggcugucaugggugaggaacaguaaguuguggcugaguucuuaagcuuuucuggccuuguucagaccagauugccuaagccaacuuggauugaggugggaauaccagggcuuggguucaaggucuggaacauauuuaaccuggggaauccuugcuggugagcuuaggaccuucuguaggauugugagaggauagccuuugggggacauucauaggccacuuucaggggcuaucuuaaaaauguuugauacccaacaaagagccauuagaugccaaccuggcaacagaagggccugugggggaguuggccagcgggaugucuguacuucauuuaugcucuagccuggaucuugguagcuggccacggugcuugcuggcuaaucugucuagcaaagcuugggggucagggguugcccugugaggugggacugcacguggccaugcaugcuccuuguugccucugcuucccuagcugugaaguggaacaugcugcuguccacuggauguguugcacaaggagccuggggagauugccugccaugcuucuugccuugagggcagggcacaggguggucuuagcuuguucuucugggcucugcauccuuucuagccacuuaggcucccagaguagcauauagagaggcccuucaugcccaagcuugucuugggucuugcugggccacugcaggaaggguacuggccugguguaugguggcuccucugccuagaacucagcuccaaagacaacuuuuagugaguguucuugaagccaccuggcucuacuuucuccuuuuggcguuuggaauucagcuagagagcuugugagcauuggugcccagugccgaguaggugaaggcagggagccacgucacacaggugcccugagaggugccaccaccuucagggaagagaagaucugcucugggcucugggcuggugcucuucaagagccaccgggacagaucaguuuugaagaucucagaucucaucacuauuugcaauuugauagugauuaacagggcaaggcagacaaaagccuuguugugccccaucucugcucacuaaaggagaaaccauagaugacuucugugggccucagaagagaaaaaagcaauuagaauaacagcuaguuagagagccugcggcggcuggugaucagacucaaagcgacagggauuccuguuugaugugguuaugaacuuguuuucaaaggaaaaucuugaaaagucuuuuuuuuucagaaccugcccagccuugauccuuggucaguacccccccccccaaaccagcuuaaccuggggugggggauaccaggguguaaggcucugggauguauucaggcugggcauccuuguuggucaguucagggucaugagaggauggccuuuggugacuugagcgacauugguggguuaauuucagggccauauuaaaaauguuugauacccaaugaagagucauuggaugccaaccuggcccuagaagggccuguggggaguuggccagugggauguagagaaggcaggguacucagcaacccagagcccaguugggcugcucccuggcugggucaguugacccugcucccacuggccucuauuugugcaucuuaugaucaggcaacuaccgucuggauagaacacugccuggcagaacuugaugauuuucaguccuccucuaggcugccugcccaucccuuagucucugcucucucucuccucaucauucugacaccaccaccagaaagacuccucuuuaaccgucuaggcuaaguaugacccuacuuuuugcagaaggaaagaagucugccuaagguccuaugggagaaggaagagcuggggcaaaaguugggagucagguugcaagagagcaaugggcaguagaccuuuauuaaggccuuuauuauguauuggguaccagugcuccaguggguuuauacaugaugguccuuuccaaacacaaacaagcucacgcacaucucaggagguaguauuacaaguccucaucuuaaacacccacagagagggacugagagagcagguauguaguggagcuucuacaggucaucuccuugcaaacccuuugcuggccuucugcaauguaacuuuccuccugucucccagaaucccuucagcaggaggccagcaccccugacacagcugagcugcaccucaccaguucaucucgcccagcuaucuauccccaguucugggucucuuacaggagugucuacugguuggcucacuucaguggguuuaugcaugauaguccuuuguaaacacaaaacaucacggucuugcuggcccaaggagugccuuguaacuuacuuccauuuuccacgaaaccuuuucucuuucuuauucucuuguuuccaaaccuacugcuguuccucaaauguggcagcaugugccugucucagggcucuccacucuuggcuuuuucuuuccucugcugugucccugucagcucauagucauggguuccucaggguuccagcugucuuuuguuagucaccuguuucucucauuggaacugggcccugucaguugcgggucucugcacacacuugcuauaguacucuuuuaaguucaugaaaggacgcagccagugcuagacaugugagcaccaucauuccagagucuaagugugaggggaaggagugcugcccacagggcccauccucacccaacaugcaucugcauggugagaccaugaagaacucccaugaauuguacacggucaguuggagcuugugaaggcuggucuuguggacugcaugugagcucacauuaggugcggugaccaagagaggcugugcuuacaguuaccguauuuaugacuuugcuuuagcgcuccagcuuuuguagaaaagccugcaugcuggaucucuggcugacaggauggccuucagucuuuggcucccaguauccacaggguacauggcugagcauaccugagaauccaggcaggggccaaacuggaagcuuccaggccauguagaacauugacuuuuuguaccaaucccagggccuccaguuaauaaagcaaugucuucaaccucaguuauucauuuuacaaaggucaaaaaggccaggcguggugguacacaccagaaucccagcagaggugaucgaaucucugugaguucaaggccagccagggugaugauauaaagagacacugucucuaaggaaaaaaaaaagucaagaaauaacaacuugacuucuggucuuguuuaugcagauaaacaccugccacagccagcuuaccagauacauuauuuauuccaacaaaugaauauuccugauuaucagcaacacuagagugaauucaucagccacaccagaugggacaugacacuaaaaagagcacccuaagacugagaugugguaggaaccccuacuauucacccagccaguuacuccucaagagccuccucacacaagagaauuagucccugggcuuugucuaggauacuuagcuuacuuuauauguacuuuggaggugcuuugucauguagaccugcacccaaauagccuacacacacacacacacacacacacacacacacacccacacaaguacucauauaaauccagccucuuccaaccucugcggacagggcguggcuaggccugccuucucaccucugacccaggugccuguguuccucuccucuccucugcuuugcucuaggcagcauuggcugaccuuugugcuuaguucugugccuuuucucagauuucccacuacacgagugaaugcccucucucuuugcagcccuccuccaacccuucccucacacagauccugaacacauccuccauuuaccugaggaccuuugcacucacuggccccuuugccuggaaaccccacucuacacuucuuuguggacuuucaacucaaaugccuauugcuuuagcaaaugcuucugccuaucccgcuuccccuagcauacucugugaccacugccucuccacagacuuccugaguuuauuaauuuacuaguuuacuguuucuucuucaaacuugaggcuccugagaucagguccugagugugccauuccuguugagucccuauuauuagggacuuuuauuauuaggaucuuuuaauguaugacacacaguaggugcuuaguaaacucaugugauccaguacaaauauuuguggagggaguuaauuaaucucuggccuuucucuuggaugaggggguggaagcccccaagagcccugcucccuagaaagaccugggcaaaggccaaugagguuagccagcaaguccuuucauguucauugauuuguaaaggcucuuuguaugugaaggcuuaucuuuugacauguagaucacaaguguuuucucuugcaugcauuugguuugugucugcaaugauggugaccauugcuuuuccaaauagaaguaccauuuuuuuuuuuucuccaugguuuccaagucagggugugcuuggaucacucuucuucaguccaaugugaauuuuuugggugcuuuuuagguuugcauuuuaccccuaaaucuuuuaugugugugugguugcuucaggguucccuguagcagcugauccuucacauagugggggggggguguuuucuacauacaaagcucucagcacauaugagaguucuagaguucacuauaaacagcucccuucuauccuggcuuucacuauguaaaccaagccagccugacacuuaugaucccccugccucagucucccaagccugugaccacacacuuggcuuccagcuuuaauccuuggggcuuugguaugggaggccaggaguguccuuuacagggcugcagguggugguucugugguggaaucuugcagggugaugagagcaauacuucccucccagucaacccuguugacuuugcuccugacucccuaacuugagcugggagccuuugucaccucucccauaugauccuauugggcugccucccuucugcuucuucugcuaccacugaagucacccuugguguucaugugacucacccuucacccugucuucagacugugcuggcucacacagaugcacaguuaauaucccagggcuagcaucauguggccucaagguacagaacacagggccaucuccucccuccuagcuaccccuguugcuuggaacugcccaccccauaguuucccugcucugugugaacugauaucagcuuuggggacaaaggucccagagcagagcaguggcaggugugggguccuauagccccuagcuucugacaauacuggaggccucugccugccagugaagguuggggggaggggaccuaggcucagaauggggacuccacccuuuccaaaagaccagccaguucucaucagccucaaaggguccuguuugcagaggcagcucccugucagggugacuaggaagcugcugcucugucugcucauuucuccccccaugggcagauucuauagcagcugcucaggcuggacguucuucuagacaggcugaaaaaggacucuggaggcugagaggcccuguuugugcuggcgucaggcacaggccccaccggcauuggauucucuccugauggagucccggaagcuugagaacuccagacagaacauguuguaccagaggccagagccuuuggccaaacuaggugggcaauggugguagguagagaggggucacaugggguucaagcaguugaucagggcugcucaccugggccugcacuauaccccgugucccaagcaaacacaagccggucuguggcugcuguuaaaggggcuucagcuccuuuuuccuguuccagccucccuagaccugcagcuuguucugucugccccuuuguucacauccaccucugccagccgcucugggagcuaucugcugaugugaacacuggugagcuguucucagcccagcccuucacacguauacacauauccgaccagcuaaccuguucacaugacacacauuuucuccgaccccucaggagccaggugggggaaagaaauguucaacuucuuggcuuuugcuuucucucuccuuuggcgcccuugcuucuuggugaaaaaccuuacugggacucuucuuuuuuuuaaauuuaauuuaauuuuauuauuuuauuauuuuuuuuugaaacaggguuucucuguguagccauggcuguccuagaacucacucuauagaccaggcuggccucgaacucagaaaucugccugccucugccugccaagugcugggauuaaaggcaugcgccaccacugcccguuacugggacucuugacuauggccggcguccauucccacggccacacggacuggggccugcuuugccugggugcugcugggagcguacucucuguggauagucugacuuaguucauccuagaucuucccacaaagugcuucuuuguugaacauuuccaagugccaucuugucauagacagagccccaguuuuuugcuuccauccgagguuuucccugguaccuggugcaucucaagggccucucaggguacagggggucuagcccucuucuggucugaacacugucacuccauacccuuuuacuguaagagugcuucccuggcccaccaauaucggcuacaccuacauccuuguauuuccuuuauaccucccuuagcccaggacuacccuugaaauggaccuuugcaacagcugugcaugccccacugauacuugaguaucuguguauacaaggcuugacaguuaauggcuucuuuccuugcccuauccuagaaacaaccaggagcacugggagcuuggucccccaugucccuuaguguccccuggaugcuggauuucauggcugucagcuuucauuauggucucuacaagguuguguggaucuacaugcucucuauaguaaccuauucuguaaaauaaagacauucaaugcugccucccuuccucuccuuggggccuccuguaccaggugcuuggcuagcgacaggguguuuacccugccuagcuccggcaugagacacuguaucccuccguggcaguuuugacaucagcaguaauacgauccagguguggcgguccacuugcuuguuuuugcucaacucaggcuuugagggcgcugguuagaacaugccaagggcgcuugcuucucgggguggcuguacgugccgugggccucccugaaaggacccgcugggaucccaugcuggacaagaggacccaggggacaaccguagcccaugaacgcccuggaccuacagcaugccugaaguagacccuucuacugaaggaugacaugcuaguaucaagagcuguacccccagugaccccuucacuugccucuggcucccacugcccuuagcccuccauagcuccuaagcaucugccccugcuccagguuuucuaccuaugaccuggucucccugggauacgccuucugggcaaggcuuccugauucccaguuacuggcuccuuacagacuauucucuuuccagauuacuuccuggcuuccuuucccuuaucucccacuuugaaucuggggccuuuagaggaugccuucuguaucucauggcccacccaaucuacccagacuuuggccuucucuucaacauaagugaucuucaagacuuccaaccuggguguuccuuugcccuccugccugauacaaaucacugugccuuauucucuauugccacucuauagagauggcuguagcuauuuuaucuuaggugcucucacccuucccugacuguuggccuucaugcuccuuauaacucuuaaccuagagugacuucugacugaccccagucagcuggcuccuggucuucugggacccuccaggcccucuacaccugcugaacuuuaaggaguucccuucaccccucccucaaggacucagcgccacuuucaguaagcucucaacacaggaugagauacaagacccacaggacgagauacaagaaucauaggcuagaaugaucuagaacuuugcugguagggggacuaacugaagagccuggccuauccguguguacuguguaugcacacaccuguggcugugggcauggcacugggcacaggcucuauggagcugaguguggcuaugugcuagaagccaggaaacugggaguugcuucuggaaggcagauaaccuguuggcagcagaguuuugagcagcuaggcagcaaguuuugagguaaaggugagcaauauccagcugaugucccaagcccuuuaagcugugccugcccuccuggggccugaacauccugccucacggcuguucagacucugucccagucuggagauugaaggggccccaugacucagccagucagucauccaagcugcagcuguggcugacccaggugggcaggcagcccccagcccagccugcagaaacgggauggggcccgcucccuccccuacuuccugcuucuacucugagacaggauuuucugaagucaggaccccugaggccagagugaggcuggaagcuaggcccagggcugcagaugggggcuggguagcuaggccuagaaacuagaaucuugugucucuccuggcacgggaaauucguggggucacagaguuagaauguuucuaacuacucaauauauugacuccugccuggcagcuagguuaggccuaguauucugcuuggaguagaggccuggcuggagcauagggguacuuacuuacuuagggacaggacaaggcuucccauacugcuuccucugguccucugugccucagaacucaguucucguccuuacuccuuucaacacaggguguccuaccuccacauacacagucuugggacagaaauuucaguaucucauagguaggcucagccuuuccucuguugacugggagaaccugauggagaagcaagguugggcuccaauggagcuggcagugaacaagguuuagagggugacauaugaauaaaggaagcugagauuccauguccuuuuucuggcccuccagugacugggaacaaaagggcugccagcucuccuggcuuucaucuuuccacauucagcaaugauguuucacuuuauacuagccacagcaccucaccacuggccacccuuccccuauuacucugucuucugugcucagcucuggugucugggcugccuccucauugugacacuggguauuccuucuccaugaccugucauauggacacaaggcucugaggucacccaucaggugcccugugcugguccucacauggcugaucagaguguguagggcuaagcucuggcugccucuggucucugauggccuguucaggaaguggguaagaagaguuggaccagcaggaaguuguuggggcuucaagcuaggccccagugcuccagcccauuuagacauauuuggcagguucucuucccuauguucccaggcucaucagaauggacacuaucuagccuauuaccugcuaccugcccacuuugugaugcucccaaugccucgggccacccugcuaugguuacaguggcauuacugauccccagcucagguucaggcccuugggauuguccaucuccaacuuccgugacaggcacugcagggcagacugaggugccaaagguauuggauguaaggggagugaaccugcucuuugacucugggcuacucacuggccuucuguaaccucaguggggacccuaguggguguaguuauggacccuagcccccuggcugguagaucaagucccuccaugaccagauugccguggaucugggugacccauguugcacuggucaucucugcuuaagucuuaacucaaccccugaguagcaggcaucacuggauuugauccuggcccugcuggcuuuucugagauuuagcuccuguaucagccuugacuauaguggcaaggcccaggcauugcccacccagcuaauccuccuagcuucucagggcccugaaggaggugccuccaacagauguccuaucucuggagguggugguaggcauugcugucauuuucuuucccuuucuggugacaguccuucccuaagcauccuguacuaagcagcgauaagagggauuugcacuggggguggaauggaggggggguugggggacucauguacaguguaggugacagguaccaccuuuccuugcaccaauaggaacucuuauuuucacuguaguccaggguccacaucacagucaugucccagcccccaacucuggcaauggccuucugccaccuuggagauugcucugaccuguaaccccccaagcucauccugcagccaaagacagacauuuaucuugcugcuaggagccuuuacucugauguugggcacugugggauguugagcagcucgggcuagugauccugaagaaggaccuuccugaaagcugcuguuacuguggcuuuacacauacuauccuguaguggcucuccuguguucuuggcagaagcuggugggcaggguugagcuguagagggggacaucacagauacucugugcagaaaaguaucugguagacuuugagauuuaccuuguaaauaaggccagagcccugacugccucauuccuacagagaacuggacaucucguauaccccacuaaauucuuguucugcucaugccaugccuagaauugcauguggggugcucucuggggcccaaggaugagggcaaacagguuguggggcccucaggaaggucuauaauucucagaagguaagccaaaagguagagaaacuuccaccuaggaaaaagguucugguuggcccugggcccgccugaccuggccugaccccuucagcugaugagggacucaggccuauccugcaguucccagcccgcccuuccugugcuuggggcugggaggaagaacucacccgggacaccagggaucggguaaggggcacauguugacaagcugggugugguucacaggccccaggaagccccagucacccuggucuucaaguucuuauuaugagcccgguuuuuggagccuuggaaaccauccaaaguaaccuucaggacugcuuccggaggaaccugggucccucuaucaccucugguuaaaggaugggacaccugucagcugacugucuucucuuaguacugaccuaucccgcaugaccacagaccuauuuauuccucccaaccagggucuaauugacccagacacugcaugcaggacagagcuucagacugguuugcccuucaucuccugccaucccagacccuaacaugcccucaucuuuuccuucugagucacagcucccuguuggacccucucuucuuucucaccaggccaccagcagaagugucuauuuucuggcacuaauauucccuucccugcaguuuagaaguuucuugucaauguuauauaagcaugccagaagcucuuccaucucugaauagcccuugcugggguuacaucuccaguccucaacaguucccagaggaaagucuucaacuaucuuagcuguuuuuccugccauauuucuugacacucuguuucuuguucuuguaguuuuaggcauugucuagugauggucauggaagacgagccaucaaaauuuugucccacagcuuccuccucagcaguccuucuguguaguuauaccacaguccuaggcuaaauguuuagcauuugcauuccaacgaaacauguagcuuuaaaagacugcuguguaaauacuauguucacaggguccuucugugauaacaguuuucuguuuucucuguaguuaaggcucuuuccuuccaucacauagguucuagagaucaaauuuagauugucaagcuugguagcaagugccuuuaccugcuaagacaccuugcuuauccuuuacuuuaaaaauauuuuaaaagaguuuauuuuuauuuauguauguguguguauaugccauguguguucucauggaggccuauggaggucagaagaagguguucgaucuccuggaccuggguuacaggugguugugaacugccugaugugggagcugagaauugaacucagguccucuacaagggcagugaguguacuuaauuucugagccauagcuucagccccagagaauucauauuuuaaaaucuuuguucagcuauuguuuuuuucauugcugggggucaaacccagguuuuguacauauuaggcaagcccuuuaccacugugacacaccccuaguccuuuucuacaucugccaccaauccauucuuuaacuuucugcaagaauuaugacauuuuucuauugauccuguugggaauacugauaaugaaucagcaccccucccuuucuuucuccuuccccuccucuuucuguuggaguccuugcagggcuuguuucuuuccaguuuuuaggugugauuguucucccuggcccucagcuucugcguucuugucuguuuuaccucucacuuugcaggagcacauucccaggucauuuucugagaaaagguauauggcagauauauauauauauauauauauauauauauauauacauacacauacauacauauauauauauuuuguguguguguguguguugugcaucuuggcaaauaucuuuauucuucaguuauacuugggauuuuagauuggaaaucaccccgcccucccacccccaaaguuugaaguuaguguacuagcaugcgcuugcucauuuccugauguuuugauucuccauuuucuguguaugaccuauauucuucucucaggagacuuaggaugucuguuuuauuucuguucugaaacaauaauggaacccagugggacauucuagaaguuggcuuuuucagcuucaaaguguucagcuccacccacagcuguuccuaguaucgucacguucagagccgaaaggaucagcuucuuuacaguguagugugguugggugggggucagcaaguaccucgggucaugggcuggggggagagugacggagugcuuuccacucaggcugagcuucuguagguguuuucuuuucauggcucugcccuuaggaugguauaaaguucuucuaggaucccagcuaguagcuacuucaucuuuaaugguagcucugccuggggaaggccgaucucuaguucucauuucuaugguugucucugcuaauagaucuauaucuacuuuuccaaacuuuuggggucucuuaugcucuucucaugucuuuacuugcuaacuuauacaaguaauuuccuccuuugguaauucuacugccauuuuucuuguggguuuugaggaaguagagaugaauuuuagcugaaucacaaggucuucugugaucucagcuuugugucuucccuggaguuaagacucgccuuuggguuuuucccuuuucauccucagacucuaaagaggcaaauuuccugggucuuuuaucuccagguuggcuaccaccaccuccuccuaggucuucugaguccugcccucauaccuuugcugauggcuucaccacgccaaacuuuaaugccucuauacaacagugaugccagucugcacccucaaggcucccugggucacaaaguugccggugucugaccucaccacuuaggaaucugagaggcucuuaacuuugaccuauccuaagcugagcucugcagauugccugucagucuugucuuuaucccagggaaucaggccugcugagccugucucuuaagacucagacugagcccccaagggucuaugaacuccuugcucucuuuccaacacccaguuccuaucagaauucuuucccucugaaacacauggguuugcucucagacaaagacaaagcacuuccuccuuuagcaaaagaaccuugaauuagccacuuaauucacuaggggguccguguagugguacacugcccucuggucauuggacagaagaaaagcuaacaggggccucucagguaaccaggcuguguggggagggagguuguucuucagguauuuuccuucuuccugcuacugaaaugcagaggugauggcaacccugggagaagccauaggggugccacuuuguagacagagaagcauccagagagcagaggcgauuccuggucugacugcugcucuaggccccuggaagcucuuaacugagacaccacagucaucaucucagccaaagcucaaccaaucugcacugcccuccucacagcauggccgaugcucugcuugcuccuugagaccuagcacauucuacuccuagcuugacauauccacauauaaguuaccucugagcuguguuuuaagccacaugacuagcucugagugaccacaaagcccagaauccuuaggaugcagcucccaugccacccacugcuuggugguacccacccugccucuuucucccuggccuuaaggcuugccacaagaacacugugcccuaccucagugggucuggcuguaaccauguggugccagugggcugagaauaccaguaggaagggguuguggguuccucuagagcaggcagagauccagcuaagcuggggggaggcugaggaccuagugaugccugcugccccaggccugguccuuuuugagccuuauugggccccaaacaagcacgguauuuccuaugacagcuguaggcuugcaggugagccuuguggaagcaggggcaggagcgggagaaagggcugagaugcuggcugggugaacugacagcccgcccaaguuuccacaacugucugcacagagcugcacggugguuuccacaggcucugccaaguggcggcugccggcucggccugggguucugacccccgacagggccugcucucugccaggcagcccugagaagcuagggcagacagggcccaaagaguuaagccacccuccaccccaucucauuccuacaguuuucuguccaaggcacagcugacgugaaaaacaauagcauucccuuggagagguucggcugcgggcugaggccccccuccccaauaauuacucaagacauuggcacgagccaggccugguuagguaacaggcugcucgcucgcuccggagacuuauaacucacagucaguuacacauaaucucuguagacaacaaaaucguuuccaggaugguggggagggugaggccuuguggagaggguacagggggcagaaggggcagagaccaggguaagguggggguaggguguuauuguggggacuaccaggagucucagggaugcagcuagggaacucgggguguugaugaagcaacuaugguaagggagggaguugcccugccuccucucuacaauacuccccacccuuguccuaguccuuggaaaugggaggccacccuagucuggucugcuauugagcagagcuccagaggcgcucauucauacuggagugugaaugacugcuuugggugcuuccuccuccucuccugacagccucacagaggacaauuuauugccuguuuacuguccauggcucacuguacaugacuuccucaagggcagggccacauacugcacccccugccucuccccacuccccguguucccagaguacauagcagacauucaggaaauaucugccaagaacaacggaggacaucuaacccgaagaaagcaagcguccgugggguggagucaggcacaugggaggggugccugacagggaggguagcggagcuguaggugcucugucacccuucagggcucauucuccuggcacugggacucuuccacaggaaacccgcccauuuuccuggaaggaugcugagcuaagcaggcaaggaucgggaagguuugugucuggaaggaccucccucagccucccucuggcaacugggcagcugagucaggccacugaaagcugggauaguaugagggaagagucuagcucaugucuaaucuaaaccuagccugggacugggcuuaguagggauuggggagggagcuucccuccuuccuucuguauaucucuggauuuuucaucccuucaugacugagucucugaguacaaagacacccgugggcacaugaguugagcacaccacugcuuucuuugcaaaccagccuuuggaggcagacuugaccugcugaccucagguucccugucuaguccuucagaccuuguucaucuguuguucuucacucagcucagaagacccagcggacaggcagcauggcucuugucaugucccaugugggccaaaugaaugugguaccaagagggaacccaguggguacucaguccuugcuuuccugccucuucuuugaagucccugagacuucugggaugcaagagcuccuggacuuuuucugccuacccucuagucuccuguaugagcucaguccucucaucgcccacgcacacuacucucuauagccucuugucaagugaccuugaccacaucccuuuguaggguccccuucauggcagcaguccucuagcacccacuuuuagcaucucugaaccucauagccuaacuucucaguucacagcugaguagacacauauccauguggguaccucaucuguuccagcucucagcucccagucacacggcaagcagaacagagccccuuucaaccuccauccuugccucccuucuccuauagaacccucuuacaagcacuaccccacugaccuucgauuuauuaguuuuccugucauauuucuuaacucucuguauccugcucuuggcaaucuuaggcacuaucuagugacagucaugggagacgagccaccaacauuuugucccacagcuuccuccucagcaguccuucuguguaguaacaccacaguccuaguccaaauguuuagcacuugcauuccaaagaaacauguagcucuaaaaguguaaauacuauguucacaggguccuucugugauaacaguuuucuguuuucucuguaguuaaggguugccuuuggguuugccuuagcuuuuuuuuuuuaaacacuuauuuaauuaauuaucuuuaaaagauuuuuauuauuauuuuaauuauguguccgugugucucugagcaugugagugaaugugcaugugaguguaugugcaugugaguguaugugaguguauaggcaugugaguguaugugcuuucagaggccaaagacauuagacaccucuugagcuaaaguuauauguguugugagucaucugacauaggugcugggaauugagcgcugucugaguaguagaugcucuuaaccuaugaagccaccuugccaaguccuuguuuaccuauuucccuguguauguguaugugcaugugugugaagguuggagguuaauuuguaugaguguaguuucuucuuuauauauauauauauauuuuuaauuagguauuuuccucauuuauauuuccaaugcuaucccaaaagucccccauacucuccccccacuccccuacccacccacucccacuuuuuggcccuggcauuccccuguacuggggcauauaaaguuugcauguccaaugggccucucuuuccagugaugaccgacuaggccaucuuuugauacauaugcagcuagaaucaagagcuccgggguacugguuaguucauaauguuguuccaccuauaggguugcagaucccaguuucuucuuauaccaucuagguucugaggaccaaauccagguuuucagacuugguggugagcgccuuuaccugccuggccaucuugccagcuggggaaucgacuucacugggaaagaaucauaugcacacaugaaggagccuguuuaugagaaagacuacauuugugugggucugcauucugcguauauaugugugugauugcuuauacaggcaugguucugugugccagguguguccaugugugcaacugcauguaccauccaagggauguauacuucucucaguaacaggcucuucuuucucucaguguucucuugggcagccccucugccucgggugugggcugcagccuugcccaaccuugcucuacagaggaucuguauuuucuagagaaacuuguaaggaaaggcaugaaaagcaaauccuaugaauuaguaagugucuucuugcccuucacagauacuuuggcugggcauagaauucucucuucagacuuuuguaaauauugagagauccauggacugguaccucacuugccaucucugagaugguccugugguauuaucuuugucccagucucucuggaaggacagacugccacgaggggugcucuuccuagauggggcuuuuaggaggcuuuuccuucuauuuccuuuuuuuuuuguauaugcauaugugccugagccuaugcauguauaguacauguguagugcuguacagaggggguauuggauccucuagaacuggaguuucuggcaucugagauccuccacaugggugcugggaauggaaccugucaucugcaagaauagcaagagcacuuagcuacugagcuaucucucuagccccgugucccaugcucuccccggaacuucuagcuaucaaguaaguaaggguagggguucagggagucauuuuggggagauuuacuucaaccuugcucugaguauuuaauaguguguguguauguguguguguguguauguauauguguguauguauguguguguauguguguguauauguguguguguguauguguguguguguguauuuguguguguuuuuaaugauugcauugaguccaaagggcccucuaccucugccucccugcuacugggauuauaaguauuugaaaccaugccuuguuuuuauuuuuauuuuuaacauugguucuaggauugaacucaaguccuuauauuuguguugcaagagccuuacugucuccugagccuuccuuguucauggauuuuuuugugaguauaacuuuuuguuuucucuggggcuaaaaguugccugugaguuuuucuuuucuuuuaaaaauauauuuauuuauugaguguuuaugcuucuugguuaauuuucuuaauuucucauuuuuaaucccauuuugggggaagauuuacuucaaacuugaucugaauauuuaacaguauguguguguuuaaugauugcauagccuuaaaacagaaggauccuauaugcacccuuaacaccuacauuucccugcuuucugguauccaugugcugagguuagccccugccuaguguuuugccuucccuaaccccauucagccuuugacuuccugucaguucaagcuaggccccuuccuuccugugccagggucuuuacguaugcuacacauucugccuagaggucuuguuucaucucuguacucggcuuagcccauuugccugcaucuuugguauauagcucauggcguucguuagguaccucuguuaacuuccucgcugguuuagcagcccaucugacauucccauagcucuuuauagugcacguacaugugcucacgcacucgcgcgcgcgcgcacacacauacacacacacacacacacacauauauguacauauaugauuccugcugcggugacuaguagcugcuugguacugcugagcucucuaguccucugcuguggcccaggcuccugucauugucucacucuuuuguuuccuuaacaagucacuaaagccuuaggggcauauaccuugauuuuccugucugggaggucugcaguuugauaauugcagggcugacugcuuccugagaggucuggggcaaguguuuucuggcccuuucagcauccagaauggccugacuccuuggcucauggcucuuccucuauuucuaagcuaguagcccacaguuccucccucuuuggacucugcucuagcacccaucucuuauaccuacugcccccucaaguagggaccccuuguaaugauagcuaugaccaucuaagccucagcaggcuuuccaucuucugauuagcuguguucacgcccuacacagguuugcauauacuguuccugcugcaccuaugacacagcuagggaaugaggagguaggauuuacauagaaagcccacccuguagccacaacagugccaaaggaaagaguucacucagucuugauccagaugcagagagguuacaaugucugugccacccagagugccaagagccccauccaggaagagaacucagaaggacuggcugagcaggaauuguucugauguccuuagagagaugcaaaggucaggcauaauuggagcccagagccuaaggaccuccccugcuucuaugauggcuaaaagaggccccagagauauccaggugcagaacggcuguaaacaugugaguacugauggacagggagccaagaagccucaggcaaugaagagaaguucaagggaguagagacugagugugcagaccucaugguggguggggaagggaaucuuccagaagcggagggggaggggggaaaaggacagggugucuggagcuugaaggggaagaagaaaaucaaagaaaccaauaaaucaaggaauccaccacacuccugagaauuuucacacccauaccugagaaaccaccacuacaggggaaggcaaacagguaaauaagcucagaaaggaagucaggcgcugggugacucaugacaaguugaacuccugacagaguccacugccucccguguacaucagaaggucacagaggcagcucugggcauccaaggaaaauuccauaaacuuaaaaaaaaaaaaggaaaaagaaagaaaauuugaacauugauauaaaauuggaaaguagccaccaacagacacacugggcauucaaaaguaacccccuaacaaucccaugcuuaaaaaaggaaaugaaaugggaggcacgucaguuuacagacaggcucacgaugacagcgugacguagcagcagaaugugcgugaugcagucaaagggacauuuagaggaaugcucacagccaugucagaggaacagagggacuaaaaaagagugugcccaggcuuuacucaggaaucuaaaagagaacaggcccagcaacaaaugccgagaaagaacaaagaaauaauugaccaagaugcaggagaauacuagcaaaauggagaaaaauucugauggcagaaucauugaggaaaguaaauccuagcuguuagaauggccaaugaaauaaacauuaagcaaguaagauaacaaauuaaaaacucaaaggcaguaacaacuacagauaccuauggaggugucuauuugcuacuguugugaaacacuguuuuugaguccaggucuuguuuggcagcccagucuagucuugagucccugaucuuccuucuucacuuucccagugcugagaucagagaugcaccaccaaaccuaguacugauagaaauuuuauagcaauacaauugaaaacuuaaaaugauagauaaauuucaggauaaaaaauugguaaacaugguuuucgaaguagaaaaucuuaauacacauaaggaugccgaagagaucaggguuauaccaucuacucaccucuagaauguucuuggaccagauuuuacaaugauuuuuaggauguuuuuaaaaagcagaucacaccuguacaaugugcuucagggcccaggcuaagccagaaagcauuuaacuuaaaaccagagcuggguacagaagcacaagaaaauucuaaauuuaaaugaugucuugugggggagccuaggacaugagggugcuugagcaauguuggccggacagaggucaaaggcuggaugaaugccagguaaagacaccccagacccuucagggccaaacuucucuggccaauguccaguuggucuuuaaaaggauaggucugacccaacccagcuggagcugaguaugacuggugugccguuucucuagaaccaauaacuuccguggagucugucagaucccucgggcuaccuccuuccacagugguaagugugacaucauucugcaggccugggucaguggaauagcugccuagcuaagcaacccccccagcaguuguggggacaccuguugggaaggauggagggcuuuacuggcagcugacagcaggccuagccagcucggagggguggucauccagcugugccuggguccaggagcucugggcagcuggugcuaaggacccggcaggugggagaguucagggcuuagcagcugaacugcuuaggggaaaacuggaggugggguggacugcauuccaaaggcaagagccucugagcugugugcacauguguggaguagauacacagcauuugugaagaagggacaaagggggcacucucuugggcccuugcuuggguagccaagccaaguggcccaggcacauggugacauaugucaaaguauccugcuucuguuuucuagucugaaaggucucuuucuuugucuuuucugagggcuuuugggcacucuacacugggcaaacuggguccacaggaucacaaaguacagucugacucugagcaaaugcuuugguugguauggcccccggugcccgaaauggacauguguguucacagauguccuuagggcacuguuccugauuuccacaugcuuugccaucugacuugaagggaagaacagacagauccugaggguggcaagggaggugggcaguuucauuucacacuaagccggagaugcugagguuuaauggugugaauguguggcugggaguuguuggauguuguuuuagacagucuugcuagucccugcgaggcagguggguuuuagauaucugcauauucugaaagaaaguccuggggggauggaagauguuuagacgcugcguagguccuuaggggucccuuuucaaggucuuuaaaaugcaaauggacacaauuucuacaaagcuggugagugcccaauggggagggagcgcuuuagagaagagugugugugccuauagauuugugugcaguguguagagaccaaaggucgacuuggaguaucucucuucaggcgccacccaccuuguuuguugaaacccagucucucacaggccuggaguucacugauuagucuagcaggcucugcagcaagcucaagggccugcuugucuuuguuuccugaugccuagaauacagacgugguguacuaccuccauuccuggcuguuuuguuuuuaaauguuuaacuuagauccuggggauugaacucagacuuucaugcaggcuugugcggagaagcacuuacugucugugccaucucccuaacuuauagagguuucugaguuauguuagauucugaguccagcaucccuccuugggaugccacuuguauccucaggauuggguguuucuuuaagucuaguguuuggccccugccagggaggaagggcugaaccccaggaggagcccggcaagggaaggggcccugguugggucuauaaccacaguucccuuggcucaggguggcuccaagcuuuuguggaguagggccggcccuguuaguacucaagauacugcaccgcagccauccguggaggcuucuuggcugaggacuaugucagaaucuuccaaagcggcaucccaggugccagucaacgaaauuaggccucgcuuucucagaugcagaguccuggcccagccuucuugccuaccaccacaggggucagcuucuuccuggguaccugggugccuggggguaacugcaucuguguaaagcugggggagcugggcacuaucacagcccucauccugggaugugacagggcuuuaagguaguguucagaaucuggcuaaaaccgcggaaagacccgucauggguuccauccaacgugguuagaaacaucugacugugaccacaaaaaugcuggcgcccuggccacugcugagaccguucaucuuagcaaacgugcggugcggagagcuuugccuuaacccuuggaagggugugugcaggagccugugcaggacuggagccauggacuucugcuaugaauuaggccagaccaggaugagcgagggacugauucuugaguauuucuggugccacugggcaugguugccucuaaggcugucuaauaacccuuaggcuucagugacuuccggggauaaaaacuaagguauuaggagggacuuccaggggcuggaaacuggcacuucccaaggucuacauguaguaggcagacauguaucuguucauucuuggaaaugagcaaacauuaccuggcugagguguugaggaaggcauauaaccuucaauaaagcacugaccucccccaggugaccauuaggguugugaggagaugagcaguaaccauguaccacauccacauaugucagacagugaaaagggaugcagaacccugaaaagggaagucuuaugagcaagcagcuucuggggucacaagcuggggggugucaguggagagcagcaccucagggcaagucaaaggaagagaagggaacaugcuggaauguuccagaaauagaugacagacaacauuuuuugcuucuuaguccaucauagcuaugccucaugucaaagacuugacuccauagugccccuauuagcuacuuuuuacuaugauggggcuucuuaucccuucaccaugacaggcagucuguggucaguuuuuaaccauuaugaagauccaugaagcugguuccuacuuggggacagauacacagagggcuggguguuuggaccaguggguaaaagcagccuucauuuugucaugaaccauggagacacucuccagacauggucugucuggagaccggagguugugucuccagcacuuaguguuccucuacuuuguaaccucugccuuugggaucucccuucccaccugagucgucaggcugccuacucuuugauuccaacuaugaaucuucgacacaagggcuuccuccugggagcuuucuauauucugugguuuugaaccucauaacccuaaccccagcuaguggagggccacauauuccugguucuuacuccuuucaugaggagcucaacuuccugcaaauucccacaccagauguucuucucugucucauggcccuauugcccagggcuguguauauguuaggguagaaccugccuaccaaagaaugcauccaguuggucugcuuuccagguugccuggccccuucacccuagcaaguauggugacucagaggcacaggcagcuguuggacauagccuggggacccuuguacaguuugucugggaugggauaggggauuaaagccagggacuuggggugugugaagggagggguggaagaguucuucuauccaguacuucauggguaaggucaguacagggaccuuuaccuuuggguuuucuguuugccagcugguaauugagucaccauggugcuucuaacauaggugucccaagcuuccaucaucuggguguuggcaacccuguucacacugcuagagacuccauaaggagaacaaggguaggagccugagguagguuuggggguauggucuacagaaagcaaggcuccugcugaagguccacugaauucagaaccgcccguaggacuucaggcugccuuacacaaauccagaggccgcuuauccuugaaccuaggggucuaguuguuccauguauaggccucuaaagagaaugcuaguggccgggcgugguggcgcacaccuuuaaucucagcacucgggagguagaggcaggcgguuuucugaguuugaggccagccuggucuacaaagugaguuccaggacagccagggcuauacagaaaaacccugucuugaaaaacaaaacaaacaaacaaaaaccacaaaaaacaaaacaacaacaacaacaaaaaagagaaugcuagcuggauucccaccuccugaguagccugugaccaggguccuggagauggcuggcuauccagguuuccuuaaagguacagccuguucauagcaagcuuugguccuucauugaucuuaguaugguuugggucugagauguccuccaaaggcucaucuguuaaagacgugagguuuggaggaagugauggacuugcagauagagaaacccauagguagauccugauuuuaguguacugacaggagguacugggcacugaugaggugggauccagcugaagggaguggguccuuggaggcuagaucuugccccuagccccuugccuuuguucucuguucucuagcuacuacaggggaauaaccuugccucuaccagaggcuccuaccaccaugauacugugccuuauugcagcccacagaccacagcaccaagucauugcccacugaagccucccaaaccacaagccaaagcaacuccuucuuccuuuugaguuauuuuuucccucaagaauucuguuauagaaacagaaaguugacuaaugugggauaagaaagaguugguacagauaacaccaacaagauuuucuccagugcugaaaagguguguggggaagaguugcuaugacaucagccuucccaaggucuaugaggcuaugaggaagaccuggguuuguagucagcuggcacuggauaggcccugcuggaguuuuacaugggcucuugcucaccaaaccccacacuaggcccaaggagcacugagccagggaaacagagggaggugguuggcuuuauuagcaucuucucauaugcaaggaggagcuuagaaggggaaugacuuaggccuuggcaguauaguaaaaugauaaccagaggcugauggaauaaagaaagggugccggcagugaggacuugggguccacauguuccaaagaguagaacccuugcuugaaguuuucacuacuccuccaaacuugcuucuucuguccuuucaauguagugacucccacuucuuuccugucuuacaaacucaucuaugcauuuguaauccauucacagauucaucuauccauucaccuauucccuucuacugccuaucuauccuuucauccaaccauuaccacccacuaauauaucuccagguacccauucauccuauuuucugucaagcacucauuuaucuauccaucuaucuaucauugcugucuaucuauccauuuaccaacucauuacccauucagguauccaccaucaucuauucaucuauacacauacucaucuacugacccauacauuaacauccauccauccauccauccauccauccauccauuauccaucuauauauaucuagccaucauccauccauucauucuuccauuacaugucacccauuuuuuauucaucuaucuauccauucacuuaauuaucuaucuaucuaucuauauaucuaucuaucuaucuaucauccaucaaaauaucuauucgcccacacuaucuugcuuuauucauccuuuuccucucauuuguucucucauccaucaguccucucaucuaguucuccccaucaggcuguaugccugccuccauucuuuccacugcuucuguuuccuguguaucuugcagcaaugacaagaucaaaugguguggaugaugcagucacuggucuuggagucacagcuugccacugucuaaaaauagaucaagaccaaucaagaagcaaguucucuuucugugcuuucucuugucucuugaucucauguuccuaucaaaagggcauacacucauguggugaugggucuagaucaaauggaacuauggagacagggauagguuaucuucaagacuaggugacuaggcaugggacuguggaaguggguaaguugggacauuucugagagagcuaguuuaacaaguggucagguuuguuggagaaggaagcauuacaaacaugagauccaguguuccuugaauggagauguguacagacacaugacuuaggccaccaagagucaaauugaccauuguuaccacuauguauuuggacaugacacagaccucuucuuugugucuacucuucccaagucacuguaggcaggagcugauucacaguuaggugcuguggcuuauugcccauucccagggcugguccucauccuaggcagaugacucugcuguaauagggggagacgagagcuuacaaaguuucucuggcuuguuuuaugugucagguucugugcaggcacaggacuguaacaggaauggcuucuguucuaguggggaagcagaacccgccuggccaagcacagggauggugaguuaaaagacuggugcugggaucaggaacccaaggcauuggagagacaacauaccaggaaggggucaaagugccuuuaugaagcuguugcagcuugacgucaggguugcuguucccacaggggcccagggaugagaggagcuccaggaaggugcugcuagggagacuggccagggguggggcugcauuggaauugccuuccagggaggagggaggccgacaggccaugagcgggagugccgugggucugguuuauguuuuagacauccuucuggcugcugcaugaagacaggaaugugggggggggggagaguggaagccggggugccccuugggauagggaagaacucugucucucuguacaugccguuccugacugccggaaaugcccuucuggcccuggcagaguccauggugggaagaacaggaagacugagcagaacagagguucgagcguaucuccccacaccuaugaucuaguugggugcacuguaaggggugguauugugaaaagagcccugucaccaggagggagggagggagagaggaagcugcaccuuggacuucaaaugcuuaucaugggagguagcuguccuucauuggcugccauguuuggguuuuauuauuauagcagucgagcugugccugucuagaacuacugcugcuaugugggauggugacaggacggucagcauccucuguaguacccaccauggccacugccacuccuucaguccucuagagcuagcagaaccucuucuuuugggugacccuuuuccuuagguugcccaagcuucaggcuagguacacgacucugaggcagguacagaguacagcugucugccaaucauaguagguacugggcuuguggcucaagcuggcuagugaaugucugcuggugguauuuuuuucugggaauauagggaaguuguaguugugagcuucaagguuguaaaucugggacuaagagucauuggccacaacacagagaccaccgaggccagagacaagucauggagcuauggugcuugcuucuggaucucacuacuccugaagcugucaccuuuguggcuuuucaacugugugagucaauacaugacauuaccauucagacacauuuuagagcagcguuuccagcucuggaaccagagcgugugugagagaacauaaagaucauuucuagaggcuggggucugguguaaaggguagaaugccugggugcuuucugaaggaggcaguggcuuagaggggcugugaugguccagcuaagggccagcaccaguauaauguaaagguggggcucucauaguguugaguggguguccugggcugggucugagccacugcugggcucugagcagccuggguuuuaaggucauccaacugguagagugguaacauccagggaucccaagucuagacucaugugauacaucuuauugucacuccacuuguccucagaauuguugcugggagggaacuuaggcaguauaucacaucuauuucagaugaggacacugaggcccagaaaacuuccccugauuaaagucugccacuugucaggaacacagcacagcuaagcucacacaagaaaccuaguuuaggaauaucuggagagagguuacaaaggccacuggggguuaacuugauaauguguuuuugcuucccuauuggacaaaggcaauaaagagacccagcccaacagcugcugaacagagucuggcauacccacagcaggcaguagacaccugaacaaauauaaacaauaggaaauccgguguuuguuacucagcaaaacugacuauugcuuaagacuggaccucaaauggcaacuuagcgaaccauagaacuuaugaccacuccucccacaauaaguuaaaagcagggaaacauccaaagcuauguauucucugugccagguucuugcuaaguuaggcagagauuucgacagugguugucucuccacuccacuaggguagggucuuacucuguauaaacacaccaaucucuauccuaacuuuucugccaaugagguagucuucugggaucagucuuacuggucugaugucgggaugccucaguguaaugacuggcauuuccaucacuguuguucccuaaaugauggauggcagggucugacuccauacaggccccaggaaaacacuuuguaacacuagaagagggcaaggacaggugggcuaagcagacacagaaggucuguugacauguaagccauauuuggaaucuccagaaaggccuaggagcugcuuggcccuguaggccauggugaauguuaaagggcagggcauguuauagggugucaagaauaggagauaagaccaaaguaaaggcuaagaagacagcuguagguaaagugcuuguauaaacagaauaccagaacauagaaaggaaauuaggaagggcaugaaagacucauuagaaaugucuuuaacacagucaaaaggcugucuagaaagacacaucagaaauaauugugugaaggaaaugaucauaaauaauaaaaggaauuuuuuagaacuugaggauucaccaaauauucagagaaaucugugguuaaaauuacucacagaauauuuuggcuaggaaauucagacacccaaaaugacaguauagcuacugaaaauguccaggaaaaaggaaagaagagacagguuaaaaggugugugaauaagacuucuaacugucaauacuggguguuacaagaccacaggaccagguguuuaaaguucugaaggaaaauccacuccuauuugaaauucuauacccagcuaagcuauuacuagggcauggcaauguaaugaagauguuuucuggacccagaguacagauaguguucuuucauauaauuauuagaaagguauuugaaauuucucaggaagacaagaguaggagguaagauccaagcagcuguacucccaaacuaaggguuguugauuaggaugucucuggagaaaauaaaugcuaauuaaagcaagaaagaagaggucugggagaauagggacaaagggaguuugagaaagagacaucagucuggacacccugacaauuaaaauaguaagcugaaagagugaagggaguggacagugggcagcaggcaagaacuaaggggucuuuuggaaggguaauugaggaagaacucugucccauuaggaguuaagucaaaaccaaaguaaaaauuguggagacaacgauauguaaagugcuugcugugaaaguaugaggcccugaguuuuagucccaguaccugugugaacacaauagggaaugauggcaugcagcuguuacuccaacacuggcuaggaggagacaggaggaucccuaugguuugcuggcuagcuaaccuagccuuuuuggugcauuccagaccaauaagagacccugucucaaaaacuaagcugccaagaaaugauauccaaguugucauauggccucccuaaacacaugcauauaugcauccauacccacaaacacacacgaaacacuccaugaacaugcacauacaugcacaaucagacagacacacacaugcacauaccaaaagucacaacccccuaaaacaaacaaacacccccaaacacaaagaaccgaagggaauacaucuguucaguggauugugaugaacuugagccugccuccagcuuugcauagaauugagagagauggcaaugagaaacagggccucagaacugaggauaggaggauagccuuuggccacaguagagcuggcaaucauggaaggcuaagaguguaaccccacagugagucccauuucccauaucuuacaguuuucccucauaaccugggagugacauuuuucuguugauaaagauauguuuaugugaacucaucauuucuuccacuucacuucuaauuuucuuuuuaaaaaauugauucaaaaguuaugaaaccaagccuaagauaguucuugaugguaugugucccuuuauccauaccucauauauccaucuguccaucuguccaccugcccuguccuuuauuccuucauccaucuuuguacuuauacauguaugcauucauucaucaacucauacacccacucauccaucuauccaucucuccucccaucuauccauccaucuccuuuaccauucauccuauauacccacucauuccuccaccaauccaucugcucacugauccauucauccauuuauccauccacccaucuauuuauccacccacccauccaucuauucauccuucagccugucuucucacucagucaaccacacccucacacauguacaugcucauucacccaccuuuucacauaccugucauguauccacccacucaccucucaauccuccagcucuuuacaaaugcaaauauccauccauucaccugucugacuaugcauuauuuucugugccauauguggagaauuaccagaaaugcuguuucuuucaugcugaagauggaucuuucuggaaaaacaaggaucaucuuuaggaaaaagagaggaucaugagaaucuucacuuuuuuuuuuuauuaagaucuugcucuacugcuagaauuugaaagaacaaaaucuccauauaucaucuaucaacuaucaauacucuauuuuuauuaucaucaucuaaguauucauuuaucuaucauucacguauguauguauguaugugucugucaaucacccaucccccucuacuuuugacaugaauaacagauaccugugaagaucuguguccucuuuugcuuucuucucuguuuggcuuugcacugaggccuauuaauagcaccucagcucacuauuuuuggacgccccucccucagaggucuucccugaccacccuggcuccucccggcacagugcccugcucugucucugcaugguaauuuucccagucuguaauuacgugguguauuuucgaccaggggccgcuucguagugccaggagcucuguccugucccugcggcaccuccaacacugucugcugucugggacauagcaggggcuucaguggggacugugggaaggaaggaguggaccgugggcagccugggauucucccucaaugcccaagcagccagccucuagccucagugugguacuuggcagugggcagggagaaccaagccugacagugcccguaguggugcccauaagaggaggcggaagcaggugcuuccacuugccacgugccgggcacugggccaggugcucagcagggaagguuccagguaauguagcccaugagccuggaggaaguguucuuaucuucuucuagaugagggaauugagaugccaagggacucaugggggcuccaaacuuggcccucuuuucuguaacucuguccuagccacuguuaggggcugcacugaggcaggggcaugggaugaggacagauggggccucaagauguggaacuagaucaggggcaggugaggggguggggagaaagggggaauccuagugggugguggcuaguaggagggccauggggaagggaugcuccugagauaagggcagagagccaggaggggguagggaagcuuggagagaugccaggccccggcaguaccuaagcucaagcuacccacauugccagcagaucucaccguauggagaagggaccaagugugacauuucagccagaaugguggcugaggcaagcuggcuagucugucaccuuagggucaccacccaggucccucugugcucuagccagcaguaccaacauucaucccuuaggccuccagacaagaaagucacacugaggaagaguaggcaaggggaggcagagagccucagagaugggagguaccacgguuugcuggcuucaggcuuugcuuuccaaaagagggucucagggggccaggaauggggugggcaggaguggugggcuguggagaaaguaugauagauggagagaggggagagagaguucuggagagagugggaggaagugagggggaggaggggcagcuggagguaaaagggggcuggggcauggccuggaguaggaggcucagcagcggguaagggaggggagggcagagcacucccuggccugugucaugccugccacugagccuguguguaugcacauguaugcgugcgucccugggguggaucuggggacacacauugagcgggaaggcuggcugcuaggcugaggagagcccugggccuguggggaauguuccaaggagagauuuauuagugaaacaaaagcauauuuuuuaggcaggacuguuuguacaguuauuucaugacaucgccuuggccucgggcccagagcagagcggccgaggaggccccgcacggcuggccgggugcacaggccuauucguuagcuggccguccucucccguccuuaucugguccuggacaucaaagcgggggcuuuucauaaaugaauuaaaauagcauacacacagcaccggggcggaagaccccaggccaauuagcucuaaguagggugagaggccuuucagagacgagccccuuucugaaggagucgcagcggcuugucaaacucgaugaaauauuuugcccaaagcucauuaaaauaaugaaccugcauuucuuuccucaagagaauaauuagcagacuuccaaauggguuaaagcagcaauuuagaaguggccccccuuaaucgucccauuuacuacauuuugugacaaggaaacucuggcgccuuggggaggagccgagagucucggcauuggcucuguguggugacggcagggcuguggagcugggugggagcuggggggccugcagagagggcugcguucaacuugggauccugccuaucucugccaccucccuugcuuugcaaccauaggcccccuccuccuuguacaucuaucuauaacagguugguuagagacuggaggccugaggguuagggccaucaccaugcugggagaauaucaacucuaagauacaagagaaugaggguaucagauguaggcucugcuucagaacagguacagacgaagagaacgccaacagguaggugaucugagccuuagcauaaucaagggcagagcccugguacaucagagacuccgaagaggaaacgagaagauaccacuuagggagauguugggggaauacaugaguugagggcugaauggauugagaagggugagcucagagugagccaggggcugugucccuagauguugauaacuuugauggccaaugggcagaguggcaaguucaucuggugcaacaagugugggacagacaagagggucauaggcaggcuggucuccugcugagagucauccacccuuccccaugcugcuaacagggagguucaacuuuugacaguagccugagguagcccuggacaauccagagagcagcaauaaauucaaauguggcugaaucuaaagguugagugguccucagcaggagccuccaagaccaccuugcuuugcuucuuccucuuuuucuuauuccgcauuuguuguuuacaaaguaagacacucaugauggagauuggguaaaacagaaguaauggcaugugcaguuggacgccauuuacaaagugccauaguaugcacacacaggccaaugugggacuugccuucccugcuauaguucuguacuuaaguauuucccauggucacugaaggauaccugcaagcauacuagguguaacacaaccaaccauuggccaucgaagacuuggagucucuuucuaaccccucucugugauaagcaagacugccauuaacuugcuugcauacaacucccugagcaacucugcuuggagacagaguccuggacaggggucacagaguuaggggagggaugaucuguaccuuggacauguuuuauccuugcaauaugggaaacaggcuaggcucauuguccccugcagccucagugucuucaucacaguguuuuuuuguuccuuugcagacagagcaaacaugugaagcucuguugugggccacaugaucgcugggcaagcccagcgcucuuacuuugauggugggauccagucugaaaagcauaaguaugcuggaaaugcaccgaguccgccagacccaugacaucauagcuuagcugcagcauauuuuagagggucugagguucacccuggaaggcaggggacugaagagaaacugcuccugaagcugccuggcaccuaaagagagaacugaauaacuagcucaggaagauccagcuucaaaaucuaaaguacaaugaccauguacacacacauuuacacauaugcacacacaauauacauaugcacauacacacauauauacauguacauacacacauaagugcacacauaaugcacagacacagaugugugcaugcucagacacauaggcacaaacacacagacaggcacaaacacacacacacacagaguacagcucuuacuaacguaucaugcucacauucucagacagccaagcuauaaguugagaauuaucaaaccuaucauugcaacaugucaacugcuaaagcuugcauaucugugagugaaugugacucuguucuaauaaaacuuuacuuacaaagacagguguuaggcuggaucaagcccgugaacuguguuuuccuggcccuuuuuucaguagauagaugagaugagauguauuucuucaaucuugggccuucucacuauagguuuccauagauuuggagucuuuacauacuaaggauggcccuucuccaucauggcuugcugucugguacagccuagucagcagagagggccucuuugcucugcuagccaggccgaggcuggagggaacucugugacagccccuagcaucugugaacucauucuccuuuagagacaaaggccugcuuccagcugucaguccaagcuaucaaucagacucagccugaccuucugagaccagugggcauguccaucugcuguuaauagcuugucaaagcaggggcugaucucaacucaggcugucugggcaaauaugcccaaauggugccagcaugccugcugcagucagccaaucugggaaauagucugggaaauggaacuucgugagaugaagguaggaagcugcaggccagagcagagccacauacuuaucauggccgcauccacauaaccacccguggccccuuggcuggcuccugagacaacagaguagcccagaaagaugaaagcaguuaggaggaauaauaaugagggggcuauucuaguuagugccaaagucccagcagcugucugugacccuaggagcccaaggucugugggaacuguucaccuugcaucagucaucuaccgucaccaaacuugccuacacuugcccacaaacuccuggggcagagaagcaauagcacaaacuagugugguccuaacaacacugauuguuuagggaaaaaguuaaagucccaguuccagcauaagcaggaucuacagaugacagggccacggguguaaaaugauuagugccucggcuucccuccuguaaaauaauacuacaggugauccaaacugcgagguucucggagauccgugccugccaauguguucagggcauuugcauagccaacagaaagcugccaauugucucugcugaguggugguuauucuugucccuguaaacauuuuugucccuuguaccuacuuaucagccagcagccaccacagagaaugaaugacagccauaguacuucuacuuaggaugcagauggauucagguucugucucuauucagggcacacuugucccugccuugagugguucaucauucuccuuggucuugaccucucaaagcccugucuuucccuugaggcugugggcagguuugagugggacagauggggguaggugauccgagguacugcagccaauggcugcaguagggcucugaauacgagagcugauucugagauucucacggguagcaggugggagauucugggacugaauaggagaugaguggggaggagagaggcugggagaggagcagggaauguugggaagaaagagggcccuaggaauuugugggcaagucugggcaagcaguagcuccgggcacgcagggggcaggcuuggaugggcaggcuggggcaggcagcaggaaggggguugguagagggguacaggccuaauccugugucccugaggccuggcgggcaucucuuaaguccuauguccccacagcuugccagaaccuguaggaacaaggugggguaccauggcuucauaugaacacccccuccacaaccuagagacauagauguguucucugaugucugcagaacucuguagcacagaggaaaccucauuuuauuuaucuauuuaucuauuuaucuauuuaucuaucuaucuaucuaucuaucuaucuaucuauuuauuuauuuauuuauaccauagacaucaucauaucuccuugccuaucuuuaagguuuccaguucuuuucucugcccaggauauucuguuugugcccacauugccuuggccccucaggaaauccucauuugagcacucugcuucuuuacuggggauaguuaugugacaguauucuggcuaaggcuagucugcuaguguguuccauaggggaacauagcugccuggcagagcugcuuuacacaggugacuuuucccaggcucuggucuuacaggaggucacacugaugggcagcuggcuaccccucaugcuacaauuugaccaggaacccuugugggucuacuuucugcuuaagguuccauuaugugagaacuugaggcuagggcuggggggucgggggggggucagccuugaggaauccaggggauaauguaucuauccucuuguuaugauaugcugugggauggauguggauccugggauacuagggugaugguugaaaguaggugguggcuacuccacuucucugugaccccaaacaauagccugagggguagccagggaauaugcauuuuaagguguuugucaccagccuacuuuguguuauauccaugucuugaagaaccuggggcauuguaaugguaucugagagccagggugguugugagggccaccaaccccaaagaguagaauucaaggaaaguguagcaagaccaaggggguucaugcuguggcagguuccuuguggguuuaacauauaugaggugguccauaaagguauuuuuuccacuuaaggaugccaucuucuagguccccuuugagaugaucuugacacuaacaggaucugggaagucccacuggcugaggacagggauagagacaaggauagcucugaagccagggccaggcucauccuccugcuggcuguauccuccaauaccuaguauacuaugaagcucagaugggucuaugagacucaggcagaagagaaugguccucagcugaacuuccuguguagcagugaugguagagagccccucuucaugccagagcaggguuacucuggaggcucgcuucucuucuauacauuucauagaugagaaaacagaagcuuccaggaugcugggcugccugugaucucauggagaguuaguagugagugacucucaggcagguaagggacuuaggagaugacaggaaacuaaggccaagggcuguaacugguuccuauuccuaggcaauccuuauacauccucgacugagacaguggguccugaacucccuugggugccggguggagggccacagauccugcucagggggcauugacuccugcugagguaagccacaugcucagguauuuagccuugaugauucuuuuuuuauuguugacauggcuauauuuggaccaccuaagagauauacuucaagccaugaccaggaggacauuccagagagguuuaaguuaacaaggaagaucaaccauaaaugugggcagcacuauccaugggcugggaucccagacugaauaaaaaagugagaggagucccagcauucauugcuucccgauuccugacuugagaugcaacguggccagcuaucucgggcaucuauacgucaucgccaccaccuccaucagaguggacuguacuccuccuuaaacauuagcuaaaaauaaaauauuucuaugagguucucuuucauaaagcauuuugucacaguggugugaaaaguagaccccacacugagagccccaucgcuuccccugauacccucucuucuccagaaaacaccagauucuuuuucaaagaaagagaaggaaccccagggcuugcuguggauagacagacaucccaaagacagaaggcuaguggagggucaguagaaagccugguaagucucaguauaacagagucugaggugaguggucagaugggcaguaucucuuggaaggacacccugaagaucccauuccuggaugggauggcucugcuggcccuagacuuaggccacucuuggauagcugaccuaaucuaccugggcuccagcucuucaccuucaaaauaggguuacacagaugaacacagaacuuaucaccagguguggaacucuugaaguucaggacaaagacccaggaaacauacuccucauguccgcugccccuggccugagcacugcucucaagcaggcacucacuucuacuuggcaaaaaugaaugaggcaucugacuguagcuuugauggucuauucuugagaagacugagguggagguuauacgguuaaaaccagagaaaaccuuacuuagaacaucaguauccagcacaucacaagcucauagugaguggguucucacccacaccacagguccuaaggacaaaccuucaccuacauacuuacaaacacaccacauaauacacagaaacacccaaccaaacauaccagacacacacuuacauauaugcaaauacccaccacccucacgaguguaagcacguuauaugcaacauccucauauuuacagacacgccacaccuucauauguauaaacacacaccauccuugcacaugcagaaacacacacaaugcuuucaaauguacagacguaccacauaucaugccacuuuagaguacgucgggacagccuccccuccccaggcagagcuccacugccaucauuaagagcagggucccuugcacagcucuucucucacuugaaugcagaggugcuggcuuucuuucugucccaccugucccagggccuuugcucuucugucucuguagauuuuagauguccucuguuggguacacguugcugaucaccuguacccaguuugccgcugcucauaccuucugcacaugguaccuucucucaacaccccucccuuuccugccuuguuucugccaucuucgaccccuucucuugucccaaauuaggcaaaggggcgcacacaaaucaacccugcccacagcauagaggcgagaguucaaacaacucgaccaauuuacaaacaauuuucucugcaacgauuaaguuacauuuuccccaauagcugcuucauuuucuugucaaaauuacacaguuuucacauuuaucucgcugcaaggguaauuaauuuccagaccauaaguaagaacuuaauuugauaccugcaaggauuacaaaccauuucaauccauuguuuacaugaaaucaagaaagauucguucuguuugcaauuauguuaaugaggagagugcccccccccuuuuuucagggaacucaagcauaauuuuguccuuagcaauaaauuggucuaaaaagguccauggccaccacaaaccucuguguggcuauuuuuagggugaaccuagugagggaacccaugcagacagccagguacccugaggaagacuuuggggagaaugacucucagacugguggugauuuccaggguguguucccagguuggguugugggccaugagcuggugacaagcaggaggauggaccgcccgcaaugcacucucucuauuauuaucuacaaagaagggaucuaagaagaucaggguagcagggaagccagguaugaugguccgccccucugcacacacugcauacuggccaaggcuggagacuguagguggggacauucagggggagaagagaucgcuuucaggcaggagauacauccuaacucugaccuaaugcugucccaugacuguggggcaagggggacugagaugcuuggcgagaguucuguuugcccacagggcacccuacaggucaucccuugaucuccaucagcccagaccaugcaaaaugacuggaaggugcauccacaggagaccagcugccugcuaagaacuggcccuauggcugggggcuggaggcuaggugaagcaggccugcugggaggaaagggcaguaugagcaagggugagaggcuguaagaaauuucuacaggcacacaggaagcugcacucagagaaaggaguugggccaggcuaccagugccaagggccauguguacccuucauaaagacagagaacagacauggagggaaggaugcuuauaggaaguccuacagacuccuaagucaggguggaccauggugggcagcuuagaagagguucugccuguguggacaugggugcuagggaaauccuugggggucuaggaggcugcuuggcccagaccucuguaaggcaggagcccugagaaggugggcugaagaaacuggcucagccuuuugcuucccagcccuccugggcacuguggggcuacgggagaaagaggacccauucauggaguggcccgcuguggucuguagacacguuauggccugucccuggcuggcugucacuagagggcugggggcugggcacuguccucuuccuuacugcaaccccccuaccccccagucagcccagagcagccggccugaggcugcggcugaaccucguaaauccugggaugcuggagacagcccaggugaggcugggaacaaugccccauuguggccccguggggacggucugccaccacuugccaccagccccuaugcuguaaaaucucuccccacggauccaauuucgccucuccggcccuugagggguuaggcccgggacaggcgcaguuccacuccacacagaaaccauuuacggcugggauaaaggcugccuucaucagcaccgaagggccaacguuucccggccccaucguuuugucaccgccacaucugucagguggcggcaugcacagcaaugggggcucaugugagggcaaggaaggaccucagcagccacuacagggaagaagggccuacagucuugcucuuccugugagugaaguccauggcaccucccuggcuucccagcuugugcuucagugggauaauacuauugcaggauccagcucugagguggagagcaugcauccugagggacuggcaaagaggacaccagaccaggcugagugaagacauugcccuuuguuaguauauacauuaaugagcaagccaggauggaggaggacuggcuuuggccuugccaggugcuaguucaaaagcccgagaagcagaggggcugggaacaccugggagaggaugggggggcaaucagugggcugugucccacaccaucuugcgcuuuuaguucagagccagagaugggucucuguuccaucaagcuuuugaggaagaacagggaucuaagagccaacauggacuuggccuggcuauuuaucaugagaaaagccucuuccaggcuguggccaccauggcuaugcuggucuucuguuuugaaagaauaauagcuuuaggugguacuugagccaucaccuguaucuuagcaucuacguuugcauuucagugcaagguacaaaagaccauccugaaccagaaagcuauggcuucaugagugucagucacuucuugggaugaggauuguagauccuuuguguuuauggaggcacucagaacagcacagaaggauuggaugcucuguuguagcucuaggaccugagacagcagaggcuuauugccccgggccucuaucuagccucccuucccuacccacccugucacuggggaaggaagcugggagagaggauaggacuagaggcucaugggcuucuucaccaacugacagaagaugggugcauugccacuauauagcagagggauauuuucuccugcucauggcugugagcacuggguaguuucugaggcuugagugguaaagucauuguaacaauugaauauuugaauccugcagaauuagggucaaauaguguguucuggggaucauuacaaaaccuuggugaacccugguggguggagaguaggaagauuauguuaguuuucuucuucuuucucaucaggcugggagccagguuaaauugggggaugggcgcuugcuggcaccugcaaguugcuauuacuucuggacuuguucuauaacugggugacaacuggugacaauugggugacauccugggucauagugcccaggggaugauucagguccaugauuccaauuugagggcaacaaguaugugauaguuaauucugacugucaauuugaugggauuuggaaacaccucugugugcaucugugacagugucuccagaauguuucaggggagacccauccugaauguggacaguccuagcccaugggcuggagucuuggacugaauaaaaaugaggcagcaagcugagcccccgcauucaccucucugcacccuaauuguggauguucugugacuagcugccucagacuccugcagccaugcuagacuccaucucuucaaaccgugagccaaaauaaacgauucccuuaagcugcuucugcuaagaacuuugucacaacaagaggagagauuaacaaagaggaaaacuaagauggauagcguggcccaccaggggccuugucagggacagaagaccacaggaggaccugaagcacaggaggggaacagggcccacucugugaacccagccauuaugcccuagcuguagguagcucacgucauccuuaucacacccaaguagcaaggaggaaagguagggaaagcaaggcccaggggagaagggcugccuaugcccucagcuauuaucaaggugggggauucugaauuggcacuggauuugggucacaucuuucucuccuacagccauugaaguaugcauauugacugugagugccuggggucuguggauguaugcaggguuauagguacaaaggagaaaguggaugcucuuuaccaagagggguccugggucccuugcccuucuccccacugaccuugcaucagaggccuuggggucaugccuuauauguauuccauacacuuuccugacucucuacccaccacaaagagugggauugaaaaagggggggauagaagagcuauggcggccacuggucaccuggccuuccuucuaugguccagucacuacugggagaugagccugcuuuguuccucauccugucagacuuugucuucuuccuaggaacagugagucccagagucauuugcucuggaaacuugaugccuggauucuguucccuuuagauucucacaaacaugguucgccuuuuccuuggaguaagccccgaguucagcucuggauuggacuugggagcaccagccugaggcagggccagccuccucuuccugccccucugaggagcagguaaagccuguuucuuaggccuuagcuauggcuuuguaaccuucuugccucucaaccuugcacugacucuucauuccuuuccaccuaagcuccagacaucggagguccagcugccuaccuccaaggcuuggggcucuugauacucucuauccucuaucugccuauccagucuuggaaggggccagcagucugcgggacugguccaccuaaccccauagcagccccucauaguucucuggggucuccccugaggacucuccugggacauagcuggccgguuuaucccuuguuggcuagguucuaucuugcuguuuucuuugacuuagaggagcacagccuuuacgccccagggccuuaauacaggcugcucacaagauacguuccuggccucucuggccuuccaccuggcccucuucuuuuuggcuucugguuccugacuuccugacuagggaaacccugcuucaauacuuucuccucuccaccaugggaaauauguaauuacaggucacuauggguguccccuccucugccaauggacuguguguuccaaggucaagagccagcccacucuacucuaagugguagcacuggcuauggggcugguaucaaugggugggaggugaccggccaacugaaugagcucaugcagugcgcagagguuuccugcaugcuuuccugggcccucugccccucugucuuggcuagaaaggcugcauuuuagaggguucugugggcucugaggaagaaacaccccacacgaucaggugguaccuguccaccuggguuguuggagguggcccguuguagccagagggguuuucauagacauguaaaccaagucugugggcuuguugggcauacccagacauguuuuacauggugcugguaggcugaccccuuuccucccacuguagcugugggccucucacuauucccacacaggcagccaagagugacccagugacauaggcuaccuaggcccuaggccaggaccucacaccuuucucagaagccccaccccuugagggugggugccgguggucugaugggacguccgcugggcuggauauaguaucucugugcgggcagccggcagcuggccaccucaaugccuacacagaugucucuuuaugcuccagaccugacuuguggcuccuggcugccugggaacagagggggcgcugugcacaguaaccaaccuguguccuuggcuauggggugaggugggagacagagguggggcagugaguagagaggauacacgugggccucacccucugcagcucauaggaacacaucaaaugggcuugcugaacaucgcauuggggugcugcgcaccuaagcccugucucucagacuccucagaggggaaccuucaauggcuccagggugcacagccacacucacuauuuguuccaguuucugcuccucuuaacccaucuuuugcuguggggcaacaugacaggcaugcacuguaccuuuuguccccagagcccuuugccccucuggcucccugacagaccugcccucccucagaaccccuuugcaaaagcccagaucuucuuggaagaagcuucggugcaggagaaagguguggcgcuccccacaucagccugggacuuuuguuuucuugggagcacaguagccagugugacagccucaucgugucccggugcuuucuggguacuagaccacaggcacacugccucaccuggcucaaauucagguugcuauuucacagauggagaucuggaggugaaggguaccuuuagcuuagggucccugcaaggagcugccguggagggccucggccuucccuguucugggccaguggaguuaucccucgaggccauaggagagggaagggauacagagcaguggaggagggagacccaggagcggaggcaugaauggauacgccgaggacgggaaacagcggaugaggagcgggcggggaggcagcaugcugccaacccaaacagcccagcgugccucagcccagcauuuaauccacaaaaauuuccaucugcuucuggagcccuuggaacccaggcaaggaaaggccguucccucagcaaagcaaacaggccuccgugugcgcagcgauucccugugcuugcggccccagcugaaaggcagagucagccauuuuguagaugaggcccugcaggccaggccaggucccaccugcaccgcaggccuuccgugggugagcguggagaaggugcuugcuacauuagcagguuucacuggcaaggaccuacuggauacaccugccauucaguagggguuaugugagcuacaugccacauugggacugagaaggcuuuccccaucaagagaggcccacugugacaccauucaugacauggcccuggcugucauuugcuauaccagguguucucaauggucucuguguacccugaggggugccccuaagugcgccucaugccugcuauccccgcucuguccacugccugcuuuaaccagcccaugguuuccggagcuaccagggacaaggccagggccaggcacggcuggcugccccuuucuaggcugguccuuuccuagggagggagggauggcucuagguuggaagaucuauuuuugguggugaccaaacugcugcuuaauaugcagagcuggggcaagcuagggugacaaguuuaaaaagaggcucauuuugaccaaaauacauguuuuucugagguuggccaaggaggccaggcagggccggccacacggacacagguucacaccacccucacgccccauccccuguggacgguacccacugccucccuuuacagaagcuacugauuacagaucacccaacagcccuguugaggccuggggccuucgucugcugcaggcugacacaugugccucugucugcugccugcccgucucccugccucucagaagcagucacacccacagaaguugacacgggcuugagcuaaauuuucaaaaaauguaaauuuccucuccagccaauauuugaggccuauaaauagagucacucaggagagcugguguagggcggggaagugucucccacacagacagggagagaaccaucccaggagaaaggaguauggagggaaaggaugacuuuggggugggggcugcugaggacuggucacugucacagugggggaaacugagacccagauuugggaggacugcucagggaugcagaagagguugggacggagccaguugcuccucacuuucucaugcucacauugugagcuugguggucaguuaucagcucaguggucacaccugggccgcuuggcucucgaauauucacacaguacugcccaugccacaaggcccuugcauauaaugggccucuggccugccuggggauccucuaucagcgcugagugucagcggcagcagagcuugcagccuagaggcuggcuccaaaggcauugaaggagguucagguuaugggaugcgugacacaggcaggcaacgauggugcaggguuugugguaugccugugugcacgguggacagaacacagaugcagcauucaaguaaaggaacuaggaugacccuuggcauggggcucaggggcugggugagccuaauacaggcuugagaugagcacugagauucugucuacagcaaaccagugugguucucccacaggggaaugacccccggaucaggccagacagaagacccuggaggacacaugcuuuuaauuucuccaaauuaaugguaacugauacaaaguauccucucugccuuggauagagaagaaaacuuaggcucaaugaggacaguggggguugcuaaagacagagagagccauccaggccccauaucuaucuguaguuuuugagguccagaugcuguucuugucauauggaugagagagaagaauccuauccccucaaaagacugucaugggcugaaaugggcucugagacuugcugucaagauaggcaggguauaaggccauuuucaugcugacuguuauuguugggaagagcgggggcagagagugccuagcaugcaaguugucaggcugggagaguccuggaaccauggcagacugcagucagaugguuagaggaccggggcaaggaaaccagcuggagauugcagcuaccuuguuucugaggcaacucuugggagucagacauagcuuuccuuccaaugccaguccagggagaagugcccagaggccacuaggcaugugcgucuccugcuugagcaaaaugagagccaucuacugcccugauagucugcuuaugguuugcuaugccacagucaucugggaagagaagggcuaugaggccucuagcuaugcaccccaggucugccugggguaccagcaacaucccuacagagccacauacuaugucgagcuggccauagugcugcagagagcugugucaggaagaguucagugugaccaguuccucuucucccauaguuucucaagguugcaaccuaacagucaacagugcccuuauacauccagcccucugcuggaccugguacuucuccucaagcuauaggcugaaaagguacauggguauccaguucucacagacuucccuaagcuuuucuacugagccuguggcugaaggcaaccugcuccacuaaaaaaagacaggaagcccgugacucacacuaugcuacccauuguggcuguggucauuuucugacauggugacuuccuucugggagagguuagcagcagacacuucccuauagcuuuacuggggucuuuugcaaggacccuucucaaacuccggggguagccugaaggcagaauggaguggcuaacaggacgcaggccuggcuccuuugguccagcacugggauuucagguucucuucaugaguggccucccucagaguguuagcugggcacagggacuccccagaagccaugcccacucccgcccgggacuggggugguggggcgcugugucaaauggugcuuucauuauagguuuaucuuugaaacccuagacaaaacagggcuugugugguuugacuaaaggaccagcaccucaggacuucaccauccacuaagacggcuccucaggaaagaaaaaauacacgaaccuuaaaauaaccaguucccagaauagcaaacgaaugccggcuucugaagggagcucuuugaucgucuggagccccaugccuuugccuguuuacggcccugucacucaagaguagcccagcagcaaggcaaagagggguguuggaguggggcuggggaacaaguaagaaggagaacucagugggggagguagggcugugcuguguccuaggccgccccacuuucuaauguaaccagcccgugcagguagcaaggcucuuaauggcggcuggcaaauuagccuggaguauggccuguggguuccagguuaugguucucugggacuuggagagggugggccauggacuggggaggaggcuuuggagagguagcccagggaagucuuauaaggaugcuuuccuggauagaugggaguuuagaggcugccucucgucccucuuccccuccaugccaucuccacuuggccuucccacucuccugcugguguucacagagcuucuggucuuccuguuaagucauaugaaacagcauguccaacagcuuagcccuuaccccauauuaucuucagaagcacuggguuuuaaugaccuaauuuuaauaaauuuaaauugaauuacacauagauccuuaacugaguuuuaaggaaaucuaaagaaucuacuuucuuagacugggugugguagcucagugcccauaauccaagcaucugggaaacugaagcaagggaaucacuguaguuuuaaagccagucuuagcuacacaguagguuacaggcuagcuugggcuacaacgugaguucuaggucagccuggauugcagagcaaaaucuagucuuaaaaacaaagacaaccgccccaaauguccuuuccaaguuguaaauuuuaugaagucuuaauacagucccagaagcucucaugaaaacccagcuuucaaauugagaugggccauguguacaaaauucaucuggcuucugaggacucggaauaagggaagagaagcaaccguuuuaauaguuucuguauuaauuauauugaagucauaguauuugggguuucuggaauuaaaugaaauaaaugacugugacuuuaauuuuaccauauuacuuuuuagggcagcuauuugaaaagaaaauauccauguuuagcagccaggagcugagcagacaguaggaacacuagagacugagguaagagcuucccaaaggcagcuaugcaccacgagcuuuagauucuacaaucuuccuagugacucuggccauuagaaccugggagucucaaggcagaaacugucagcaagcucagaccuucaaauagcucaaugggaaagucaacaaaauuagcccacucccugagaagacugucaagauggcuuuaacuguuaagaggaagggaacaguuuuugcccugggaaguuacauccucaagcuaguuacagcucugauuagagcucaaacucuuaucaucugaguggucuggaaaaucuccgagucuaggacugaaaggccaggcuggauguaugcccauauguguagcaacaggagagggaaugaaaucaggcaccucagacaaggcagcgggugugagaaagaaguagauaaaacugcugauuguauuuuuaaaacccacauaugcacaacacacacacacauacacagagagagagagagagagaaagagagagagagacagacagacagacagagacagacacagagagagagagagacagagacagacagacagacagacagacagacagauacacacacacauaaagaacacaaaguacaauauccuuuaugacuauagauacaagccaggcauggugguccuggaaucucaguauguggggggcaaaaucaggaggaucauagugaguuugagaucagcuuggguuacacaguaaguuccaggccagccugggauagacuauauaaggagacucuguauuaaccccuaguucccccucucauuguauguguguauuguauuguguguguguguauguauguguguguguauauauauaucuuuauauacauaaauaguaauguucuuaccacaguauaacaacccgagcccugcaaaauuaaaaaaaaaaaauccuucaucuaccaugaccaaaugggguguaucccaggaacgugagauuaauuuagcacccccaaaauuaguuacuauaucauacuguauuaauagaauaagggguuaaauaucacauggucaccuugauagacucagaaaggacagcuggggaaaaugcacauuuacuuuugcucagcucuuagugcacucagcauaggagaacauccugaacucacagggagcauugaugagaacuccaaagccauccucauccuuaaugacaggugacaggaggccuucucccaggagagucucuagucauuccuacauauuacugacguucaagcuagggcaaggguggugggaaggcggcgagagcaggaaggagggaaggaaggaaaugaaaggcauugggaccggaggggaagaaguaaguuugccuucauuaucuguagcaggaguggaaaaucuaacagaaucaacagcaagaacaaaacaugaagacuaagaauagcaaguuuggacuuucccagaccggccaaagauugaguuucuagcuccaguaacauacaaucccaaagugaaauuaagaaaaaaaaccaaaaaacaaaaaacaaaaaaaacuaaucccauuagcaguuguauggugaauaaaacagaagugaaguuaacaacaacaacaacaauacacaaaauguacacaaacuacaaaaaaauuaucaaaauuucuaaucccagacuuuggcugaggcagguggauuuuuaauuucacaguauagcuaacuaguuccaggcuagccugagcuacagaggaaaaaaaaaacaaaaacaaaccuugucauaaccucaccucccaagaacuggaggaaguaaaacagagauagcauauucauggucuaagaugucuguuuacccaaauggauccauagauucaacagaaaaucccagaagcccaccacccuaccugccugccuuuucuacccccaauuucucuuuuaaagaaaaaaaaaauacaaguucaucuaaaaauucagaugaaaauaucuagguaucagaccaggguaggagaaaaaaaaucagaauauuuucacuacucaauuucaaaacuuacuguaaagauccgauaaucaagagaccauggagcauauggaccaagagaacgggaaugaagguccacaaagaaacccauacauuuaugguaaauggauuuuuuuuuuuuuugagguagcccaggcugacuuuaaacuuuguauaugcuugagucugguuuugaacuccugacucuucugcauuaguuucccaaguacagggauuaaaagugugcaucaccaugcuuggcuuaguuaauuaguuccuaagaaagaugccuuugcuguuugaccaaauaaaagaucuuuuuuuuuuuugacuaauggugcugugcgagugaaugaaaaagcagcuguuugugugguacuugcggguaggcagauauugaagacuauuagauaccagucagaggucagccugggcuuggccuacaucuucuuuuguuugcuuuuauuuuuaguguuugagacaaggucucacuauggagcccugacugaccuagucaccacauagaccagguuggccuugaacucacagacauaggcuugccucugccucccaagugcugggauuaaaggcauguccaaccaugcuuagcccuugagcuauacaccuuuaagaggcuaggaagauagcucaguuguuaagguacuugcugugcaagccugaggaucagagcuuaguucccagaucucacauaaaaaagucaggcauugcuggcacauauuuauaacccaggaguuggggaagaagaaacuggugggucccuggaguucguucaccagccagccuagcauacuuggugagcugcagguuaaucugagaacuuuucucaaaaaauaaaugguucugaaaaacaacuguugaaauguuucuuuggucucuaaacacauauacacccccacacauguguaucugcacacauacaagcacacacacauacaaagccaaguaaacaaaaacuuagaucucaucucacugaauacucucaaauugccucaaaaaucuaggccuaaauacaaaagcucacucucuacaauuucuagaagaaaaaaauaaaaaugaaaauaaaaaaagaaaauguuuaugaccucagauaggggaaagagaucgaagaucgucaaaagcaggaaccauacaaaagacaaauuggacuucauuaaaauuaaaaacuucugagauuuaaaagacaauucagaaaaugaaaagacagccggagauuaggagaaaguauuugcaagucauacgucugauggaggacuuguacccagaacauauuaaaaacuccugccacucgacaauagagcggaguaccuaauuggaaaacgggcaagagaguugaauaaacauuucaccagagaagacuaugaauggcuaauaagcacaugaaaaguugcucaacaucauuagucauuagggaaaugcaaaucaaaaccacaaugagauaccauuacauacucacuaacagggcugaaauagaaaacccaagcauaccgccugguugcaaggcugagagaaagugggccguuuacacacugcugaugggaaaacaagggcaaaaacaaaacaaaacaaaaacaaaacuuuagaaaagagucucgccgccguuuuccuagaaagcuaaacagaaauucacccugugacuucgaggaaaugauagaucaaauagauaaagagauuccagcgaggauagagaagauuugaaugaaacaaugaacaagcuuguucuggugcuuguaaacacagcccugcauccagugacugccgaauaugcuucaaguacucgggggcgccuuacaaaggcucagcgcaugguuugcuguaaaacauccuucaaaacauuccaagggguugauaucccaggaccacuugcucugacagugaagcaauguuacuagaaaguucuaccgcaguaauaacaaugaugaaaaccacauaguuaugcugccguggcauaacucuuggaauaaacaagaggugauggagauuagaaaaauacaccauaagcagaugaaagcgaaaguaaagcucccuuguccggagugugggggagccuggugcagggcccugugccugucaccccugugacgaaggaggcuaaggcaggacaaccuugaggccaaacugagcuacugagugagauucuggcucaacgaaaguggcaugugccuuuccagugaugcuuacagacaaaaaaaaaaaaaaaaaaaaaaagcuucacgggcuucgaaaucuagaaaaucuggagauuaauaauuaucuagcuuaagaaguuagagggagggaaaacauauuaaggccaagugauuagaaagaaagagagauaaacagacuagaauaagcaagauaaaaacccacaggcgggaagauccacaaagccaaaaguuuggugaaaauagcaguaaaacuggagaaugcauggcaggcugggcugccgugggaaauggggccagcguugauaaaugacaauggggagcaggggcaaaagacagaagccgccgacaccaaguaaacagcaacaaauugaaaaccaagauaaaaaguacaaacuccucagcucugcugcuuaucaaaacugacacaagaagaaauaaagagcccuaguaguucaugaaccucagacccuguaauuaguaguuaaaaguauucucacggaggaaacugcagccuggauggcuuugccuugaaauucuaacaaaugagagagagagagagagagagagagagagagacucacagaaaguauuccaggauguaggaugggugggaacaccucacuacuuaaccugugagacaccaugacucagcaaagauggcagaguaggaucaccuggauuugggcagcauuugagacuuaugugggaugugagagaugaggucgggaagucugcagugauaucuauguaauaauuccccaggcagagaacaugaagaccugggcuuagcaaauacucagcuggagagcaaggauggagcagggcccagggaucggccugggaugacaaggucucauggugcagcuuguaagccucauggauagaagcggacccugaaaggcagguauuggaggcugggugguauccucuaacaggaaauaaguaugcauggccuggcuucuaggacagaacuaggcagaaaugcugggcacuggggccucucccuccaacccaugcucccugcccccagaugcccuguggacagggucuggaaaccagagugccccuguguccggcuucaagccacaaacauuuccugcagaaaacaagaaagucagucucuuggccccacugugcucugcauaucagcccgacagugugagcuuggcuuguaaaauaaacacugcagcagguccagguccaagaagaucuaagaacaccacggguaagaggugggugggaguucugcagagagacagggaaccauagggaagccgaggcaggccagggaacagaagaggggugccggaaccagaacuccgggguuccuauuacagggaugacaagguggcuuguaccaucuugaauugccacuaguccugacuacuauagccaguggacaaggccaccaccuccacccagccuuggcucucagaguugauucuagccuccuuaccaaaggacuaucacacuucugaaauguucuucucuuacucacaucugugacugccaucaggaccagcucuuuguauaacuaacugcgugacaggagacugccugauuucuagaacaaaacaauccauaaucuacgacaaaagcugagaguguauaauggcuacaggaagggagccuauggguaugcucucccugguaugaauuccuggcuggcaccuuagggaacucuggcugggcucagccagccuggcuggcaccuuagggaacuccuggucaggaaccagcuggccuccccuaagaaucccuuacaaguagacacacucaauaucuuugguccuuagcuugauccucuccuuccaugggguccagguguuuguaagugggguucagucccugugaugugggcagacuauggugggauacacuucacagcugagggacuaagcugagcuaggcaaguugcugggcacuaaagacuugacuuuggccagucuguagcuggccuggaggggugggagggaggggcugucagcagggaagcccaggggcucuggcugggcucagccaggcuggcuggcacuggcucugcucugggacugcugggcucccagggauuuccuguccccuacuucccaaggucagcaggauugcgcuuggguuguuucuggucccgaugguuacguugauaacugugauaacguggggcccggccaugccaucgugcccucugggcccaacaaagcucuuucccagggucuguccccacagggggcaguggucccggacaagggagggacugggcaggcugccaugggcuguuugggucagugcaucuugacagccucuugauguacaguggggguccaggcuagagcccugggaggagccuugguucagugugaccauggccuuggcagaggacccacuccuccaucuuaaccaucuugagguagggagugaaagugagaguggugcccauuagguguuugcugcaggauuccagcauucuugacaaccuggcucagagcccagacagggucaaggucaccaggaccucugaggaucggccuagcuuuguuccuaaacuuugcucccagaaaccauggacucuggaaaaccagcccuuuguuguccugaccugaugaaguacuggcauguacuucugccccugucccugcuccugcuccugggccaguacaagcuccaccuuagucauauaaagcugugaccugcucuuaaacccuagacugcugcuagucagucauauauugagucuggaaaggggacacugauuuuaggagcuauuaacaaucaucuucugucacuuagaagagauaacagguuucuggucuggguuugagggguagccuguacuauagguaaugagcagaaggagaaagcuggaacaguuagaaugggguagaaauuugugguggagaaauuaucuggcacuggagacaguaggcauuugugucaacaaagcguagggagucuucaaagccuuauccuaugugggccagacuaucuuuugccuaccuucccaguugcagcucauauugagagucagaggcaaauguugcuagagcaacccagcagcaaccacacucaccacucaacugaaauuccacuauuuuuagcuuccuaguuauguucagauaaaauccauguacacagacucaaguugucuggcaagauaacagcacaccucaaaccgcagagacuucgaagaccagcaguggauuguaccaugugcccaagaaaagucccccuaugauccagagcuuccaguggcucaugaaagguaggguggugggcacagaagguagggggcaauggaggagccuauuugccuagcuaauaccagcugugacauucugauagcauaagauugucggcagccagaguaugcggaacgguagcacucuacaggguaugcacucuacuguacaugggagccuacaguaguggauacuaaaaauagccuggccgggcagagacagaggagccuagcacacuaacucaagcuggaucuuccucaccagccagguccaggauaaguagaagcugacaccauccaggaauccaccccagccagguucugcaucuucugaagguuuggcuuacccaaagcaaggaccuuagacaauuggcuuauggggaggcccgugugaaucuggcugcagccaccuccuggcuaagacacagccaggaggcucuuagagcucuaaggguaaggaguggagggggaaagcuaggucauguuuaagacuucagugcaucuggcucugcaaucucacuccuaccuucccagggcagcggcagggccacaggccuugggacaccaggcagaagcagccaauaggcaggucucugacuuugcaggcacacaacugugaaguguuuuggcccagccacugugcacacuccuucucaagaacuucacggaggaggucagagggguguggagcuaagcgggggcacuugggauacugcacuggccgaggaugguggcaauuaaagcugacagagcugaagcaggaaccuaccuugucuuccacccuguucagacgggcaccgaugguguuacugccacggucuuugcucuuuucuaugggguaaagcacaaagucagggguaugggcugugggugugggcucaggagccuagggagcaggagauggggaagggguagcuggggaguggggugggaugaaugcuugaaaauacaagacuuccuuuaaaauucuuuguggcugggacaccagggguugggggaaggguagauacuauaaugacagaguguaucuaggcuccagacuugcuccuccuagcuugggguauguuccuucuagcuucuacacaggaggcccuagugaccugugguaaggaaguuaagagacagacaggggugggaaagagagccccuguggguugcucucuccagguaucaguguggacacccaccugagauggggaugaacaaagauggcuucccaauggacugauccagccuggagagaagagaggaacaugagcuuacacaaugccugaggcaccacagagauaggccauuguguccaggaggacagcaugacacccacuccaggggcaucugcuacuguuacuccaagaccagccaagaggcacccaagacccuaugugcucaugcuccugagagguccaggcaggaaguuuaaaaaugaggagcagaaucugggcuccuuaggcuuccucucuggauaagugggguccugaaccuuugaccuuguguauggaagggacagucacagucucccagcugcacuccaugauauacagagcuaggucugcaagcuagcucaugaaacuagccuccuagaccuauaccugugcuggacccaggggacuuugauggaaauaggauucaagaccauguuggcucugaauggucaggauccuuagcuccacccaguagcagaaagacccauggauggauggguaaccuagagggagaugucacuaagaaccuuuuccuucccugugaggcuggggcgaggucuccuuucugugcccaccuucucuguaguucuuuaaugcgcaccauaagguucagguggcccugggaguacugcucgaugacaucucgcacgucguagggcuuccgugcuugcugcaggccagaaagacacgugucauuuucuccugaaucguguaugcucaauucucaacacagugaugggguggggugcagugauagggaggaauggcuuagaacauacauaguagcaggcuugauccccaaaggcuuagccugucugggccuuucccuucugucaguucacugguaggacuagccagcuccuacuggcccuuuugguuccaggccuccucagaagaguuggccucaugggcuggagacaugguccugcauacccacaguucaucugggcccuagacuucucugaggggggagguggaacaacacagguuguagauggcucacaaugccacaaagacuuuccauaagacagcccagcucucgugaaggaaggaccugccaugcucagggccauucuaggcaccagggucaccacauauucuguggucuacacauccagggacuacugaguccaagcuugggauaauacuuaggcagauccuuggucuuguacauacaucacucugaacuucuacuaagaacuacacuugaugauaucuccaggucuuacucucuucuguaagauggagauauaagcccugauccucccuucuccaagaugcguuucugagccuugucgcugucuucuguaaaacaggacacugaaucuuguuccucuuuccuggauaauggguugcugaagucuacgcugcuacuucuaagagagacugagaauaaaauaggaccuagaugaggaaggucaaggaauccugaugcaguaccuugucagucauagguggucaugacugaguccagggucugaguccuuccugaaagggcacacugaaagugacccuaaguaauaggggagagacuugugggagaaaaugcuuucuaaggugugugacaccucuaggcaugccuggugacacaugaggugaaugagcaagggaggcagaaacuauguguuugagguggugcaggccuggauuagaagcaggacagauccuuauguuggucuguggauagccugagagucugagagccucugugcccaagugaacauggguaccucugcuagccucugcaaacauacaugugauuguugaauauguaguggggagaagugagucugccaggcugcaggagggcagggggcuguaagcaggaaacaguuaagaaggaucagagagcugaccagugguggugcaugcuuuuaaucccugcacccaggaggcagagucaaguggaucucugaaaucaaggccagccuggucuacagggucuguuccaggacagccagagcuacacagagaaacuuggucucaaaaaauccaaaaccacaaaacaaaacaaucaaacaaacccagaaggaucagagauacccuaucaaccaaccacccguggucagcagcacuccaggccugcugagacuugucuuggagccacuaagcuccccuuuagagucugguuggggauugaggagccuuugucaaauauuugccuaaggcucauguaagagacaaucuuagcuuucucccugggccaauguccccugguggcagcacgagccagagaugagccagauaacgcugccuguccagacugauuggcuguggacgugggugcucaaggcaaacuuucagagcuaagaggcccuggcaccucaggccagacacaagggcagcuggccaagcacuuuaucggccagcaaggcaggcaggcaggcaggccuaaagucaggucaguauagcgguuggagagcaggaggguggauggcugaggcaagaaagcugggucaccaggguggccuggaagccuguggagcccuccccacaggggaucccucuucaacuacuucacucuuuccuggaggccugccaccaccugcccauguguccccagcaauaaagccagcucacuguagcaccccuacuuuucucuguaccccauaaggccucucugccaccugggcuaaguguauaggugagaagcagcgagcuggaaggcaggagcaguuuggccuguucuggcaguuuccugagccacucuuaggacauuggcuaauguucugaggccugacacaaagugcuccgggucucuuuuucaucagccaccaacuaugucccuuguuugugacauagaaacugggucugcguaggccacuaagaugacucugacucaaagggaccauaagggucccuguguuccacuggguacccagagucuaaaagugaaccccagggagcccugagccuaccugcugcaaccccauucaacugagcaguuccuauacuguuucauguagaaccuuuuccaucacccacggagccuauuucucucagccuggggaccgccaucaacuagcaauuccucaugacucuuuaaacacuagcaacauaagcuacaccacuuccuaguaagagugucacacccuagccccacuuuuccccugagagauugucuugucaagauauaacuccccaugggguuccugugguuccucaccaaacugggaagagcugguucuacagguacucaacucccuaucucucucuuggugucucagcagugggacuguaggucacguggcuucuagguaggggggagaaacagcuuuaaguguaauuuuuguggggccuuuggacccuucuaauccauuuccaggugcuucuuggcucuggccccugcucagugugaccuuuacuccuuuugacaacaugaagucccuagguuuguggaagcuugggcauaacuuggucuauuuguguugugacaguuccagggggugcaggcuaacaauuuuauagcagagugccacuguguuaugugcuggaugggcauagggucccuccaggguggcagugaggagcuagggugagaagcuauaugcuacucucuuuagugucagaggcuuggcagggggaggggcuguggcuguucuuagggcuagaacagcugaggagcugaggacgacagugagacucaugucacccaaggcuccucucaguacaaugaugacaacuugggauggggacuauaccuuggccucuaccuccugcagagucuagagguuuuggcugccccagagcugggguggggguugugaugaggggguagggggagccaguguuaaucucauggccugguaugguaggcguggccuauaacaaggcacagggccaccacugagauuguccuugggcaggcuauauauacuaagguggguugccccagccuucucugcucagugacaagggcuuuccaguaagagaaugcucuccagcacuuacugcaucuacugacauguucucagagugaggaauaaggcuuuccuccccaugacuucugcucacaacugucccagaauagaggaggaacacaaccugcuacccucggggucucagcagaacagcugauacuaaauggaccccagcagcagcucugccaacgcaggagcccuggucacuaaucaggccccaguauugguaggguaggauacagaaagcuccaagcuagcugaggacauaagucacuuaggacagaugucacuuccaguccuggugacaaugccaggcugucaccaucacagccuugcauggaaggagaaguagucccauaaaguuacuucuaacaaucaacauagagcgauaaagggacccugggccagggcuggguacaguacccuuggaggagccugcugucuuggggaguggugauggucuaagggguacagucacagcaugauggcaucuaagggugagggcauacuacuacuguagucgucucggggucaacugcgcuggguauggucucaccuggaauuucuucuuggcuacaaaguacugcaugcgccugaugaccuugaugguggcccgauggugaucccgcagccuguggaggagguggggcagagugugagcagccuucacauuggugaccccacaacacauguuaaagguaccccugccaaacauggguagucucuccagaaacaagaacauucuauccaggacuuguucugucucuagagaagcuagacauaaggaguuucugcaggggacagggaaggaugcuacccacagauggggagaacaacuccuuuccugcuuuuaucucacaagugggguggcugucuguaccccuaguuugcaaggguuacaacuccaacagcauagucagggaaugcccuaggaggaggguguacuacagucuuauuaaugaagauccuguuuccugagacggcuuggauacuuuguugguuugcuucuaaaucuccuucuagaaauaaagucuuuuuauaaacaucacuggagaaggcaggccugugaucagacaucugugugcacagaaacagacuggaagacagggcaauggggagacugggaaaaucugcugucugcgaagcucaaauuugaccagccaggcuacaccgcauuggcaacagagagcugcugggagccuuugggaaagggagacuggaagcugcccccacccccuagaaaacaagaggcaagaggaagccagacuaaccuccaggcugggcuuccuucucagaggagugugggaaaugucuacaccagaugggauggugggacuuccugggcugugaagaaaacaguggagccuaggcuccagagcuaccaggagacaagugacaagauuccggagaacaaaggcuaucaggguaucuuuuuuucacacgauccccccuuggaaauagcugugguucucacagagcaauaguagcugcugggagggaguaaaaauagaagccagcaggcucuugccaccgaggacaggauucagacccuucuagcaugggaccccuggaaacauccagaggauuugguugagucuggcacagccucacauugucucaagcguaaacuagcccagcuuucuuuuuuguauuagaugaaaaucuguagcgagauauuuuggaauuucugggguuugcuuuguuuuguuuuuguccauacauaaaaguugaaaaauaagggaaaaauagacccuagauagagaucugcagguguggugcauuuugcaaucuuaacugcuagaggcccucccgcaaggagacagugugguuuucuagcugcuuggauuugagcugaccuugugaccuaauguggcuguagagcucuggggagcucuccauguguggaacccacagguguugagaggguggcuggaguggcugaagggggacgaguggaggugaccagccuucagucagcacugauuggagguaugugacucagccaucuuggaucaccuggcccuaggcaagcuacugaugacugcaucugucugagucagcccaagcacaaccacagaacuaccuuccagaggagcugaguccaaacuccugacccauggggcuguuagcaagacaaaugacuaguagaccacaacauuugguuauaguuugcuguucaguaauagauagcugauaaagaaauuagaagcuggaccuauacucccagauauuuagaaggcugaggcaggaggaucacaaguucaggcacugucuagugaacagagugauuucaagccagccugaacaaguuaauggcaucauaccugaagaggcaguucagcaguuaagaguacuugcugcuugaacucccaaagguacugacuggguccaguccccagcaccaacaaucucugacacaaguuucaggggauccaauacccuuuccugaacuccaaggacaucagauacacacaugcugcacacauauacauguaaacaaaacauccacauauauacaauagaauaaguaaaacuuuuaaaaagaagaagaagaagaagaagaagaagaagaagaagaagaagaagaagaagaagaagaagaagaagaagaagaagaagaaggagaaaggcagggagcuggguguguugguaugcaccuuuaaucccaguacucaggaauuugaggcaaguucacucugugaauuggaggccugucugaauuacaacagagaguuccaggccacagagugagacccugucucaaaaaaauggaauuggggcuggaaacagaucagugguagagugguugcuuagcaugaacuaggccguggcuucaaucucuagcaccgaggaaaagagagaaaugaaggaggggaagaagaaaggaaagaaaaagagaaagaaaaagaaaguuauuaauuagaaccccgagcugggacauugugaugucaacuuuguauaaaagauuugacguugauuuuaggacugggaaggggugggggagcagauggcagaagauugggauaugugaugguguuugcaguuguaagaccucgaagucuguuuggagggagaaagaacuuuguuucagggaggacugugaagcaauggcuuuuaaugauagcugaaaaucccuucuuguuccugccuuguuccgccaugguggaagcagaucaugugaucugagcuucggccucaagagaucugcagacuucacuuuuacccucucagaaaaaaaaaaaaaaaaaaaaaaaaaaagucugccuccuggacaagcccgagcuagccugcuggaaaagcugagugaaggaagaaaggugaaggguucggaugacagcugacagcuucaggcaugugaggcugacacugcucagccaccaagugaguguucugcccccagcagugcgcccagcagagcagcccaagucugaccuacagagucauugguagauaguuggcugugcugugcaucagacuuucuagaugagaacuuuaagauaacugugauaaauagagucaggaaaauagaugagaagaugagggauuucaccagaugauaaaaguuaucuccaaauacugaaaaagaaauucuauaaaagucaggcaugguggcacaugccuauaaucccaccucuugggagguggagucgggaggaucaggggguuccaggucacccuuggacacagagguucgaagccagccuauguuacuggagacgcugucucagccucauucaaagucucccucucaaaaauaaagaaguaaauaaaugaauuaaagaaggaaaagagagagagagagagagcgagcgagcgagcagcacacugguggaaauuaagacuacauacaguaggugguuugauaagaggccauguaguaaaacaagaaagaaaaauaguaaaaacagaauggauaagaauaagguggcagagaauguggguuuaagugaauugauaguucauuaaguagaucaugauugucagucaggauuaaaaaugaugauaugaauucacuaaaagcaaagaaaagagaaaggggcagagaaaaagguggucuagucuagcuuucuaaacagcagcugggaacuagcaccagguacaguagacuagacaaagaaaauuucggacuuucaaagucucagcucugggcuggcuguuaaagugcuugucuuacaagcaggaggaccuggguuccuuucuuagauccccccaaaaaucuaggcauaguagcauuguguuugcaauccuauggcuagagagugggacacgaagauuccuggggcaggccagugagagacccugucucaaaaagaaaaacaaaaaaaaguggucugcagcugaagaagggcacuaaagguuguccaggauucccauccaccuugcuucccuggcaauggauaccaaagcaccagcagagcccaauaugaacaaucuauaugucaguccacccagacagggacaaaagccacaccacggcuggccagcacacacaaguauuuacaaagauaccaagcgcuagguuuuaaaagcaaguuucaacaaauuucaaguaaauaaaaugauguuuaacauagucuuugaccacaauaaaauuaaacuacaaaucaaaaauauuacuaggaaauccccaagugcuuuggaaauuaaaugaucuaaguaacccaaggucaaggaaaaaaguuacaugaauuagaaaauaguuuuaauugaauaauaaaaaauguaucaaacauuacagcuaaaguguauaccuauaaucucagcaacucaggaggccaagucuugaagaucacaaguuugaggccaacccacgcuauuuagcaaacuggugauuuuuuuuguuuguuuguuuuuuguuuuucgagacaggguuucucuguguagccguggcuguccuggaacucacuuuguagaccaggcuggucucaaacucagaaauccgccugccucugccucccgagugcugggauuaaaggugugugccaccacgcccggcugcaaacuggugauuuaaaaaaugacaagauggcucaguggguaagggugcuugugcccuagccugaagaugugaguuugauucccagaacucgccugguagaaggagaaaaaccaacucucaaaaguuguccccugaccaccacauauggggcauggcacuugcaccccccccacauacacauauacacagauaaauaaacaauauaaauuuaaaaauuguaucuucaaaauuauaguuaaauaaacguuggaaauacauugagagaugaacauugaggagaagauaacacauggccuaaaaugugauagaggagaggcugagauccaacucaaguuaacacacacacacacacacacacacacacacacacacacacacacacacauuuaaacccaaaggaagucgaaggaaagagauaauaaagauaaggguguaaguugaugaaauaaaaaaugaauguugcauuaaagaaaaucaacaaagcuuacauuuggcuuuccaaagagacuaauaaaacugauaaaacguuagcaagauagaugggaugggguaaggcgaaucacaaaucaccaauguugggaguuuuaaaauaaugagcaccaccacuguggaauuagagacauuaaaaaaagucuauuuagagaauaaugugaacaaaaauaauucugauaauauagauaaaauagauaacucaucaaaacacguuuuaagaaaagaagaaauaaauacaaacugcccaauggaauugaacuuagaauuuuaacgaucuuucuacagagaaguuggcuuagaugacuucauaggcggugucuccccagcauguaaggaagaagcccccagcuauauacaaagcuucuuacagggcuuuucugagguggccuggccuugacucucaaaucugacaaggauauuccugaaagaaaacucaagggcaaugucuguccugcauguggaagcagcgucuaaaacccagcagccagugagauccggggcucaagucaagaugcaggaucagaguggcuuaauccaguuaugcaaggcuggcuuaacauuugaaaaucaaucaacagaacucaccacaucaacagagcaagaaaaaacauauaaucaacucaaaagaugcagaaaagcacuugauaaaguucaaggcccuaguccuaauuaaaaacacaacuccuagcaaaguagaaaacacaauuaaaaaaaaaaaagaacaaaaaugaaaauugaaacaaacaaaaaauccuaaacacugagcacacaucaagucauggagaaaucacuuuguuccugagauggugugucccauauuuucuaacagagauuguaaagucccagcuugugcauuaagaugagaaaaggagagagaagauggaaggauugggcugccaaaaggguucaauggcuaaaaaggcuugccuccaagccuggugaccucagaacccauauguugggagaagaaaccgauuccaacagguugucuucugacguccucauucauacugugguaggcacuuccuaccccugccccccacaaauauaauauaauuaaaaguuaaaguaaagcacuugggaggcagagcagguauaucucugcuaguucaaggacagccagggcuagagagaucuuaucugaaaaauaaaacaaaucaaaaauaaaaccaaaacgaaauaaaacccccaccaaacaaaccaacaaacuauuaagaaaugaauuuaggagaacccugaccuugcugggauuggacauaguagcucauguauguaaucccagaaaucugaaggccaaaaaaugaggauuggaagauggagcaagccugguuuuacuaaagguugaaagcuaauaauccauuaucguucuaucugcuagcaauaaguaauuagaccacaaaauaaagacacuaacuguaauagugucaaagcuaauagagcuauuuaaauuguuagcaggugagacuuauaggcagacaagcacuggauagugagaagcggaugcugacuugaacucauggagguuauaacacauucuuaucuuggggcuggagagacggcuccuugauaaagggcacugguuugcucuuccagaggaucuggguuugacucuucccuauuucucuguguagcacuggaacuuucccuguagagcaggcuggccuggaacuuacagagauccaccuaccucucucugccuucugagugcugggauuauaggcaugccccaccacugccuggccuggguuuaauucuuagcauccacauggcaguucacaaccaucuguaaauccagucccaggggcucugaagccuuccucugauuucaagggcacugcauguacauggugcacagacaugcaugcauauauauacucauacauauuuaaaaaaaauuuaaaaaccuguguggugguuugaauaugccugggacagggaguggcacuauuaggaggugugggaccuccuaacagugaagaacuggagaaaggcuaacagcaaaaaguuuaggugucuuaucaagguccuuccucaggggagcuucauucaagggguucugagucugcaaacuggcucaagucuggaaauugauucacuggccaagauugccuuuugccaugauccaauguagccuuucuuccauuuguuugagauuuguuuuuucuucauauacagaucaaacagaaauguaguaggcuuccuaucuauuucaugccuggaaacaccaugauugauuagucaguaccaaagguccguacaagucaugucauuauuaaaauucacaucuccugugcugaccauuacggguuaggucauugugaaccuuauuuugucuauacuuuccauuauaauaacuacgaucaacuugccucuggcgauauaaugcugccaucuggcccuugcuaccucagggcccaauuaaacccauugcauuuaauccauccaauugagcagcagcaucuccaacccuaaggucuggcacaaggaaaagggcaagaacaaaauucuucaaaugugcugcugccuucucaccaguuugcgucuuauaggauuugugaagggcauaucuucugagccuucccauuguggaggauuagguuuuauacaacguauccacucuagcauugcaauuucccugagccuuaaaaucccuugucaacacuaagccaagggauaucaggcaucuucaacuccuuuucaguaggccaucuuucgauaaacacuucaacaaaccauucaaacaaacuuuugacacauccacagcauaaagaaaaauacugguaaagccugugcauuaaggcuggcagggcaaugggguggagcaagaccuuaggcguuauaaacauauaugugaccauuggcuuuaucgucgaagcuguuuccaucgggaaccaauguucucaguaaaugugcuuagacaccauaagaagagacagacacugauuccucccucaccacagcugcaaagcuagccugucaggccuugaacaggaagcugccgagaucagggugugaaaggccauagagugucugcauagccuugggcuagguaaagguuuccuuauggacuccugggaacaugagccaucggagaaaaauuccaguaacgcuggacugacaaacuggaggcugccugaaacccuucauuccaggccuggcuugaggagauaugacucugaccuuuuuccaccacucuccaaaggccugaaagugggugaaaagugggauuccaugaguaucucacugggaaggguccuuccucaacugugauuguagauuguagucuugagaaccuccaguuuuggcugugguagccaccagccugaaucuuguauuuccaucccuugguuucuguuuucauacacacacacacacacacacacaaauauauuuuaaaucauauaucuuuuaaguuaggugauucaacaacaacaacaaaaaaaaaaagaguugggcacgguugcacauaccuauaauccuagcacucuggaagccaaggcagaagaguuguagugagugugaggccagagauuaagacucugucucaaacaaacaaguagauaaacuuaagcaaagguuacucagcccucgguauuacuccauugcugaaagccucuuauguagcugucugccauuaacacaguuacaugagcugucauaaaguucuccuuagcuugaacaucuauguuccccugacaaggguggggcuagugcuaggucucaggccuguggacagugcugggacacacauucccuuuucaaggucugaguaccagaguuuccugugggugcaaagccagacaggcccuugcauaccagucaugugacucccccaccucagagaugaugucacauuuuuaaagugauggcuauacacugaggaaccaaaugugcuuccucugcugugguggaagcaggcuggggcaggggguuccuuaaaaaugugaccccucauaaccacagcucuacauauguauucuaagaaacgaagacacaaauucauauaagaacacagaugugagggucauagcagugcaauucagaguagaucuaaaaaucugucagcaggcagacacacacaagcacgguuuguccgugcaacugaguaucauucagccacacaaacuaagaguggugacauuuugacacauaucacaaaacaaauaaaccuacagggcauugugcuagguaaaagaagccagccacgacugaccccaggcuggagagccccagcucuaugaaaugcucagaauagcacauuguggaaauuugagaucggugguccuuuaggcagggaggauacggggugacugcugaugggugaagguggcuuuugagggugaugaaacgcuccacgguuagcuaguggugauggcugcacagagugugaccaugcugacgugugcacagagcauuguagcaggaguggcugccuugcagaucucugcagagagcucagcuggagagauagggaagcucuggaggguggacagaaccccuuucucggguaucccaggaacccaggcaggcaaccagugggcccugaaguuggucucauuuccucucugugugcacaacaguccauccuugccccuucugcccaacccccagacaguggaucacaggggaugcuuccaagagacaaagcucagcuccugugauuccccccaccccacacugcaauccuugcuguagcucccugcuacacccaaugauacccacaucauucucaggguagcucucgguucauuaucaaaaaacaggacagugaacuuugacucucuuggcaggucuaagugaugucucaucacguagaguguucaauggaugguuuuuaugucuuugucaaauuauuuccauauuagccauccaugugagccacccuuugcugggcccccgcccaggccagccauagcagacauucuuguuuggcacuaacauucugcagggucucaggggcagguggcugcaaugcaaaggucacccauuucaacugucccagagcugaaagaggagggugauucuguuuccccagucaaggcucuugggucugagugucugcauacacuaaaaacuucaucuccaaggagacugugguggggccuuugggaggacauuaggucaugagaggggcacccacaugaauaggguuaaugaucuuauacaagaagccugaggggguuuaguuaucucuuuuugcccuucugccaucugccacaggacacacagaagacacuaucuaugaggcagacauaguccucacuagacacuaaaucucucagagccuagacucuggacuucuaucuuuagaauuuguacaguaaaucuucauuauuuguaaaucaucuagucuaaggcauuuugucacaguuagggcuaggacuguacuugacucugagaaaggguguugauaaaagauacgguggugguguuggaagggggaucagagaggggccugugaagcacagaaagagagauugaggagagcucaucagaccuucagagcuuuagggacagucucagucuuccuaggcaugggcaaaggacuacaguuaggaugcugguaggaauggaggcaggaauggauacacuggugagggcuucguagaaauauggaguaaugaaauagcaaagaacguaguggcauuguguuccaggaugcuagugcucuguacaggauggcacuugugagaagugaacaaggcgguuuagcagaagcuaucccucagcaaaguguugauggugccgauuggcuucucuuugcugauaguacaaggugaaaggagaaucacaagccggugauuguuguaaggagaagaaaauguaccugucuagguauacucagcucccaggaggaagaaaagaaugaaaugacuccaggcaugguggcacacuccucuaaccccggcacucagaaggcugaaacaggcugacugcuuagacagaguucauguuagccugggcuagugucaggccagguagggccacacagcaagaagcacaguaagacucucuuucaaaccaaccaggcagauagcaaugaaaagaggcauguucaugauaaagguuggagguuagaacucgguaugucagacgggggaguugaugcugcucgucaggugacacaaagaccaagaggcauuucaggaagcauagcccaccuuaucccuuacaucgcaagcuucugccucccgaguucaagugcagcagcucuaagaugccccagcuggggcuucagaagccaugugaaguguuagcacagugacuaccccuccagugaguggcaagucuugguggccuucauggagucuugucuaccaggcauaggagcuaaggacagauuugucuccacucagauucagaacugaguggagacaaagaacccaaauaacuuuuauacccaaagaacuacagggcugaggcagaacugcuguagggaagggcuaucaagagaaauuccuagucuggacauggugggagguuugucccaaaaauccagagagucagagccaguagcauugaacuccaaccuggaugacauaugggauacaucuaguuaaagcauaguguuacugauaugugggguuuuggcuuaguggauccauaaagugggacaaagaccaaugauucucagcccuuacauauucgugcuaugugaccuguugggguuugaauguacuugagaccugcuagucuuuccuucuuguucauuucuuccuuugaaaggggaugucuucuucagaucagcuccacuacaguaauuuggaagcucauggccuuugcaguuucacaggcuaauagaucuggagaacaaucugccacaggacaagucucaucuaagacucguucauuuuggacacuggagacucuuguauuaguacugaaauaagauaagaucuuugagggcucuggggauucagugaacuugagggagcuaagucugaaugcuaugaucugggugguuauacuauaauccaucuguaacucucaugcauggauggugcaguccuggugugguggcauugagaaguggagucucugggaagggguuagguccugauggccgagcucucaugaaugggaucaguauucuuauaaaagaagucugaggggcuggggauaugggucugacaagcucuugcuuagcaugccccaaaucccuggguuucaccccuaauauaacccagguuuauguucaucuauaauuuuacuacugaggagguagggaccggaagauuagaaguucaagguugccuucaacuacauagugaguucaaggccagucugugugcccuggggauaaagaaggcagaguauaccaggaccuacucuccauaauagcccuaagauaauuagaaaacccuaaguaaguuccaucccgugccaccagcauugucuuugggggacaccagaaaagaacugguaagagugagggaggcuuguguggaagagcuuccuaaggcagggaccugacugucagugggaacacccaggcucagaacaagcugccauuggcagauacgucaaggggguaaaaggcagaaucuggacaaaauaggacagccaggaguggcccaguuugugaaaaugcccccaauagcuucuccuagcuaagucuggggaggagagugggggccuggccacuaacauggggccccugucugacacacuaguggucuguccuaugagaugaacaugaaccaaacacuuguaugaauauaggaguucccuuuaacuagaaggaacaaguuccaagaugccaaucagaugcccaaagucaagggcaguucugagccauguagcuagaggagagacgacacaauuagcagugacuuccuuucccuucuuuacaauuuuacagauuuguucugccugugggucuuggcaaccuagcaugcaacuguuuccuuuccuugcagacacuucuucuuuuuuucauucaaaggacauacuuuguggccucuucagcauaccugcaucaugacugauguauuuuuuuuuuacuauuuuguaucauauuuuacuaauaaguaaaauuaaagguaagcauugugacacccagaaggcagaccuguugagacgguuaccaagugacuaagggguagguagcaaaacacucuggauuugguugacagggacuucacucauaucccaggugggauaggggguggauggcacgaaucucauaacaguauuacaaagacaaacaauuaaaaacucgugcauuguuuauuucuagaauuuuccaucucauauuuucugaccauaguuggaguaauuaagaaagcagaaagggaagccgaagacagagggaauuauuguagccauacaacgacugucuuaggggauaucucaaaggacuagauggagucgggaaacuguucauccaaggggacugacgccaucaggaugggagagcuaaguguaaggugguagaugaaagcuguaaguuggccugcagaaauaaggcuuggguagcaggcuggccugaggaggcucuguguaguuccacuagggccacauaaagcaauacacacacauaagucauccagagaccgaugccaggcagcacggccaugcuaagcaucaugccuugguuuuaugagcgugcccuacccucaugcugaccugagaguuuuccucagacacuccuuuugcagacagacugcauguucaggggcuucccccugugugguagccuccacagauguacaggcacauggcaucaccaauccugucccccacucauugcaugugaaagaauaagggugacacuuagggagugccuacccaggacaaacacauaucuuagaacagcagccugguuugggaggagauguguggccugugaaaggaggauucggucaggcaugguggcacacaccuguagucugaggcagggguacugcaacaaguuugaggccaaccugaucuacauggugaguuccagacaagccaaggccucauagaaagacuuuguuucauagagccaaaaugaacaaaggacagaaagggugguuggugggaagcugcugaccuggcugagaauuuggaccacgggguaugcaggugagucuguagucccaccccacggcucucagcacuaaugaggcguguguuucacaccaggggaagggguugcugggguaggauggaugucugcuuugagaaucagcucagcccuguccuuuuuuuuuugcuaguagagagacugccauuccaggucugggccuucucccaaagguggcaccuguugcuacuauaggcuagggugaagagggaaccuuccugacagaaaaguccuagguucauuucuucccugagccucagcugguuccagucaauucuuugauuuuugggagucuccggaucgaaagagcccagaaaaauaaaaaaaaaaagaaaaagaaagaauagauaaaguuuucauguugacaaaggagcauccugggaggaaggaaugccaaaaagaagacacacugguagcucugagaaucacauaguggcucuggacccauugagguaacaggggugccagugccccaaugucacugauggccugaaaguccagggaaaccuguggggaacugccggguagaaacagaagagagacacgucuuugucuggguuuguaccaguaggaucuggugcccagaguugagaagccaguaaaggcugggguaugggcaggcacugcagaggacccacuuuaauccuggggagaagccaggaagguugggguaugaacaagcacuggagaggacccuguuucaguccuggggagauuaugaggacguuugcugcagacugucagcccucauuaaguuaauggaacuggcgaguuggcuaguuuccagcacauuggagaaagaaaacaagaaaagcguuuucagcgaaagagccgagagaucccguuucgcucagcagcccccgggagauuaggggccguugguaauggccucgcugaaauggcuuauuggggacuuguugauuaaaacaagggagagaaacuccuaaugucuaagaagaauuacacaggcuaugucuagagaagugauuugugcauaguuccuugugaacuacacagcaaccugggcacagccagggccucugcagccacuuggguuacaaguaggacggggaaagacaggaguuaaacgaggggcauucaggagguagcagcucucuggggcuccuuagagagggccuuagcagcccagagcacucggaccccagaacauaaaaccccugaagcuguguacaacuggcaaaccuggcaccucuaacuagccuuccugagccuuucugggugggacaaaaagucccggguaaaucugccacaguguguccaugguggguuugucucuccgccacauuuugguuuguguccagauguuuuccccacagacuccauacauaaccugccagguaacccauaagcucaccuggcaacuaacuuccaagggcuuggccuugugcagaggucccugacauguuucaaucccaucuuccucuggacugaacucaaauccuagacccagcaggccucagguugggagccaacagauuccacucugccccaggcuuccagcaagauuuucuaggcgcuuagcaucuuuauuggcuucuuaccuagguucguuccccuuauccuaaccucuaucaauacauuuuuuuuuuaucccagacaucccuguucuugugcuuuaaagcacauuuaauaucucgaauugucucccuuguacaaaugaggccagagaggcuuagcaaaugggucacacaagcccagcagcccucagugcucacgcuuugccugcagagcagagcacucagucucaucccuagcugcuucucugccucacccacuggggucaggccucuugaacaacccucauuuuauaaguuccccacucuaaucccccaagccccuucccacagagcccguaaacuuuucuagacuuggcugguggguccuggcuccacauuggaaacugaaguaugugggaccuuccugugggugcugaaggaaugaaugggccuccaaaucagacgaaggaucuagaccaaggcuugccugagacagaaccucguuccuccuaaagcccugguauggacugaguguucaccaugaucucccauuagcuuuugcucuaagaaugguauggggguguggucuuaaccuggccugaaaccuccucucacuucagaguccuauaaucccuaaaugucuucugucacacaguucagugggccaagagcugccuacccuugagcuaagguuagaaucaaggacaaggugauaucugcaaagauggaagcucucccaagggugaaggcccaaaagcuaaacaagagguggggauguuggucuacugacuucuacuucccugccugauuauagcccccaggcucuugguaagguugagguuaaccuagacuguucguuuccaauagaauccccagaaaggaagggcuagagggcuagcccacuacugaacacugauggaaugaacuugggguuggggagggagggagggucuccacugugagcucugcuggcccccaagaccuuaugucucagacuuccuggagcucuuauaucuauagauggguccuccuugguuaggacccuugucugagagucugagugccuucucuccauguauaugccuggccagggcaugggcuuaaauggagggcaggcaaggagucuaucaggaugcugagaaggcucaucugugggaaccccugaggacauucugagggggcucaugaccacauaacacaugaagaccccucagcccuauucuaacuugucauguugcccagucaaauauagcugugucaaauauagcaucugggugaaauauacaccuucugggaucuacauguggccccccucacuagggugaaguggggggaggggcacaacaauccaaccugugcuuccaaaggugggaaaaacucuuuucuuugucuauccaagagcugggucaagaggagcugcugcccuacccccgccuagcucuuucccgccuaguccugggccuccuucgggccuaguccaugaaggaagagcuggccuccugcccagcaguaaucucugcccuuccuuauggguagauugugaaguucugcaaacucaacacuguucucagagccugggcuuagcugucuuccaggguguucugucaguguggauaagcaguuuuuccauguauuuucaagauagcuugcucaagccagagagauugcuuuggaacuaaauguuaucuagacccaucugggaagcacaaggaaacugguuccccagggcugacugccuuaccugcuuaaguuagccuugcccaucccccuaccccuaccccaggaccuucccuuuagccuuugaacacuguccaccaugaucccacaaccuggccuggcuauucauuuccucucccuauguacuugauccugcccuaccugacucuucuguaggaauccugcccuauaggucuauuuccccagagguagaccuuucugcucagauaccugugauagccaugagcugucagccuuaggaacaguguaucuuuuuuuuuuuuuuuuuuuuuuuuuuuuuuuugagggcucuguuuccucaaagcuguguccccaaaacuuggugugcaguggggguguugauacugcuucagucaaaaccagcagggacagagugcugacugcuccagggugcaaagcugaccugcugggcagaggcaacacagugggcagggcccucccggggccaccacccgguccccccagccccucccuccuucccuaaagggaaggagagguuaauaaaccaauuacuuugggcaacgaagcaaaauaagucccauuaaaguaauuaauguccuuugcacaguccccauuggagaagacuaauaaauuggggcuuugucaccauccgguaauuucucucuaaggcguuucuucacccccauccgacagcacaguuuaaggcucuguuaaugcuuuuaagacgggcucaaugccagacuaauuagauuugcauuuccaccaugggccaggcugggcgcggaugugcccaaugagagaggcuccaggacccugccggggcccagggacagcacccgccuuugagaaggggccauguguggauucccacgccugccuggggcgauggccugcuacccugucugccugcucagcuucccgguccccggggaacagggccuauggcuuugauccaggaagaggccagacuucauucucagggggucccgccaugaaugguccccacuagggccuacagaggucaacaguaugguccaugucuuggggucucuccagagcucuguaaggccaggcccuguuggcuuuuaggaggacaguauagaaaaaggggacagaacaauauaaacauugaggagcuggacagacacagcccagccaagauagccaacccuggcauugggauaaguuguguaaacaguuggcacccuuaguggaugauagagagaggcuuaacuucuuuuccuaaccuauagucucaccuaauacuaagaaaaaugugacagaacucagcuuagacaccccagaaccuuuggagaacccauggucauaucaaagauagaaagaaauaguuccggucuagaggagcuucaggagguaggaccuguaguuguauggaauccuggauggauccuggaccaggaaggggauaugaggggaugcugaagauucaaauagagugaacugugugaggcacgguggguacugguggguacugcugcucaucgguaaugaauagacacugagauauuauguuccugacagacacuggagaggacauguagggacucuguacugacucugcaaugaucuuauaauuauaaaacuguccuacaauaugcuucacuucaaaugaaucaaauacaauaauagggagagauaagaggcugguggaaggagaggggucuucguaucauuccuucuugccuguggcacagguagauaggugucugucacugaauuggacauaaucaauacaucaucuaggagauggagauaagccaaaguagaucaucaacaacccauuaggugcugaagucuccacaguaccccugcaacccaguaccugaaggaaagaagagccucacugggcaagagaugcuaaggccugaagcuagcuauacucacuccucauggaaagauguucccugggcauuucaaccaugcaacucuuggccugaaaucaugcugaaugaaaauauggagaguaaguccuggguugaauucagccugcucuaacacuugaacucugaggguuccuccccucccuagacccuguuauccuauuuugugugauggacgccauugccaagaagaucaccaugagcucaaguagcuccauggauaggcaaggucagucagguaggaauacguuucugcagucugugaacuuauaaguccauccuuccuuccuuucuuccuuccuuccuuccuuccuuccuuccuuccuuccuuccucccuuccuucuuuccuuuuccucuccuccucuuccucuucuuccuccuccucuuccuucucuucuucuccuuugaaacagucucaguuuauagcucuggcuuuccuggaacucucuacguagaccaggcuggccuugaacacagagauacacuugccuuugcccuucaaguguuggaaccaaaggugugugccaccaugcgugacucugcaagucauuuucuuauuacugaguuuuauccuggggcauggaauuuggugagcauaaucuacagaguggguagcagagggccuggagaaaaacaggguugggccuggaccaaguuggcuagaagccugauacauauggcacagcccaagauggggaugacagggaagggacagcugagaaguuagguggggugagaaacaccaacaaugcuggauugacugagucuuggaugacaggauauguggaaugugaacagcagugcaguuccaucugccgggcagacaccugcuuggcuuugcacugcagcaugggaacagcugugaacaaugaaugccacggcugccacagcuguguauccguacaguuuaccauguggaugaguguguucacaguuuuauacuuucccaguguccuuuuccuauucgucuuuuuuugcuuguuuguuuuaguuuuucaauuauuuuaaaauguaaagaacuauuagcucaugggccguacaaaaauaaguggcacuuuucaguuugcaacccauggcaaagauuaaugaacgaaagccgcaaaacaaugaaaauuaggucugauggacaccuguguuugcguaagcucaaaaacaccaaugaacauggaugaacacugagaacuauagcaaaaucagaacuagaagguaagcauuuaagaaauuuaguauagagcuggguggacagcccagugaggaagaaauuuccuagcaagcaugaggcccuguggucaaucgucggggacuccuccccugacacacacacacaaaaaggaaauacaaauguuacuaaagcaugucuaguuuuguaguugaacucuuccaaaacuucauaaaauaucuacauggcuccagaaaacagaacaagaguuacgcugcccaguuaauaggugugguuucaaauccaugcaaggaaaauguaagaaaaaggagauucagugcaaugccacuuacaaagaggcaaaaguccuauggaaacagcuaaucaaacccaagaauguauauuaaaccagcgaggaagaauagaaaacugaaugaggaugugagccaggaaugcaaagacgguucaauaucagagucucucagugugauucucagaucaaggggauaaguacacaauucuuccagcuaguagaaaaaacaucugauaagcaugccccccccccuuccuuuuugucucuguguagcccugcguguccuggaacucacucuguaggaccaggcuggccuuaauucagagaucccccugccucugucuccugaaugcugggauuaaaggcgugcacugccacacccagcucauccuuuauuucuuauaguuaaaaaggcaaucauuagagaacagaaauagaaaaggaacuuucuuaacucagcaaagguuguaaacaaacaauucaucaaaaagacaucacagggauuuucacuaugagcugaaggagcaaggguacccauggucucuacuguuaaggaugguccuggagauauucaggcucaggaagcagaaagaagauacugugaugaauuggggaaagagggggaaacuguacauuuuugcugcccucugaaaaaacuggcagcucaucuguuagagcuggcuaaagcaaucggcacugcuuacuguacaaugcugcuuuaugccagcaaucaauacauuccaauggagcaugagaaaggacacauucuccuggagucgcagaagugaacuuuccggggggaggccuucugacugcaguggggcaccaagcaugugguucaauaucgugcggagagacuccuugcccuuggguagguggguagaauaguauagauuccaggauucucacauggaaugcuaaaccaacuuaaucuggagaaaauucuguuucacaagcaaacugaacuccaaagcugacagggaggaacgauggguccaaaccuuuacaccacacuaaagggaugaaacacuauaggaaucagugcucuucuagacucaagaacuuuguucccuaccacagcaguaugucuugagauaggggugguuagcugaccaccagacaaagaaaguacccccaccauucuccuuguacccuugaggaugaagcugaacacaaacauggcuccaucuaccaccauggagagagggggggcgggacaugacauaaagucuauccauaagggaaaagaugucugauuauacugaaacacaaguguaccugagaaugauagcagaauauucuaguuucauuucuguggcugugacaaguacccuggccaauaaaacaaccuagggguggugggggaaggggucaauguagcuaacaauuccaaggguggggugguuuaauguggcuaacaauuucagcacaguucauuauuucagggacgucaagacaggaacucaaauggcaagucacaugugcacagucaggaguagagagaaaaauacaaccuugcuugcuugcuucucaguuaggguuguacugguuuaucuaguucagggccccaagccuagggaaugguggcacucaucauggcccuugauaauuccuuaagugagacuuucuucuaagaggauucuaggaugugacacgcuggcacuuaaaacuaacuggcacaccuaccgaggguccugauaugagagaaaauaccaagaaauaccuccaaguggcacacacaagaaggcccaucagaguuaggaauacuauauacagcaugcugaggguggguuggcucaucuuugaggccucaucuucaugacuguggcaugcugggcagaaucuucucucuuuagacaggcuuugcuucucuucaagacccugaauuaaacagaugaggaucuuguaucucucucuuuuuuuuucaucucuaggaccuaauaugguaccuggaauguuggguguggaucaggaugaaugagugagggaaucaaaaagagaaaccccuaaacccuugcacgacggcucugccucuggagcacggguagguuguuugcucuuagauucuucuuuuuacaguaggcacaccgaguagcugugcaaguguccuacacucaccaaagcugugguaaauggcgcauccuucacuccuaugggccuaaaagaaucuaagggcucauguccugugggagaugcugggcugcuuggucuauucaguguuugccucgcuggagcauccuucccucugcauucugugcugucuucccaacacccaccuagccuccugcuugugacaagauggagaagacauggaguguccuaagugggugagccgcaagcuaacacucucggccaacucccccaugccuggaaaggcuccuguuuuguuccacgguaaugcaacaccaucugaguguuggguuuagggacagucacuucuuuuucuuccagucuucuggcaaaaaugcucuuugauguccagaaaauugaaguggguaaggggaggguagauggacauguaguggcacuagggaagaggguuuuuccuugaggcucugaguaguacuggcaagaccuaguuaggcuccuugaguccugcugucucuagaguuuaguuucuuccagccuagccccagggcucuugcucugggcuuggaccagguauguguuacagggcaggguaaguuaaggauucagaauauagccacauauggaagagccagugacagggugacugguacucucugagcucagaguucaggcuaggcuaggccugucccaaaccagguguauaugcaagccucaucuguauccuccugaacugugcuuaaugguaauuguaugagaccacaaauucuccaggaaucucuugcuauacugcccuuucauguuuagccaccuugcugguaucuuccugaauuucccacuaagcuuucagugaagucugacucccacugccaugcagucaccuaagcaaaaacccagggaguacacgugcucgcagacacacgucuaggggcauauaaggagccgggggaggacugggucuuaaaagcaguuacaguaagauacuacuccucacuacacuauucuguguuacagucugaggaugguggacugauggucaauauuuuaauuugugauuuuuaagcuuugcugugguacgaaauacguguguauucagcagaaaguacaucuuguguacugaauuucaaucuagucuugguguuacacuuauggucaucuuucaugaugauggauggagucaaaguacaaccuacagccaggcccuaggagcaagugguuccacagggugccaggaagcuguacugauauauccacuaagagaaguagauacugaacacucuuuccucccuccgucucuccugugugugcgugugcguguauguguguguguacaugcaccuacauguguuuggggaggguauaaggcagaggacaaccuucaaguauauccaagguggauguuuuuugaaaaagggucucugaucugggaguuugugcuaagcaggcuaggcucagcuggauggccaaaagagcccagggaucugccuguuucugccuccccagugcugggaucacaagcauguugucacgccuaggguuguuuguuuguuuguuuuuuaacauggguucuuaggcuagaacucaggugcuuguguuuguaaggugaacacauuacagaguuuuaacuccccagcuacuacaauacauuuuugacuuaaaauauuucaacuuaugacugaucaggauaugacaccaugguaaggaaagaaacaugugugaugguuauuaaaauaauaaugaagguugccuuuaaaagaauaagcugaaugaaaauaggaaauaucauaguauguuauaugguggguuugcauauguguggccuagagggaaucugaaucucauagcuggccagugaacaucaguguuccaggagagaacugagugggaauuuggagagauuguucagguggauauggaggaaagaaagauaaugguuaggaaagcauccauuccaccucccuugggcaccacuggcagacauagagcaucaugguccaucuguacagacucaggaaguucagcaaaaggggagucaggcaggguugaucuccuggugggggauggggcugggagagccaacagaacauaggcuccagagugaaggguaguucggguagggaguaggcacagugacagcaaguccaggucucaaauauaucucaggcuuugagucugaguaaaagccguggcuccuuauaacccugaagcugaauaguaagaagggggugggaacucuuccuugaggccugagcuggguccagaugaacgaaggcucugaagcagcagagagcagaccaacccccacagacuuccugcacuggagcagcacagggucccuggcuugcaagacccuuacagauaaaaauagucccuacaucacuggaggcccaugaaucacuucaauugcccauaauugcuaagacacugcucucugcugcagcauaauagccgugacccuggcuuagguaucccaaaugagaccugccuugguuuggacccacacuaagggacauccaggccagccuucuccacaaagaacucagagaauguaaaaaguucagggggaagggcagcaaaagacuaacuuuccuggauccuaggaaugagaaaaaucaaguaccucaacuccuggcagccaccuggggaaggcaaaugucuacauugcccuucccaguaauuguggacuacagcaaagggcucacgcagagcuuucugagucugccuacucacgggggucucuagggcacauuugcuuuguuugaccuacguuuauuuagugcuauagaagagccccagcuggcuguuugcaccgagguccggugugcuggacucagcacucuggggaggugagggccccuuguacuccaaggcucuuguuugccaagcucaggaggacccagugggacggagccuagacaaacauugagcauccuuggcuucagaaacucuaccgguaaacacuccccugccaugcauuucugccuugcauugauucagcugcagagugcaaacggcccugagaaagggccaaggggagccugggcucaacugcauucagaaagaucuguauggaaguggcauagcugaauggucagucuccauggucccuaacacagugcugggguguagggggcuagauagcugugagugucuaggcaaacagagaaugugcacauuggacuagcucaagucaaaggcuaucugccacuaccuccugcuucccugauguguuggucaugccugagcuaagguacaggauagccuaagucaggaacaagucuccuaggaacaguaguucuaggaauguccuccaagacacuuuugcugaucaagagaagagggauggcuauuuuggaugaaaacgcucuaucucaagggcagaacagacagggcaaagcuuauuucuuucagaauuuauuuucuuuccuucuaacuuuuaaaguggaaaaaucuggcauugucacagcaagugccuuaaacagguuaaacaaucaacacucacucucaacuccggugccaagaguuccaggagguaacuaagaggccaggaguggcagcuccagggcaggggcauaggggguaagaagggugcugcuaggaacucagcagcucugugguugaugaucacccugauuuugcuuggcaagccugggugaaggggccggacccucucaagagggguauccagaaaaauuacaggccaagggggcacugggcucuuaucccccaacuauuaauauacccauggcuauaaugaaaagagcccagcuucucugguggcugggcauggcuccucuaaaguaggcacuucuccacucccagagaugggguauguaaguagcaacagaaccuucuagaauguucccuuaguaacagaugggacuuguggcuaaagagcugaggcacaaagggaucucaggccugggcuagaaacugaaaaagccugcagagcuagaauggggcaggggauugacagaaggcuuggugcaggaucacauggggccaagcccaccccccacuuaugugcaucccugugaggacauauggaacccuagcaagaguauauacagagagacagagaugaggaagaaguuauguccaggaccaccuguguccugcucaucaccauucaggugagacaucuccaucagcagauccaccagguccccuaguuccucaaagaccaaaugaguuaaaguccagcuuugcauccuucuuggccuacugucuccacucuccccagguacagagauuucccacccccauccugaagcuccuuauauaggccuucaaccacugugguguccuucaagccucauaagaggcaugguaggccccauugguccacgagcccaagcuguggguauaggggauacagggaacuggguucugugguggguaguaucuuauuggucccugaaaauguccaugucuuaacacuuggaacuugugucuugugucaacgaagaauaaauuuuguugaucagcugauuuuggggaggcaaaaucagcauggauggacuaugggcugccuuaugugaucauaaaggccuuccuuauacagaaauugguggagcaaagauguggccacagaggggguaggagauaaggaaggcaaguuggggacguguucacugacaucucuauccuuacagagcccauaauccaaggaugugggaugucugcaguaggaaucagcccuccccacacuugaucuccaggacuggaggaugguaagucuaagaguuuaaagcuaccaccuaguugggccuuugggucuucugucaccgacacaggucuuguaucuacugacacaggaaaugugaagguagcguugaaugaucuuccaucaaagucagggcccccagagguacuaugucuguucaccaaaucuagggacuucuagggaggacuuccaaguccacaugucccucccccuuccauugcugggucccuugccauaucuacuacucauuugauaucuuugaacaccuguaccacuguuuguuuagcacuguuccuuaaacagacucuauuuccuuaucugacuauguuuuaaaagccagaaaaugucacuuugugucgaagguaguuaugaaacauacauaauuaaaaguuacuuugacugaaucuacgcagguuuccuugaauugggcugagagaugaaaguauacucuucacaucuuccaacccuacucuuggcacuguccccagaggagcacccugaggaagucugucucacaaaggaaagagagaacagcuggugccuuuucaugguuuaggagcaaagcaggagucaaagucggcaacuaugggcucuauuccuaccgagcugugggcacagggcgguagcuauggaaccauaggcuuguagguuccgguggcuucacacugaauuuguuuugucuacuacccuuguuccaugucuuugguugcugggauacaagaaggggauuccacacaagaagacuauggucgcugcccucagcuucuaccucaaaaucucauuccuaagagggcuucagagaacuuguuccuccuuugucccccuauucucuggauuagauuuggucaauccaauacugacugaacaaggacagcacacugacaggaccaggugugcuuagaguggcaggguggcccagaggcucugguagaugucaucucguacccacaagggagccuaaugucuggaccagugucagcuccucucaagaucugugggacucacugucuuaaagucaagggguggggcugauggugggccuggcugaauaugaacaaguuccuaagccaccagcuccccaagucugagaggagggcuuaaaccccuuuagaagggaaauggccacgugugaccagagcaaaguugccuugucauuggucuuccuuuguauaacagaaacacuggccaccuuauacaugucccaucaugcuauaucuuuggccaggauuagcuuaucauaugguaucaucagucaacagugaucuugaacccacugcuguccuuaaaucacuucaacugguccaucugugccuuauuuggaggcuggaaaucuguuaccugcaggcacuaagggagccaagcuaccaugggauggguuccugcguugacuauggaugccugauacaguaggaauauggggugguaguggggagguacagggugagguagacccucaaggccacuucaaaagauccagcuaaugucaucuauaucccuugccccccauagagauggaccuggcaggaaagccaguacuuguucaaaguaacauggaaauggaguuugggagucaggcugucaucuaugaauucccagccuccacucauaccaggggucccugggggcccaucuggugagugacaggcugugcugugccucccaccuggccucuggcacccacacugcaccuguaacaacagggcaucggagcuggcguccgauuacggcccccucgcggccugcucugaauuccugcggagagccggcacaucgaggucccgggccgggcaggaggacaauccccacagugucugugcagcuggcacuguagcauguggccugcugagagggcagcccggcccagcccagggcuuggguccaaccggcaucucccagcccccaacaaggcuccacaagccccuugccuggcuaagugacacucuuagacccuggagggcccaccaagccuggcuuugccuccuuguauccuccucacccacccccaagcacauucugcuacuggcaggugggggugaggcacaccaaggcggcugcagugauuuaucugcccaucucagaggugcccaucacccugugguacacuuaccaacuugccagaggcugguggccuuuccaucuuccugcauaguuaaggcaaaggucaccuccucagacagcccucccagacuauguuggcuuccugacaacacagccauccaccucacuaccaaggaacauauuggaaagguccccaaagacccagccuccaguuggcaggggcccacuucagccuccccuuccauccccucccccucccuaccagaggaaguauuucuuuuuccuuugguuuauauuuuuaauuucuugccuuggccacagcuugggcuuuuggagagcuuggucaagucaggguaggguguggauucccccuggaacuccugagccccaguccagggcaggagauggauauaguauugguuccaugccagagaugccccuccucuggguggcaugggugccaagcccuuugugucuccugcuuaugccuccugcacauucugaauguauaggccaugucaagacggugacagccccucccauggccauuugaaccguggcuccauacucacugacacccaggagucccgugugccgcgguguuacuagggacuuugccacgaccucagaucccugcugggcuuggacccaccagccgguguuuuacagccuguuagggccgaggccgcaugaagccuucccggcaguuuacacaaagguucuucgccgugagcggcgucaaguagauucacguugggaucauaaagauaauuaggagacuuuuauuuucaaguagcacuucugaaaucuauaaaauuaagcuaauauacugauuuuuuaaaacacaggaauuuuauugcucugugagucagaguuugccagcccaugaggucgggaguuaacuccuucccguucucaggcagccagugguauggcugaguggcugggccuccucauucugcugagggcacaugcuccaggaaagaagguucccgggauaggguagugacuagacaggaacugacccuccaucccccaaauacugcuacuuucccccacuccaacuccccuuucuuuguccuuccugacaaguugagcccuagcuuuugccccuccuggaaucuacucccucuuaguguucuucuugguccuccuuaguccgacuuaguacccagaacgcaucuguggcuacccuuuccucugagauccucucuagaccuugcuaacaggaugagccaccacagcucuguguccugggaaaucaggccagcauauucagcauagccuucggaagggguaagcagagagccuguagcauugccaugaaugggcaccuuaagggcagccugaagaugaccuggaacuuucugggcuccccacuuguggcugagucccuggaugucucaucuugaccaaguucucacuccauggccuugccugacaugaccaaggcacacaaccaugucauaguccuagauuggagacagcuguggaggucacuuucuacagcuucuuacuucacaggcuccaggcaucuccucccuucggggacuagguccuuucuuuaggaccacagagugagugucuuaucuucaccgagagacauggaggugaccauguuagggacagcaauuuagcacaccauaucuuguggguuuuuguuagguuuguuuuguuuuugagacagggucucacuauguagccuuggcuagccuggaacucccuauguagaccagguuggcaucaaacucauagagaucuaccugccucuacauuccauaugcugggauuaaaguucuuggccaccaugcccugcuaaagcugagucaugcauuggcuggaaauggaaccaagcaaggccuucuguauggcaggcaagaaucuuaccauagaaccaccaauuccuugcucugcuuccugcacucuuacauucaguccuguugugcccuucugggugcauugucagauuuaacacauuuucuugagaaguacaauucaagccagauguguacagacagccacagcuuacaugaugacaaguggaggcuuccauggcacaugugacauguguuagcaugccauucaaggcacucacuuccacugggcccagggcaggcaugucacgggcuuggccacauggcuguucuuagccacacagagaugucaaccuagacaucugcauuggccaucauucuuggugucucaguccuggggcuuagguuaccacugccaggcccaaguagaggucauaauucuuauuucacagcagaggaacgugagacaggaaacuuauuccaagaugcaaagaaacaguacaccuucaugcuugcuccuaaccacauggucacuucuggaaucauuacccaguggauaccagacuagaggauccaggauacuguuccuagauguuuuucucaacucugaaaguccuagagagguaccccacucuccagccacccaguaucccacaaaaguagcacaacucaggcugauccugcucacugagauccugccaaugcugucuccauuaagggcacagucacugaagacccagccuccauuuacccagccuaaucccuauauguagcaguuauuggacuuggacugguggcuucccugcuucucagccaucuagacucacuuugaggccugguacgacuaucuguucauucucugcaguauucacucucucuuucucucuccaaaugcuuaccagccccucccuccuauuccugaagcccuugaagcagagcagaacccuuccccagaccuuagucuuccaguuccuggagacagagcuaugguagacaauuuacuggcaucuauaaccaccaggaaugccaggccugcuagaaggucugggcagucuugauuuaugacacaggacuccucuuuggagaaccucagaaauagcugcuccagggaccugaagacaaaacaggacucaaccagaggaaagaggugugugugugugugugcgugcgcgcgcgccccugggggcggggugugugugugugugcgcgugcacaugcauguacgcacuugugcaugggcacacaaaggcccugagguaggaaaugagagcaaacaauagguccggauguccccguccuguccugcagaaacuuugcacuucuguuuucugcuggcuggggguucagcuucaggugggagagugagauaaaugaaugugcaccuacuucccuacaggggugcuugggucuggcuuggcuccuccuauagugccucuccuggcaagauggccuucucuccucuuagaaacugcugguuggaaguuugggguacccccauuauccuuuggagucuacccuagcuuccauacuuuuauaaccagaguuugauccucacgggaaauuucaugcucaguugggucuuccauguugugcuguggggaggaggcuggcaugauagagagaaaugaggguugggagucacaucagagggaaaaguauaggauuccuuggucugaggucaguugagggaccugagguuggugagcccugccugugggaacucuuucacuuuggacaugggaggaaaggcugagacggagagcaagccugagaaaagacagcuguagcugccccuuuugaguuccuggaugcuggggcuggggcuggggcuggggcuugagagaugugugaggcuggaucaugccucccauuuuauggaagaggaaacugaggcuuccagaggugaaguucuugccccaugugaagagaucucaggugucuuuguguuugugcuccaccagggaaacuggccggccugcugccuguggguggucacaagcuccuagcaggaucccuaagcucuggagccugcugugacgagagccaccccugccuuagcaaaguggggccagggcccaaagggaagagggucuggccaauggaccgccagggcagggguccccucccugggcccccgugggugggacagaggcccccaggcuccggcugcaaggcgaggccuucaguggcggccacaauaaauauguuuguucaagggaagccaggcugggagcugugugcgccggccugcugaggaagaaaaggcugcuugugccuugcacacuggggugauuguuccugcucacgcaacugcugccccauggccggaaaggucagacggcccucaggccccgucggaagcacccggugccucgggccccuuugcuugcacccugccaugaugcccuguaacgcccgcaugcagccugccuucuggccuuggcaugggcagagaagcaaugaggcgaggggagaaaggaggcugggaguccaccuguugagcucaagggacaaaggugugagaagaacaggcccuauagggcucauugcucaggggcagccaggagccaguugaggggcugaacuaauuugcucaguugacuauaggccuagacauuaggaaugacauaguaaucauuacagaugacauagggagaggcccagaagcacacaaaggucagcaggccacucuuaggggccagaacagccaucacuccacucugcuagaugagauggcugaaguagguccccgcgucugcuugaugcuauagagaaucacuccugaucuuugggauaagaguacagcuuaauugguagaacgccuaucaugcuugaagcccugaguuccauucucaguauugaauaaacuagguguguuauugcacuugggagauggaagaggcagaaaaauaagggguucaaggccauucuuagcuauacaguaguucaagccugggcuaaaugcuaucuugguucauucguguguguguguguguguguguguguguguguguguguguguguguguguguguguacaugaucucagaaugaucauccagcuccugagaugggaaagagaaacaggaccuuaagauuugcuggguuugguaacagacccugagugaugcucuuucuccaggaagcuauuuagggacauccccagaaccaugccagcauuuucacuaagaccauaggaauaagauggcuaugaaauucugagggaugcugccccuucccaaggcccaaggcccaguugaacaguccuggggggagguauugauaauacaaguggcuuuugcagucagcuuuggcccagugaacccccuaaacuugcagccauaauggcuagagcuuuuggugaucacgguuuaugggagggaguccaguagcugccagggccaaagcaugggagggcuggcuagguaaagggagguggcucugagaaugaauguggcacacagggcucucaccgguauuccacuuucuuccacuagaccuacgcagccugcuucuuacauguaccuguugucacagggccccuggagugcuggacuuguucagagggacucuucuguugcugagagggaaaccacccucaggaauguuaauggagucccaccaucacagccagaagacagccacccuugccuggucacuguguuuugcauacaagagggugugaugaugguugaccugugacaguggcuucuauucucaagacucuacuauggacauacuaccagaacaugccaccuucaguuaccuggggaccuaguauucugucacugggauaagagcaugcuauauuguccucuggauaagaaucauaggggucuuggagggugaaauccuuagaauccauuuguaccucuuguccuagggaagaggcaaggggugggcucagaagaaggcaaguucaacaucccucaagugggggaagccugaccuaugccuacagggagcuggugagggacucuuggggagucuacuuuccucugccaggccauaggccaggcaguguccugugaccuccaucucaggcucugugguuagcuuucaggccccagauucaugauugcucaucgcccaagaagaugggucuccuuauuucuuucagggaaaccaaguuaccagugagccauggcugcuaggagacagaguuagggcuugauugcacguagccuuaggccuggccuuguugguagauacagccaccaaaaccaacacuuccacugucuggcuggaaucuucgucgucuguccaacucggccccuugaaaccaugaucacuaccagcuagugucuuucauggcaaucccuaucagacacccaaccauucccuaucuggccgccaaaaacccuacuuuucucuugggucuugacauaacuggccccacagacaagcugccauguuacuacccugacucuacuucagugaaccucugugagccuuguaagcaaggaggaaggcaauggggacugcugaguagaaguguuuggggaguggagagagagcuuggaggaggagcaggcagcaggagucagaaagcugaggagaggauuuaaucugccacccccuugcagagacccaacuacacauugacuugaauuccuaacucccagagcccuuugcuguguacuuuaaaaagcuguuguguuggugggaguauguuacaguugccauugaaaacuagaaucuuuuuuuuuaauaaaauaaauaccagcuucacuacuuccuuguguaugaccugguucucucuugcuuggguuaguauaguagcuccuguucuggccucccagucuggcccuuguccuuccuaaaacauggcuauaugaauagguguuugagucuccuagaagaugccaucuggaagcuggugggugccaaauauuaagacacugaagacucaauccuaguaauaaggguaacuuuucagggugcuccuguaggaaagauagcuggcauaugggcaugucccacaguuucccacaggacaacacacuucuauccugcacaguacacacucuagagggaggccaggaagaaacugaagaggcuacaaucauacccaggguggaaggaagaggucagaagccucccaaagaugcucuuggaagaagggacaggauugcaugagggcaguccuaagcagaagaaacacccaaagguccugggacacaaagaagauggaagaaggcaagggauagaguuccuaggcagagcaagaagaggacgaggugacaacgaggcuggggaugacaugugggccuuuggcaugugagcuuugcauuuguuacuguacgcaaggucagugggcuagugggauugaugcaauguuccuggagucaggcaucccuccugccugcaacauccauagaagauuacucaaacaucccugcuccucacugaccacacaaagcccaugucucagagauuuuacacaaauggucuugaacucuggaugcuaccgcugucccuuccugguccuauggcuuucugcugcuacucaugcuugaagaagacugacuugauuugguuguaggcccaggcuucuucccuuuggcuucccacguggguucagcuaaugagauaccuagaaggauggugaaggaggccauugaggcccaagauuccccaccaugaagccacuggcugcaacuuagaucuuggguccuuauuccucucaaggugaccaggacucaugacucucaguuuacagagcuucagauucucuuuucuuuucuuucuuuuucuuuuuguuuuguuuuguuuuuuucaagacaggguuucucuguguagcccuggcuauccuggaacucacucuguagaccagguuggccucaaacucagaaaucugccugccucuaccucccaagugcugggauuaaaggcgugcaccaccacugcccggcauagacucucuuuucuugaucuguaagucuggggcaggaucugauacugcuuaggguucuggaggguuuauaguucccaauacccugcccagcucuagaagggccuaguguguuuuauguaggccucuaugcccauuguaaggauggcuggccacugagcagggaaguaacagucaccauggcaagcuaagcacagguccucaguggcuuuaaauuccccauaucucucauauucaagucagcuucuacuugagacaauacagaaauaacaugauuugggagggaaaaaaucaaacuuauauucuucccugcugggaaauggccuuaccgcucucucuggcccugcuccauuggcuugucaccacagucccacccaaagccccucuggacuccaagacaccucccucucauaucagcagaaggggugggaugggagcugccagagccuggagugggucacuucccuguccuuagugucuucugccuugccagagaagcucucaucucccuagcugcuucugggcuucuuugaaaaucugucacuagcucuaggcuugccuccaggaagggugugcccuucacucaaacacaucugggacauaguucagugguaggaugcuugcccaguacauauaagaccccuaguucaauuccuagcaacacacguacacauacaucaccccaaaauaaacaacauaccacuccuuaucugaggugccagcagguuaccuaaucuauccagggaucuaggggucuuuaagucaggagccuggguggacauuucucuauucacuucugccuaagcuugccacgucagcacauauccugagagccaucucagcuucuccaagccaccgcccuaacccacccuuggccuuguccuugcuggggccagcuggaagcaaucuccccagaguggcaggugguccuccuuagcaggcuccugcgaggccaucucaagcccagcacccacacagagguggcucuguacgcacggcugccuugggccccuuccccgcuggaaugaaccaagcacuuuggaauuugcagagaaaucuggggucuuuagcugcuguuuuucuuggcgcggccuuaucacaaauuaguggggaagcccgaagguuaggguuucagugagcucagcagaaucugagaagugaggagcuggccuccugccuuucuaagucagaaauaauacuugaccugcugggccccagaggcucucagaguccaggauaacuccugggcagguuacccuggcucugaguguggggaagccuggggaggcaguguucauacaaguuggugauuuccccccucaagcccaaauggccucccuggugccuuccuggggucacccugaacugugugaguuuagagccuucaggcugggguucuuggcacugcuagcagcucaggcuugggaaauggcacaccugggaagaggguguaagcaauucugaauaaaagggcacacucugagaccuagggaucuccagacacauuuaggcuuuacuucaaaguucagagagaagaugggggccugagcagacaaaugcugggggacuccacugugguaugagccucuucugauguagaaggcaggaauugcugugccauaguuaggaagccagagcaucaaggaaccauugaguauuccugaugagggcuaccuacucuuuuagauguuuaagguccaucuguuuauguggggaccaacucagagcuucucuaaagcuguaucuauacauaccucuaggaguccuuaucuacaucccaaugacuuauccccacccugcccaagucagagccaagucuaguucuggcauguacuuggggggcaccucuuagcacaccaagaacuuguuggacugcggccuagugcaggguccccaugggccaacauuauccuugguaccugguacagcuugcugcaucacucaucauuacccugcgacagaguccacuacacuuccacuguacagcucagaauauggaggccuuggagagucuuguuucaugucacacacgaccaaggaggauaugccagggugugaagcaagcucuaugcuguuguuaggaagacagaugaugcuagagcagagugcauguugugcaagcauggggacuugaguucagagcuucagaaugcacauaacaaaaagagcuugacauuguggcacauguuugcaauccuggagcugggguuggggguaagcuggguagugacaagaauauuucugggguuccucagcccauuaaacacuucuuauuagcaagcuuuagacuagagagacccuaucucaaaaaccaaggaagaugccucuugaggaaugaccugugguugaccuguggcuuccacacacaugugcacauauauacaugaauacaacccucccaaaacuccaagaugauaaucucaaugaccaucauaaacagguauaggugagucuuuccccuaaauagaagacuuugguacacaccacuucucucuguauuccuaggcaaguccuagggcuaugucaaaaaacuagccaguagguacaaagcuuaacagcauuugacuggcauuuguaugagaucguauguagcccugagugucuuuccuucagcagggggcaguuuuugacaugugccuccuuaggggauguggcugcugaccagggugcagauaagccccaagacagccugaccucccccuuucccaccuccccuuuacccucuuacuggcccuuccucaaaugguauuaucuucacagggaaggccuggcuccagagccagcaaugggacccuggccaccagcccugcuccauuguaaggaaacccaauccaggcaggaggacggcugucgcuccucacgauuuagggcugucaccuggcagaguagagggcucucuacucugacagaauaagugguuccauucugaaaggugacaccauaaagcaauucugagccggcaggaggacuguauaucaugugggccuggauguguguguguuuuucuuucuggcucuccuuccuggucuccuugcuguggcccccacccccuggugaucuuaucagagcauccggggccagaugugauuuucuaucaagaggauggggcccuaggcagacccaagggggucaugcgaagagggggaagggagacuuauaggaggugggcucugugucagacacaagagucagauacacacuuccuaccagccagagaacggaggucuucacaccuguaauuggugaggaaggugucagcuacccacccacccccaacuugcuuugaccacuaggucacaaguaaauggccuaagaggcuagccguaccucauguggaaugacugaacaccauuauugggcacaagguuguccuuugccauccauuccagcccaggccugucagccuguucuauaaaucgaugagaacuugaacgacagacagaagucccuuugaacacucgggcugggaacagcaucaccucuuugagccccaguguuugcuucaaaugcuauuauuuucugguccccugaucauuccagagucguggaccagcuaugggagugucaccauggggucuaugacugaccaacugaccucaccuagcaagucuucuguuaggaggguauucucauauucuuuauagacaaggguaccaaggaucacucaaggaggaagguucuuucuauaagaggucuguaggcacccccuaagcagaccaauguuccuugggagcccuggagucuccaugucccuuucucgucccaauagucaacaggaaugcugucgucucuguugucaucagguaguauguggagauccagagauagccagaagaggagaaaaggaaagauggaagccuguccacucauuucucuuggcuaccaccucucuucucucauagugccccuucccucaacgggcucuuccaaagcagaagccucccugucuguagaaccuccuauuuauucucuugcguucucgcaauacacaagcuggacaguggacacacucuggguaaacccuccccacagcaaccauuuucccaggaugccucuggcugugagagccugugaagucaaguuaacccauguguggggucagggaaguacuacuguguauuuucuguagcuggggagacacuaguccucaaguugacaccuccauuggaagcuuuucaaagaaaggcgcuguggcuccaggcucuaggcaugcagagauuaacaacauguagguucuguccaaccuggcccauuccuuuugcagagacagccuugugaccuucgggggcugccuuugcuuugggaguuuucucaaggccaauggccuccucuuggccuucaucuguccccacacaaggccagugugggcuuagcuuaaaggaggcuugaccucaacgugguccuauaaggcaguugagcuagggagauuguaccugcauaugcaaauuggucugacgugagaacugccagcacacacauaccuugaagacaucacugauucuaaagauaauccaugcaagggaaauguggcuuguucugcaucuuuaaauuguuuucuuuuuuccccauccuugucaaagaccccuguacuaucuaauguacuagagcuuuuccugguaacucucuagcaaguugggaaucauacccucuauuucuuguaaaacccaagcacuaagggacacaggcaguuggggacuaguuguggaggucugaggcuuggcauauugugcauaccacagaauuguccuaccuucaaccaggugcacaaagggccagacccuggggucccaccagcaguguggucuagucauacaccugauaugguuggguuguauccauuucugucuuuccauaauggaaaacuauggaacaaugagaugacuccaagagaucacagcaauguuggagauuguuaauccugaauuuaagauacauucaaccucaaagcucuuugccaagacacauggcucuuauagaugcuaaugggcugccugaaggcucacccaucagcaaacauauuuggcucuggaaugaccaaaaggagaaagguuuuuuauuuuguuuguuauuguuguuguuuauuuauuuuuuguuuuuuguuuuuuuguuuugaauagaagauucugacuuccuggcuuaaacuugugauaaccaaacucaguaucugugagcguaacaugagaauggcuuccacuuuaaagauucagagacucaguguguguguguguguguguguguguguguguguguguguguguguguguauaaggcucaggaaccuguauuucucagauucucugggaauucagguguauguaugggaauugaaccuaggcucccauggaaugccuaccuggcccacuguucagcuacucaugggaaaauagggaccuggagacugggugggugcucuguguaacuuggcucaggguucacucaauacccagguggacacaaaucccauagguuuccucaacauaguguuucccauaguuuucucaacuguucuuuuauuacagaugugcaugucccuggggcugguugccagguguggaggcaaauggguaggcaucgugccuauggaaagccaugcaguagguucccagguggcccaggcugaacaguccuccuugaagccacaaggagaccauuauucucauuccucauuaccauuauggcccccagggccaauuucuguaaucuaaagauuugagccccuuccucugcucacuuguauccugagagcugaacccuggagggauggcacagaagaaugggaagaacagugaauuugguacuggauccugagggacccagguccagucauggguggaaagucaagaaaaauaucacagaaacaaacaggaugaaggggcguagucagagccagggcuauauaaggcucucugaguauggggcccaucaggucucaggcagcgccagagaggucagagcaugcaagguuaauacggagggggcuacaggggggugggggugggaggaggguacagaggaaguuggaggaaggaaggcaagaugaagacauguuuggcuggagcagagcucccagcuccuccccgaggacagggagaguccucgaaggguuuaagccacaauggggcaugucagcccugucaucugggaguucaucugagaagggagaccaggauggggcauguuccaugucagccuagugcucaacuccuggagggagcagucccacagaccuugaaccaugggaccucgaggcgaugcccugucaucagaauaaaacuugacuuacuuucucagcagaugagcccuucucagccucagaaucaagacaacacagccaaguugaguucuuuuuccaugauccuuaaagagcugggaugucagggcuggugagagugcucagacgggaaagguacuuaaccaaccaaccugaugacccgagccugauuuccagagcccacaugguagaaagaaagaaucaacuacaaguuguccucugaccuccacacacaugcugugguguacacacacacacacacacagagggugcugagcucuguuuuuuaagggagcagacccuggggacuugggacaaagugagcauuuaaggguguuuuucccugagauccagauagguucacaggucucagccccuggaggguggcuuuuuuacuuucugccuccauuuccuggcucuccuuuguucccacagcuguucauuguacuccuggcugcccaugccucuucucuucuacucuuacaagauuguguguuuaaacaaaguuagagagccaacaauacaggcuuaaaaauguuccugaaagcagggccaggcuaggaaauaauaguccugggggaagcaaugacuuccugggucuguccucucuuaccuguccuaaugcuggcccuggugugaaaagagucacuuaguugucuugauagaaaaaggcuuggaggcagggauggagaauucugucuggcuaccugcaagucacuguguuuucuuugcuuuguggcuucccauagcuggacaaagauuugaagagagacugcauguacagcaaaugcagggugggcugcgauuaaacacauggggagaugucuauccauguaaucacuguggggccaucuuauuucccauccccuaaucaacacuagucacugcuggucauaaucuacaaugccuuguagaaacccauguaaccuuucugcugggagugaaaagggaacacaagauucuuuauaacaguaaccaggguccuuaaagccccacccuugccacacugaacaagcagagagagaaggaaggacagcuggggaggcuucauauuugguguaaaucuucaguuugucacuugguaguuggccagcuaaucaggggcccgccaaauaguuccacaccugacaucaggauuccuggacuugcucaguggggauuuguugagcuuggacugugugucuggcccauagccaggggccacgcccucgguugcccaauaugcaggacgcacguagugcuugcuccagacugcucguggcucccucaaaacacggaaauagugguuguucuacacuagaaauaccaggacccauggcccggugugagccaccaaguuccacaccacucagcagagggaacuggcuuccagagguccccuuccacaggggaccuuccaguguuccccuaccccaaccaggaguuuggaauccuggagcugcagggcugggcgacuagggagccuuugagauaaggcacacugggagacaggcuguagaauuucaccagccugcaguacugaaguuguuugucugccuagccauuacucaagagcccuagauaccugaagcugagcccuggggcacaaacuggaccggugaugggggagggacacauucuguccugaagagccaggagaccucagugucugaccagaggucagcuucccugauguggcucugcaaacuagccacagauuccaccugaagcugccucccagguuuguuagauggaccugggacgaagagacugaggcucuuuagaauuucuuauuuuaagugcuugugaaauagagucuugauuuguaggccuuguuagccugaaacucaguaugcagaucaggagagccacagccuuauagcaaucuuucugccauguguccccaaucuaccuccaccauguuuuugcuuagcccuugagcuuugugccucguuccuaauuucuuuuccuagugucagagccacugagucuggcacagagugggucacauuauuuaggagauagucauggucaaaaguaaaaagcaaacuuacacaacauaaauagcuauacaaaaguauaauacaaaugacuacuaauguaguccuggguccuaagauagaugagguggccugggacuagacucuagucucuguggccuggucagugcucuggggacagggaugccccuguaacugugggaacaauuaauguaggagaggucagaggcagggugcucagugguguggcugaaaugugcuuuuguggggcacagggaugaauccugaagcuauagccuugagguugucaaggaaaccuuguuuuaucucagguaucugagcuguaucacauggguggagagugaccgccccuugguccucauccuucacugagcaggucagcuagagaggccuggcugaggcauggggcgagauaguuuuuugguuuuguuuuuugguuuuucaggacaggguuucucuguauggcccuggcuguccuggaacucacuuuguagaccaggcuggccucaaacucagaaaucugccugccucugccucccgagugcugggauuaaaggcaugugccaccaugcccagcugggggggcgguaguuuuaugguuuguauuggcaugguucuugcccaggcugucccugcccacucaggcauuggagcuauggcucauguggcugcucccugauccaggaagcuuggaggcacucaagcuaaggcacggucucugggggagaugggcuacucuggcuaguugaucuugaaggaaagggccagguggaagaugauccacaggacaggaaaugagauguagguaucucaagaaucucccaugugggcugagcuggugacccuaacccucuagagagauucucuuuaguuugaccauggugugucauagguccagacgaccuauacacauggcugcaaaaugcugggauuguaggaauucccucugagccugcccuacuacccaacuagcugcuacagguauuagucuucaaagccuaugcccacuacccugcucauccucaaccugccucuuuuuuucuccuuccugccucuuucugccccucugccugauccucuccugccuagcauccaugccagggcccacagaucucuccagcuuggacuccccugagcuuaguggacaggaaggacccugagagaggcuucagagcauacucuggcuugcuauuuccuggcuaugugucugucagucuuggggauccugggcugggucauaaagugcccauauagagaacuuguaggaagagggaggaggggugugugugugugugugugugugugauaugcugggaccaaaucugcucaaggguauucuugcucagugucucucaacaguguuacugcuaguucccaacugugauacuuuauacuggugccaacaccagaguaugcaagacugcuggcacuugcgagcugugugcaugauaccugcuaucuccuccagggccccacgccuaagcuuuccaccuuaguggggugaugcugauaaaauggaaggaagcgcgugcuguagaggaccuaaaaaugagucuuaaggucuugcaagaaaaguuacccuguccaaaccauguccuugcauaagaaaggaauuggucaucugcaagacagugacccacuuggcagcuccucuugccccccccacccccgccugcuacuugcucuuggccucaaagccaugugcuaccaguuucucugaagcuggugauagcugacuacucgcucugugcuuuugugggcacuguucccucugccagggauuugcccuuuuuugugaagcgugggugccaaaaacggacauguagaccaccccucuacaagguggaggccuggaaugcuucuacggaacucagauccugauaaguggacaaaaaaggugucuccaguuccuuuacuucacguaugcaggccucuacccugcucagaacagaccauuccaagagugcagaaaagagccuuggccuuguaugcagaggcugcuugagggguggggccacaaacuugggugcccugagguaucucacacuuuucugagugacagacaaucuggagguuccugagugagcugguagggagugggcagcaggcaaacacagaacaaaggcuuggugcugagccccugaucuggccaucauguaucucagggcugggcugcaagcuaguguuugcucaucuggaagcaauauuguaguaacguuagacggcucgaauacggcauauucucugaauccgugaacucuacagugaggaauauggauuuaauggauaaucucaccagcagccaaaagaacccagauuccuccccggccuucacccgggccuuggcuucucuuggagccccaacucagccaggggcccacagagccugcagcacagcuuccaggagaggcaugugaucuuugagaucggggcuggguuuuuuuuuuuuuuuuccuuuuucuuuuucuucuuucuuuuuucccucuccuuucucugggugggaguggaggagcuggggaccuguucugggcaacagagugacugaucuccagaccagccuguagccagagaaguugaacuggagaaaguaggaaaccagggugauuuaucacuaucuccaauggccaaggcuugcuuuggagugggguaaggguaggcagaaauaauuccugcagcucuucccaacuuaauauaguuggaauaauaaaaugaaacaauaaaaccacagcggaaaagaugauggagagguuuuacagugagcagaagaggaagagcccagaaggcggacagagcucagugaacaaugugacucgggaacucauccagaaggcagccagggggaggggaggaguggaaugcaggucuggcuggcccuggccaccaagugaagugggggcugcaagccacucagccuauggaggcugcaacucagguagauuccuggcuacucucuggggucucauuucaaaugcucauuaauucuuaauuuaaauauugucaauacauaaugcuucacaaaggugcuaauuucacugagagccaucagcugccacugcagcugcauaggugggccucucauucuugccaagauuccaauccacucuccugacuauccagaugaacuucagggauccaacagcucucugaugaagagggaggggugaaagauaaggguaagaaagaagaaagauggguccuuccaucuuuccaauucuucagauguccaguucagaggccacgcaggaaauaaagcagcuaacaugaacacuccacuccaggaggcccugagagucaugugcccugacgucucagccuuuggguguagcuguuccaaggacgaggcuaggguauccagaggaggcucccacugcagacugaguggagacaggaugggggagugggaaguggggaggcuggggggugggaggugggguuaagggagguaggggccucucaguuggcuuuaucuuuacauuccaggaucaguagaagccuccaaggguucccaaaccacgucaucugaugagcuggagaucaaagcugaggcagaagaguuuaugggccuccaguccauccuggagcacaggguggcuagggacagaggcagggagggggcucccgucugcacucuccaauauuguucauuguuuucuacaguuccguucugagucucccacagucuuccaggggcuacagugaacacaauauccuguaguugggacucuugcucuagccucaucuagucucagagggggguauaaugcucucucugaggccacaaugcccugugggacaaugccuucccggggcagaggucaugagugucagcucauuccauagcaacaguuccacaccuugaagagagcuagaaacacagaaaauauucaaugaaggaagaaagcaaauguucagggcuuaaaugaaaugcaagcacagggcaggguccacaacucagcagcagugauuuuguagacugcacaaggcccuggguucaauucccaguaccauuaaaaaaaaaaaaaaaaaggcaagcacaaagcucucucccaaacucccaagggacaccaaagcugucaccucuuugggucuugauccccuuucuguuucucugggggcaggaaacacaggcaguauguccucuguguacagauggagaaggagacccagugagacagggccauaucagauggccaugauucaauuugguccaaaugacaugacccugcucugcccauggggauggcuucagggagcagcccucagcaccugccaccugccauggcuccaggcaacuaugcaccaugagcuacuuccaccucacucucaaagguacccuccucagaagcagggccagaauccugccuacaccagaagucuguagacuggauuugagacccuugaguugaaaggaaauuugaaaaucaaauuccuuuuguaagcugccaaaguccugcuucucuagcaccgaggcccuaagaugccuggcuugguacuaaagaacuguucaucuaucauggagauaugugauacaacgauuaucuaggagucaguuaaauucuaauuuagauuucugggcucugagcuggccuguagcuuacugagguggacuccacuaucucuaguggacucaccccagguuuaaagaucuucagucuagggguaacacacuuggcaaaggacaccaaggaacaggaagaaacacuuggacaggggggugcuggugcgacuugaagaagcucauggagaagggaggaaagagugucuucuugccaggucuacaaggaugugaaaaaccuggucagggcagcaaacuuaacagugagacuuaauaguaggaggcuguguagaaguauggcagaugugauagggcuagaaacauggccuuuaguagcuagcaugggagacugacuuggagaacugacagggccagguuguacagaggaaggaaagcuacuggucaccagccugaagccucaccagaccaacaaaagaauuacccaagagauacucugaagauagccagguauucuuggaagaaaccugaaaagauagccacaugaccauuaaagugguaacgcuaucaaacauaaccucagguucaaauaagacucagagucccaacagccuccucuguuaaauauugacaagugcugggaauucuacagacccaagcaacaggggagaacaaaacuggacaauucacacuuucugauuucaagcucuggacacagcuacaaaaauaaagucagaucaauagcaaugaaccuucacauuggccuucauuucccugagagcccacaaggcuggcaagaucaagcaauggggaaagaagacacccuuucaacaaaugguguuggaaccacuggguagucacauaaaaaaauaaaauaaaguugaucccuucauaccacauacaaaaaugaauuaccccccccuuuuuuuuaaauguaaaaacuuuaaacucuuagaagaaaguagaggaguaaaucuuucugaccuuggcuauauacauugucagauaaaauagcaaacacaagcaacauggugaugggguggagauaaauuggacuucaucacagcuaaaaguuucaucagucauugcuugcccaaaauacuugcauguaauuaaaaugguauaaaaaguggguuggaaaauaaaaauuugccuucagacucagaauugacuggggucacacuaaaaacaaaaaaacaagcaaacaaaaaacaaaacaaaaccacuauaaaggaacuaaaaaagagccaaugagaaagcucagcugguagugggguggggcuugugccaccaaaccugacagccugaauaucuaucuacacagcaggagagaacugaaugucccaaguuguccucugacuuccauaggcgcuguagccucacacaugcacaaauaaacccucaaucaaugaauaaauaaauauaaauuuaaaacauuuuaaaaggaagcagggguggggggaccccagauauaugcuuguaauuuuagcauucaggaguuggaggcaggagggucagaaguucaaguuagucaaauuggaggccagccugagacccacucaaaaacaaaaaaauaaaaaaacaaaacaagaaagugaagaggcaacccacaaaaugggaggaaauaaagcugauaagggacuuuugucuagaauauaaaaucuaguauauagguuaggaagaacaauuacuuuauaacaacaacaacaacaaagugaacgaucaaucagaauuggcauuucuccaaaguugguacacaaaugucuuucuguaaaagaugcucacugucauuaacccucuaggaagugccuguccaacuucauacccacuagcaaaguaaaaacagaaagcaaauguuagugaggguacaggaaccucagggacuguugguagaauuugagagaugaaacuggcgguuucucaaaaaguucaucagaacuauccuaggacccagcaauucuaccccucaguggauaugcaaauaaaaacauaguucacaaaaugcccagauguugaugguaguauuauuuagaacaacuaaaugguggaaacagaccagaccuucaugaagggauaaaugugcucuccccauacaaugaaauauuaugugaccauaaaaaggaacgaagcaucaccacuuacaguaacacaaauggaccucacaaacacgaugcugggugaaagaagccagacucaagagagcacagaacauaugauuaucguuacagagaguauccagagcaugccaaacuauagaaauguaaaguugagcuguauguaucuuggacuagggaguaggcuggggaauaggaaaugauagauaaggaacagagagaauguucuagaauuagacaaagggagaguugcacaacccucaauaaauuucaagugcuucaaguaggugaauuguaugguaugugauucuuuuuaaauaagucaauucaaaaaaaaaaaaaaaaaaaaaggaaagccaagaaacacacacacacacacacacacacacacacacaaacaaacaaaaaacccaaaccagucccacaguacuggagccccugacuggacaggcccugacugugagugguucccaguuccaggugcuccuggauucaggaguccaagaggccccuugggcucuggggcugagccuccacccacaucuugcuccucagcucucagguuugcuguuucucagggcaaaggcacaggagccuggagccagcagugcucugcagcuggggcugggcuggggugggggcgggaagcugugcagcagggauguaggcucccacgcuccagggccaagcugacgugacuaaagcuaaacagaccccaugccacaaugggguuacagcuaauucugcgcagcacacugagccuucgccagcgauggcagccucggggaggggcgguggggcaggcagccccaaagguaauuugcacacggcguuuauaaggccccucagcucuuuuaaacauaugcuucucugauuauaaacagcugauggcucacaagauucagauuuuccagcagggcuuccaaaaaaagauugcacuaggguagggaaaggugaccggguucuuugcugaggacguaaauccagccauguucucgagcagcccagccgucaccaggcuccgaaccugucacgucuuuaaaauauuggcugcuauugaugugucccaagaaaggcucuggcuuggggaggggacagagugauggggccuuccauaagaauuggguucccugcugccuuggugugaaggauaaguuuuccuccaucuccugcccugaggcuuuuaguccuggaucaaaagccagaauucaaggcccccaggucuaggcuucuggacucaaacagucacacagugcccacaauagaggucucuaaaaaugauugcugggcuucuccugggguccugggaaccuagcaggaguucaaaagagaaugaagagcagguagaugagcagggcaccagcagcaugagacuccagggaugccagcucacuauuuugccaagucccccuuagucaugacccaggcuacacaugaacaccaggcuggcagggaaccguacagggaugggucagaauccugucuaccaucuaguucuggcaucuagagcuuaaauuaaaucaggaggcauccucucucuacugaggaauggcuuucaaaggccucuagccugaaguuagagaauagaaugucauuugacccagcagaguauccuggggccccucaucuuggcugucugcagaagacaucuugggagcagaggccuagccccagagauuuagcacuauggaagguuagaaguuaucccuuugaccuucaguagccaauacacaguccucuggucccaaaucagauucuggggagugacauaagaggucucaguggccaggaggccacaugugggcaccuucauagcagaaguugcuaauaaacauggucugugucucugauaugaaacugcaugccagagaggggagaacggagaugguuccugguucuguauacacaaauuuccagggccuucugccugucugauuuacuuggagugggccuguuuauuugcucuucuggauacuagauggucugaaagucuugcagggccucaaaguuggaccugcaagcuaacuuucagggauuggcugagguagcaaggguuuccuugugaggaagggugugugugugugugugugugugugugugugugugucacagucauggugggguugaagaguaaugcagaaaauggcaguagcucuauuccuggcuggacugauggacagcucuacaucauuccauuauuuacccaugggcucuaaaggaauuuaacccaacacacauaacucuagcaauguucaaagacagacaaagccuguuuauugagcaggcccaggaaaagaggggcuuggggaggggacuuuaguagcauucucuaccaaucuauacacccuugugucuacuuuuagguuguuuauuuuuuccugcucccuuuauucuauggcuaacucaauuuuccugggcacgauaaacaaaugaggggcagggcugacuagugaggagcccuuucucggugcuuacgggcauuguccuuagucuuaacguaucuuaagaacuaaacuuggagauuuucugugaguggcagucaccuuuuauauugucacaggccaacuucucccuaccauaagccuacugucccuacaucacuccucucugaaagcacagccuacacuucagaccuguagugucuggaucucuugaguuuccaggcugggaccugugcugggucuugagcaggggacacuacuauucuagaggacaguuaacccucaucaaagaaaaggcaugaugugugaggucagggaggugugccgccuggguccaggacacuuacuggugcccagauaccaccuuccugggagauguugaccauuagagaaggccgagggacagccaacaguugagcugagacaagcagagauggcuggaucagcuauuacuggcucacaagucaccccacagagucacagucugaugcacacagggaugagggucagcggaucaugguucuuugguagccuggcugggcagggcuggcucgugacguugcagugaagaagugggcacugguuggagcuucuggaauuaccugaagaccugaaucagagcaccaccccugccucugguucuuuguggugcauacauacauacuuccucacugguaucuggccacaaguuugcuuggguguucuuacaacauggaagcuggcuucuguaagugucagcuaccccagugagggagaaugaggagaaaguuauaagaccuuuuaugagguggccuuggcacucaugcuguccccugauacacauuccacuugucagaauugaaucaccgagucuacccuaacuagaguggaagaagaugcucucucucucucucucucuguguguguguguguguguguguauguguguuacauguuugcaugggugugcacauauguguaugcacaugucaagauauggcaugacuuccacaauugcucuccauuuauuuucuaagacaaagucucucauggaacaugggccucauuaauucugcuagcugggcuccucugcgagugaacuccugggaugcgucuguccccaccuccucagcgcugagacuauagaugugcugcuauguuuggcuuucaugugggcguuggagaucuuaacuuagguccccacgccugaaugacaagcacuuuauggacugagccaucuucccagcuccuaacucuugaaggaugugaguguaugggggagggggaggugucaaaggccccacagacacauuguaaaagcaccauggccauugucaggccucccuuucgucccauucuuaucuuuuuuuuuguccaaaugacauccgcacuuugagccugccuggccgagggaaacauguucaucaggcucuuccuggcccucugcacuugaugcuucccagaggccuagucacuucagcagccuugccuuccaagagcacacagugggggcugggggcuaacugagagaaugagcaucuacgcuugcuguaaaaacaauggaaagcccuuuaacccugagagaccagcucaauagagcagagggguaguacuucugguucacauccuucuggggacuucagagagagcauugggguaaccccagcauugguaacagucagaggacaggauaggggccuuucccugaugaaugggcucugaacuugacaggccugagcaggauagaaaugcucugagccugagaugcauccugggagaccacugcuucuggaagaugguggcagaaaagacucuuuugguggugggccugguagggcccagcucccuucguuuucccauucccagugccuggcacguaaccaggcccuaggcaggugccagggagacagcugcggcauuaacccgugucgcagcaggggcgcagggagagcuggguuugccuaaucaaggcuuggcuguacaauguccaaacauauacaggacagcugcccucccccaugagaagugcccacaccccaugcugccacucacagagauugccugaaugccaggccucccacgaaccaccaccuggccuccaguuauugaugaccccaaaugaagugauugagucuuccugugcguggaggucagcaucagcccuaauguagcauagucaccuaagggcauguccccuagccgucuaccccagaguuccucaagguccuaagacuaacuuggacccugagcuacccuaaguggcaggauacaggucuggcaagcuaagcuugugccuuaucucuggcccaguguagcaaagacagggauggagacacugacaagcuauauccaggggggacccuaguacuaugaagugucaccacaguaguagguauuguguaugagguuaacucuuugcuuuuuaaaaaaaaguuuauuuuauuaucuuuaguuauguguaugugugucuauuuguguguggguaggugcauaggcccacagaggccagaggggucugauuccccuggggcugguggugagcugccugauaggggugcugggauucgaacucagguccucuagaggagcaguacaugcucuuaaccacugaguuauccauccagucccccuccauggaucuuuaauuuuuuuuuauuauauuuuauguguuuugguacuuuacaugcaugcaugucuaugcaugccugauacaugaaggcaaagagggugucagacacuccagaacuggaguuacaaauaguuacgaaguaccauguagauacuaggaauucaacccaccucagaaagaguagccagugcucuuaauugcugagcuaucucuccagccccaggccaugacuuucuuaagacauagcauugacauugacccuuacuuuccugcaugcuugcccgcuugcccacugccacaacauuaccacuuggcuaaaggucuaaccuuagcuacaaagucuaaucaaggucaccucuucaugaagauaccccuaguccaguccuucucacuuucauggauacuaccuuccucuaaaaucaccuccuuucccacugcagaaagucaaaucucccacagaacccacugagcacacccuucagucuuucuauccagcagccagagaaaucuuucuaggaaaguucccucuaaggagucccuaaagauugcucauugucccuuaccuccaaccucggccuacagggcaaugcccagaaccugcucauuguaggagggaugcagacagaacaaggggacaagggccacagggacauuggccagcaucugcaggagaaaaguagaucugugaaccucaaggauggauggggaguuaucagcagguccacaaagacacauugguggggagauccagauggaguguaggcucaagagacagagagguugugggaagaggaaggcucugcagcaaacacauugacuaugcggaaaauuacagggagcucaccuaggucugcagagagagagagagaaaaagagagaaagacagagacagagacagacagugacagacagagacugugugugugugugugugugugugugcaagcgugagauguccacaugcacauguuugagcauuaacagggaaaugaggaggggcuguggagucuguggauaaugucugcaagggugaaccuuaagaauggcuuuccuagcuuugcaaauggccacucagagauaacaugggguccccguugagugcagacuacagcauacagcaacgccuguucccagaagauggccuaaccaggcagccacguggcccugggccucucugcuuuggagaaaagcaguaacuugguaaccuggcugaagcuaguucuauccuuagacucuagggauggggguggggagaagugaggcccacagaaccccuuggccagggccugcugaguugcugcuuggaugaggggcucccacugcagcccuuucuccuuccuugccuguguggaagagaucugguguuucccuugggaccccauggggcucugggccccaucugcacuucugugcuggcaaaugccgaagaauuagcucagcaacuuccucccccucaucccccacccccacucuaaauaccuuggaaucaagagaaaagccgaguggccguuugcagccuaauucucuucagcugugugugcgugcauguaugugugcguguucucggaugcagaggccugcgagggaaccuuuugaaccccaaauguuggaguuggagggaacacaaggaacguuaaguccagcccccacuauguucagaugacauaaaccagauacaggaggaggacaagaccugccucugucacauggaagcccaaguacagagcaccaggugcugggcucucugcuucugccucagcauccucauccccacagcccuuagccucuggaagggaaggaaauguaggcacuauacccaaagacaacccugaucacagaucagcuaggcuggccccggccugggaagggacuaguacaacccucagagccaugacugcugccuuucccccaaauucuuugauuccucagaccagcucuauucucccuccaaucagucuggaaucgacccaggucucccauuucucuccagaaacaccuauacgucuuguuucucaaugagacaucaaauacauucagaucaagcucuauccucucuggucucccugaaaagaguagagaggcaggguuuggggguggcauauagcagcuauacugagcuugacaggcagagcuaguuguuugacagcaccccaugauccggaagaggguggugucaauugagccuaugacccaaaggaaaaggacagguuuuuuggccuaaccgacuucaaagauugaccuauggagaccucuugaaagcacagugagguauauaccagaugucaucaaaaggaaauugauuagggacagaacugagggcccagaaucuacaaacugacaacagacacucuugaaucuacuuguuggguaugucaugacuaaagacacaauuagaacucagacuuuaaguauaccauuaaauaaacuaaauuuucauaauuaaaacaacaaaccaaaacaaaacuauucucagccugguggggagguugugauauacaaccuuuaauuccagcacucaggaggaagaggcaggcagauuucugugagugugaguccagcguggucuaccgagcuaguuccaggaaagccaaggcuacucgaagaaacacugucuuagaaaacaaaacagaacagaacaaguacaacaacaaacccaaaacaaauaaacaaacaacccauuaucaagauagaaucccuaucaagcucccaggaaggugucacuccucuaagugaccuugcuucaguuagcuuccgagcuuacucacauauuugaauaaaacagaccuuugggaaacccacaggugaggccuggagggucagcaaggcacuuuguaagacacagcuucccuaggcagcagagaucuacccauuugguuuggauuaagaacauccauaacaggcgguugguaacacacacuuuuaauuucaguaguuagaagacagaggcaggaggaucuccaagaguuagaguccagccuggucuacagagcaaguuccaggacagccaaggcuacauagagaaacccugccuagaaaaaacaaaaccaaucaaucaaccaaacaaaaagaacauccauaacauuuugaaaaggugccuacauuucuuacugggaguuguguuuugguaaaacauguggauagucucuaaagaacuggggguuccacuccccuuaccuucccugcaagaaacaggccugcaggaacaggauccaaggaaaaugccuggccuucuaggccagaggaggcaaacaaaggcuuaggccucagagcuaagcugggacagugcuuagaguaaggaagagcaggguuucaaaucagagccccauggccccuucacauucucuuggugccuggcuuagcagcuucaugggguucagcagcagcaucucuaguagacagaugggaaacaagacagagaggguucccugaucucagccaaggggagcagauaaccacguuuaccauguggcccugaugccccucuuagaggucaauuggaaggcuggcaauggcaggaagcaggugccuagucacuuaugcuggggaaguggaaggggccauuuguggcaaaagaucccaggcuucacuuccaagaugcaagcucaaagcuaauaugaugaauuuaaagauggugacagguucuugagggaccccauuaacugcacaucugcucugggauaggcagaaaagaaaaccacccaucagguaggaggguaggacuggcccuuugaaucaaaugcagcauguuccagacgggcccaaaaggaauuggcaaagcagauguguggccugguaggaggugggguaccaagcuaggaguagcuucugaggguaaaaaggaacugucuguugcuagaggaugacaccaguuucucuuuucuccagcuaaauaacaacaggagaaaaaaagagaaaaagaacagaaaagaaaaagaaaaagaaaaaaaacccaaaccuaaaaaccgugccuuccccuccuucccccacauauacucagucaucuuuggcaagagagcuuccuggcuguuuuuguagacauauauuuucagcaaaagcaguuaagauguauggcuuccuugcgugcuuuagaugaccacacccuggccuguucacaggacuggcucucccuccccuuccccuaaauccuguuugaagucaauucuggguaggggugguuuggagaauauacccagaguuccacaugcuaaaacuauaguuugcacagaaaucugcauuccccccccucgccccaggcuugcuuaugaauccugggcaaguggauugucccccaaaucuggcauuuugucaaguuucuccaggcuuuaggucaaugcuagauacaggguggugcguagacaguguuagucaaauaaaugcauggauaaguaaguggacagaguggaaacgauccugaacacuccagugacagggccaggaaccaagagaaucuggaggaugggucgaguggcuggggucuaaccucaggacuaucauuaccuaguuuuauaacaugggcagacccagggcccccuccuuuucauaaguaagauagccccaagacuuuccuuacuuggugauuaaaaaaaaaaaaacaagcaggguggccuccuugugugcuuuagaugaccacacccuggccugcacaguaggauuccaugggacagcugagaggguggauugcuuuuuugcaucccaaggucaggccagagccaggggcauacucaucuuuggccaugaaaccguuuagguacauuggcugccucagguaucugcccuguacugcauugagguuggucucacacuuauucagaguuaagaaccccagguucagcuaggaagggaugaggaagguaggccuuaaggggugguggacccagcaggcuaggucguacaauccuguacaagcucacccaauccaaaugcuggagacaucaggcuguuuccucuuggccaauaaaaauagucagcacagagcuaucuguauccagccuaucaugaggaagagcucccuagucauuauucagcaucuguccaaucaacagugucguggcugccacgucaccaaggucuugguagguggccuagccguugucgcuaggaggaacaguugccucagcacgucugcgcagcuuuccuugcggcgccccuccgcguggucuaugauggugcauuuugguccagucaggcccgguguggucggccucauuuuggauuacuucggugggcuucuccucggcgugguuacggucuaguacaccuuagugugcuuuucucugcaugguccuucccagcguggcucgucucagcagcgugguuuucauccgugugaucguccucugcaugguuuuucacggugaggucauaucagccagccaccagccucagcauauuuguccacaguucuuuuggagcugccucugcucggaucacuugagcacuacaccucagucccgacuagccauccucagugugcuuugcucaacgcgauccuccucaguguuuguccugagccuagaccuccauggugaggucuuaucuuguuucgucaugguggucggcgauaugguccgaucugccucagcaauugggucacuuccguguggaucguuucagcacggaucacuccagcgcggucggcugccuuggcgcgauccacuuggcuucucagcauuuuuuuuuagccugcuggguucucucaguuuuucuucaacacgcuucuuuucccucugugugauucuacuuggagagcuuuucuguucagcuugguucccagcgcuucuuuuucucggcaugguucuccuagguaugguuuuuuucucagcgcggguuucuucucugagucagcacggcacaagucgcaaguccgcguggccgcgcucaucauagccucccccuccucgcggcaagcacucacggccagaagcagaggugauucgugccgcgcuuucgcggcugggcuccaucuucguuuugccgcaguggcuccguauucguuuugcaguuacggcucgguccucguuucacggccgguccucguuucacggccguggcucaguucucguauuuugcguccacguccccaucuuuguggcccaggcuuacagaagcagggguggucuugaggcccuuugagccccgaggucggucgagucccaaggugaguggccuaggacaccggcucaggccuucggauucuaaaccccgggccgagucagaacgcacuggagcugaaaccgaaucgggucuggagaccccugagcuuuguagcccgguguggccagcaccaagguagugaguggaguacguguuguuaugugguagcuguuuuaaugcugagagugaggggcuccguucggaauguucgcgcauggugggggaaggguaucguggaacugaggcuggggaaggcugcuuauucggaguuuugaaccgaguugugaucuagcucuuggauccgaguuggguguguguaugugugggucuacagugguuccgagucuagaguggagucacgauuggaaucggguagagauucgggucuggagccgacucggaauucaggugugggggauugggaacuugggguggaggccgcagugguugcaguggguucuuaaccuuccuugugcuuugacccuuuaauacaguuacucauguuguggugaccuccaaccauaaaauuaauuucauugcuaccucauaacugcaauguugcuacuguuaugagucauuauguaaauaccuguguuuuccgauggucuuaggcgaucccuaugaaaggguuguucaagccuaaaggggucacgacccacacguugagaccugcagagucagaaucaggucugaauugggggaauagcagaacugggaguuaccuccagauuuucaguugggauuugauucuuuucugugguuuuaaauugagaucccagaggcucaggucucuguuggggaccagacugaggguuucuaguuauauucaggaccugacugggcaguacaguaagaauuaaaguugguuuugagugugagcauaauggucugagguagggaucaggacugaaguauaaagagucugguuuuuaacaagugggaaucacauuuugagacauggggucccaugugggucagaguugauuuaaaggaccaaggccagggcccaaaccuuaguccuccauuuuguuguucuuguuggucacauucccuuuucuguaaaauggggaggagugcuuuccgcuguaaccuuucugggcauaaaagggaguaaguaauucauagagguaaaaauagucuuaucuuaaaugauuaaaaaguguaaaauauuucucaauaguaauaaggacaaauaauaugcauuuaacaaucuuuucucauaccgugugcccuuuguuaggcacuaccaaaaaggaaccuuuucuguucuguucccuagagcuugccccacccagccaugggccuaauacacagccauccucaggcaauacuugcugaaggaaagcaggcaggcaggauuaaccagauuucuauggugucuuaaaugauccauuucugcaccuguuuuccagauacuaggagaaaaauuuaaaggauuggauugcuugauuauaguucuauuuuaauguguuaccaaacacacugaagaaaaaaaguggaucuguuuugggauuugugcuccagcuagaaggaucuuuuaaaauuucgaaucagagcauguccaaauucaaauaaggagagcacaaauaaagaaaauuaugaggcacuucccuggugaacauagaugaagguccacuuacaguauuaacuaacugaauccaagagaauuuugaacaacaguucuuagacaaguaggauuucuccuugggauauaaagaugauccaauaucagaaacucuauccguguaagucacaguauuaagagacugcaggagaaaaaacauaugguuuucucaauagaggcagaaaauuuacaugaugagguuugacgccuauguaugcauuugagggggcuggaaggacauuacuuaggaagccaaaaacuagaagagaauuucccuaacuugauacaguguauauccaaauuuaacuuuuaaguaaacuuaaaaacuauuauuccugguaagauaaggagcaggccaaggguauuuuccuagccaccuccuaauauaaggaaaagaaauggagauguaagacuuccguggcaggaagagcgaaacuaaugacuuagagagaauaguuguauuugcauugggguuugcaaacauuuugauguuacaaucuuuguguacuuaaaaaauuauuaacucccccuccccacauuuauuuaagauggacuauauuuauugguaguuacagucuuagacauuaaaauuaugugcuuaaacauagagcuguauaauuguauauuccagggaggucauaucucuggaaaacucugacuuugugagaaucaaaauagagacugcagaugaguuaugggcguauuuauuccucagaccaucugugaccuuuccugggagggucugagaaggcuucucagaaguuucuuuggacuuuucuuugaaaacugcugaacuaccugaaagauaagguuuugcagcaaaagaauuauuuggguauauacaguauacccaaacaaacaaauuuuuaaaaccccacauuucuuuauaacaauagugauguaaaagauguaagaagugcacucagauacaaauuagaauagcaacgagauugucuggucuuuuuuuaagacaguguuuuugggaaaacuguaaauucccauuggagauaaaggaagguauuuggaugugcagagacauuuguuuucuuggaaaauuuagcguuagaauccucaguauuuugcaaaucuguaaauuuaguuagauugcagucagacuucuagcuggaggauuuaacaucucuuccucaaaaauguaugugaaagagaaagauguacaaaugccaagugaacuuugaaaaacauuccauggcuuagcagccagaaggguggagugacagagacccagaacagagcucagugagcucagccccgagucuggggaaggugacaugugaucaaaguggcaccacauaucaguggaaccuccuuggaagauguuaaaaaacaaguaaaagagaaacauccugugaacucagaguccuuagaaagggggagcuccaaacuguaaguaaaagguaguugcuauuuauuaagaaaaacuacagagaauauuuucuaggguaggguggaagucuuaaguaggauaaaucucaagacucaaauuuaugaacuugaauaggugcaaaaauuaaggauuucuaugaaccaaauccaucauggccagugccacuaguuccauaauugaaagacaugauuugccuuuuuaucccuucucaugcaaaguucugcccaugacaaauuacaagauaaccagaacacuaaaaccagggagcagcagcugagacgacgagaaagcaaaucagaggaaaagguaagacaagaaacucgcaggaggguuaccagugaagauaugcucaaacugaagucaccagagaaaugcaaaucaaagugacauuuauuuuucuucugagaacccuuagaaaguaggauaaugccaaguguuggcagaagguagggagcgagacuccccgccugccgcaggugagaggggagaccgacacagacauucuggaaagcuggccagcauuuuuuuuccucaaauaaaauauuuuauaccugcggcgcaacaguuucccuccugaguaaacaugcuggagcaguucucccccagaacaaggagaggcugugugugccugcucagcacagcauggccuggggguggugggguggugggcauuuggcucugguugcugugguuagaagcaggggacuagauguacacuucacaagauggagacacauggaaacggugcugagugacacagacagcaaacagaaggaggguuucagucccugccuugguguuuaaauucaaauuacaccccucccagaccugcgcuaacugggcauacuguccauacguacaaugauauuaauaagcuacuccagagcagcugucugaguggaagggaguggggguuacaggauggagauaggaugcaaaagcauggaaggagcagagugguccuuuuaaacagacccuuucacaguaacaauuuuaugggcagaaggcugugauuuacucuguguguuaugcaccaggacccaagagccaaguaugaagaagugaaugugcacccaucacucaccugccagauacccucuguagacuccuauuucuaggaacaucagcuuuuuacaagguuggcuugcccugagcucugaccauuucuucuucucuugcugagcuugggccucagcagcauucuuugugcacacguguucuaggugcaugcaugggugggguccagaggucaaugcuagguaucuuccucuaucacucuccacuuucuuuuuuauagacaggagcucucacugaaccuggagcccaccauuuuguuuugacuggcuggccagugaguccccugggaucuuacuuagugucuauaaccuagaaccccagucaugugcugccagaccuggauuuuaugugugugcuugggaucugagcucagguucucaugauuuccagcaaucacgauucccaguaaguacuguagcuacugaaccaucuccccagcccaauaucaacauuuuuuuuuuuauuauuauuauaucagcaaaguauuccucccgcuucagggucuuaagguuagccacucugccugacuuuuauuuuccuguaauucucauaucucacugcaagugccuuuucuaaccugccauaucaauuagucuccucagcuaauugcuaccucagucucagaagcaugggcuacacugugguauucuuguuccuugggcguguccacuuaaguuagcugccugucuccuccacuagaagggagguccugggugagcgugugugucuucucuguaggguuagcacucuguaggcaucucacacauuucuggucaguggcuucauugauuuguuaaaugaaaggaaagagcaggccaggaaaguguucuuccacuuucagaauucagugagaaaguaaguggugaagauuucuuaacugccaccuugguguuauuuggugaaggauggggguugaggggagaggggugcucuguguuguaguauguuucacagccuaaauggcauuuaccuaguccaaguaguccccucacaguugugauaacaaaaccugccucccaagguuaccacauagcucuuggggugggggugggggggcacucccugccaggucugccuuagacuaguugcaaggagcuagaaagccuuucagcuuuaaacacaggguccuuuaaacacagcggacccuggccuuuauccugcaaugcacuaaauccaugcccuuauggucccuaugaagacgacccuggccuaugccuguauaauagaagcaccuccaucucugcucauugguguaaauauauuuugacagguaauccuguccucacaaugcaugggguuccauuaaaaucuuuacaacauucuuaaaacaaaucaacaaacaaacagaacccuacuuauuguuauguugaugaaugucuugucugcaugcauguauguauaccaugcaugugccuggcauccccgaggacagaaggaaggaucaauccccuggaaacuggaguuucagaggguuguaagccgccacaugggugcugagagacaaauguagguucuuucuacaagagcagugaguauucuuagccaccgagauaucccuaaccccgguuacaaccauccuuuagcugcagugccucaguugugaggcauuggcaccugcagcuuuaccaguuuggagccggccuggaaagaggcuggguugggucuucucacagcugccaguuaguacagacuaguaaguggcucuugugaacaauagauccagaaguuuacaguacacuuaggaggagaagaggguuugccucagagaaggcugcuugggagaguaaguggguggccucuaauacuggguuuccuuucccugugcuugccucugauaucagccuuugccaugguccucuaugcugccuggccccagaaagucugggucaguggccagaguccagacucccaggguccugaucagagucuucaggaaggccugagagauuagagcacagaacucuccuagccucucccacugggaacugaaagcuucccugagccuuuccuagggacugagacccuuguuugcaauuuaaaugugcccuccuuuauggaagaaucccagcuccuugaagagccuugagcucacccucccuagcaguuguagccuuagccaggggaagaaacugaucuaaugggccuuucuccuaauaaugcuaauuguggcaauuaggcucugcaauagagaaggggcagggccaggcccacuaguuugcccuuagcucaaauccaggccuucuuacucaggcugcuguccagguuaacuaagccuggugaagguacuaaauaagcagagguucagcagagggugguugaagccugcuggcuuccaggggcaaucacaguggauauggaucugagucuaauguucagucuaguauucauacaggugacucugggccuugccaugugauccucccagaagagggucuaacuggagcauaaagaugguuugaauuaaucaauagaccaauaucuacccuuuccuuucucucucucucucucucucucucucuuucucucucucucucucucucucucucucucucugugugugugugcacgcgcgcgcgcggcgcgcgugagagagaaagagagagagggggagagagagggagagggugagggugagggcgagggcaaaggugagcaggggagggggaaagaaagaagagugagcaggggaccauggauaagggcuuaucuggucuggcaggaaguuagguuuugaagcauauggcucuauggauuaagaaaccauuccucaguauggccaauuaguagaucuaauccccucaaccuccuaacauauacuaaaggaucaauguuucuucacucugcagggucuugcuuacaaagcacucuggguccuguucucucugggagcugggaaucuggucuaaugaaaggaaacacagcacaggcauaggcagccugaaugcuuaguuauucaaagguuacaccguagcugacuuugaaucaguauauagcgucugcacgguacggagacuuuccaggaagugaauuauguguaggaggcagggaagugauuauugcuccauuuuauagacucagccauuccacacauacuuguugaaaguccaccaugcaucgcacagcugucucgaggagggauuuuacaggagucaggucacgccuguccuauggugcuuguguguuguuauacacugaagggaauauucuuugaggucuggagauauagagaaaggacuauuaggaaccagccagaacccaucugggauccuaguuaggcacuaagaccaagaggacacuguggaggagggaacacgagagaaagaagcuagcuuucuaaaccuggguacagaucuucaguccuugcuuccugugaggaucuuggguuuguucugagaccacugagagcugcuaaggcucuaaguucccauuccauuuagaucccauuccacucagggaacuaaguggaauccacauuuuaaaaggcucuuccuccugaguggaggggaauggagguuaucagaagguguuguggccucccagaggagugacaauacaaaaggagggaauggguagaggggguaagcagccuggcuugguaguggacuaguugggucucagcuaggaaagaaggcguuggaagugauugcaggguuucagguuuacacuacuggaagaauuuuuguuugggguggagcaugaguuggaggaguggaguaugaggugacagauaugguggguccagcuauuggaaagcuaguuuuugucaguccaggagcuccugaugcugagggaagggaccagcguagggaaagaagggcagcacuacuuagugggugugaaacugggugcagagcuagcauggugaccggggauagauggacaggaaagaggaacccauucuugcagaggucauguggagucaauguucuagucuuaugaggguuggcaguggacagcaaccagccuagaaugugccuccugccaguaugacuaugacacuugccuuccucugugacuagagagaaggccuuauuucucagugguucuguuuucucucugcauuccuagaaucaagaguagcaaaagaacauuucuccauagaaugugcagggagggucaccucccucaggaggccucguccuugcuaaaguauuucauaaucuuggaacgauggaaaauccuucuacccauuuuaaugcaaagccgggcaagcuuuaaaaaaaaaaaaaacaaaaaacaaacaaauggccuugaauaggcugagaugaaaagcaaagagguugccaacgcuagagacugggggaggggugugcagugggcagggagauuuugggaggcuccaaaguuagcaguuucugagcuuuacugcucaaaccuagaggcccaaaccaaacagagcagguccaggguucaaggugcaagggggcaacagcccuguguggaagaugucucuuucuugucauuguuccugauuagcuguucaaacagccuucacagguucugcaaaaaaaaugguuaacuguggguccucuauaucuucuacuugguaauuuuuaaacacagcugagccccgggugccccucccagaggcucagaggccagaggccagaggucagcacaaacucuacaccacgucugccuagccuuuaccucaugugucuaggaaugauguacauuagaguagaggcucugauaccucccucgcucaggugccagaucaaggcuucauccucugcccuuugcccaggguuuagugggguuugcuaauauuacuuaauuccugaaugaaccuuucaggucagcauaaaagagcugggauuguauggcaaaacccggauggggaagauggcucagacuguuaaaaacaagcucccagcagugggagggaagcacccccuccuugaggccugaggucaguguucccauuaauccuucugccaagggauauguaccuaaagguucuagggucacacccuaucgggacuagccauucgggacuucugagaaauggcauuugauagcuacauguacugccacaacuguacacaaccaagucacacacauucauccuguucccagccagggcccaagacugagucucauucccguuuuaccuccucuuagccugggugccucuaccuuguaauagaugcugaggccuacuuagaccccaugacugugccugacaaccaaagaagcccaccuucuggugucacccaccucacccuagcucucugugauuccagcuuuucuaaggaaggcagguagccucucaaccagucauaugccccaugccagacagucaugccagccgcuccagugcucguuaacuaccuuuaggccuuguggacuucauguucuauggaugcgauuuaguacucccaagagcaccacaagaaaggggauagcaagcaagaagaaacucagccacauagaaggacuuguuugaggccacugggugccugacaagaguccugccucuggggaaaccagugcuccaugccuguaaccuugacagagugcucuuggauuuauguuuucauagaagcagucuguggagggcuagagaggcagccccuguuuuccugggucccugcuugggaagucacagcuaucacuguugagaaaggcagcccagguuuggagcaguuggaggcuaucccaagaguagguuggauguagaggugugggugcguauaaaugccauccuggguaaauggaaaggccacaggccaccgugauaagguaccacuuccucuuccugccuggugggcugcuucaguaccaaaauguccggccacuaacuugguauaaacaaaugggugugauccaaaugcaaagaacagaugcccuuagcccccacuccuccugcccugauuuuccucagugggcuguaugucuccucuccauucuguuucuaagaccaccuaaacaucaagaaucuggaaaauagccgcuacagcaaauguuuauauucuucuugguuugucauucauucuguuccucccagagaggccuaaaugcugagauacugggcagagggcaaggaacaguacugcccucuccagaggcugccaagagacaaggcuguaguuguagucuuuagggccaucagcccuacaugaugcuguccuccucauucccuuuuuccuaugggugggcuucuucccaugggccacuucuacccaaagccaugugaaaggccuuaaguucuagagggauaaccugaggguggcacugaguugcagggugcaaugagagauuauugcaaggcugguagaacccuccaucugcagggcugacuucaaagcugcugcugggcuuagccugcugcaucaaagucagccaguuaaacaguuuucacauaaaagggagaguggaggguuuaaaagccuucccgugaagacaggcaggcauuccacccucuucucaggcacaagagccacuagaggagaaaguaacugccccuuaaagacacagaaaucaccuuacacccugguuuaggguuugaagacuacagccuuagguacaagcguagugaggcaccuguguggagggauccuccauuugcauucagcucccugcuuuauaucuggccuuguauuuugcuucccuaccuccagcaccuauguuuuuggggugggggugggggcaggcuaucuggcugucgggaauaaggagauguaugguaugacagcccugagggaacucagagucaggcugcucagguuggauucuagcuuuuagucuaaacaauggcuuuauacagugccuuucuuccaguccuagcagccuugugugaauacauuuagaggagacccucguucagccuccccaagaacucucugggaagauccaggagacucuaccuugcucucugucuccccacuucugccuuccucuuugcccccccuccccccaccguugggucccuugccugacuccaguauacugugauggcagaagugccaaugucuccucucaagcagagccuaacccagcuugugccuugcagagugcagaggggugcucacccugcccuccuucagggagacaucaaagggaaacuggaagcauucccugcugacccccagugagugggagaaaagcagcagcuuggcucagcuggcugggcuggggauuuuccauccuaccaacaauauccacaggauagauaccccacucuggcuuuugaggaaccaggaacccucaggaaccaguguuugauuugcagccugauggugccaugaagggcucauuggcauuggggcauggcuagccacuugaggaguucccuauccucaugacgugcugacgacugguuugaaaucuuagcauuucucacccuagcagaauacuaccucgagguccccugagaucuagcuagccaggggagaucacaauuuguguggggacccaagaaagguagagagaagacugccugccuuuucucuaucagcugcuuaucccccaggccuuuuguggagugcacacuccagccuccguagcagcucagcacagcccaggcuauccuagacugucccaaguccucaaggguuucagcaccucccaagcuaagggaacaggaaguccagaaauagaagucaacauuuaugcuaaaccaggguacccuccccccuuugacuaacaugggcuuuuggcagcuucuggcucucagaucuccaugcacaauuuguaggcuaaauacucuacacuacucaggauaucuaauccugucccucaagaguuagacugucagguuuuucugagucacagcaaccuuaggccugguaagucauagugagcauguuucccucuucagccuagaacucacaggaugggccaaagagaaugcaguaugguuucaaggauguccagggccagcagcacuaccugaugagaugagacgagaugcuugccugcuccauccugucagggucuggucacacaacuaggcuggagcaggcuuagagggcaggauuagacauagugagauccaacaaaggcauagaaaauaucagaagugagauagcaagccaggccuuaggcuugugcuuccuguguuccugucaacgcugcccuacucuaugauuauggaaaaaguaggaaaaaaaucuuuagagaaaccuaaguaccaauguggcuuuuguagcagacugaauugugggaggcccuggugaagacauauugagcuuugacaugugauugugccuuagcugaggucuucucucagccaaagcaaggacucaguugggucccgacucccacaaggcuaucuucaaguacuguuuguucuacagauggagguggggggcuguuucucauuucugccaaagucacuuaagggacacagagaagguagaccuguugcuuuucuaguaccuagaaguggaaagguggagguuggucagaaagccacauuuugcuucucauucccacaugaaaaaagauggcgcugggggguuuacccaucuguuccucuauaucuugucuuuggcuggccuaggcccuuaucucaccacaugccacuccgaagagagacggaaaugacaagagugggcuaaacuauuuggacuggguaaagucaauaauagacagugcccgauuaagaacugggaggaccaugucuuccuaagucucaugguaugcuccauucuucaaggggagccauucccguaagagcuggugugacagauuugaaguggcugugccagcuagugagucuuuuccucugaaccauguagugauaggcaaggcaaguugacaaggaaguucuuuccaauucgaagaagccaaggcagucaucaagcuuugucuuaccaggaaaacgucaguguauaucguuggcugucuggcuuagaagaggcaacugugaaugauggccagagagaaucaccuaacacaaucugguuaugaacacauuugggccauggagcgagaggcuagcccuggaggccuaguggauccacaagaacccagagagagaacaaagaggcucagggucuuagaggcuucugauccacacagagagagucaggaaaguuauuagagguguuccuucagcuaugggaacaacaucugagaugcugguacuccagggcagugugugugcugcuggauagcaggaagguuucuacugaugccugaggcuugcucuagcucauaaaucuccacuucuccuuagcacugugaaauguuuacucugaacuaagccucugcuuuaacaagucauguuucaauaggaaaaccuucguugauggaaucgaaugcaauuccuccuccuccuccacgacaguuacccauuccuaagaaaagcacagcauuuuagcaagcacccagggccucaggaacuagcauuugcagacaguaguguggcagauaugauggccucaugugcaucaaggagaaucuggccucuaugugccuggucuugccaguccuucagacugacaguucuggagugcuccauccuucacuuccagccccauuauccauagaagccuucagugggaacucucagacuuggugcugguucauuccuaagacuggccuguugcugugcuuuggaguuagccuagcuaguccuacccagugcugaggguauacauacacacacacauguggcaugaucuaccagcccuaaggcaacaguguguuuucuuuaaacaguagaguagguuuccuguauguaccuagcugccagagguugcugcugugaccuagaaauagcugcugccccaagccuugauccacagguuuuuuuuuuuuaaagauuuauuuuuauuuuauguguauuaguguuugcccacauguaugucuguguauaacaugcauacauggaacccacagaggccaggaaagggcaccagagccccuggaacuggaguuacauauucacaaaaccaagaugguuccuuccaugugaaacccuucuaagagaaucaucaaaaauuacuguauuucauuggugccuacauuucuagaacagcaggcagaaaggggugcauuguagagaauggugauaagauagcuucuggagaacucuggggccccaggccccauggauagaacccugccagggagcuuugaagcuguaccgucccuucaagauguuccuggcaggcggauuucugaguuugaggccagccuggucuauagagugaguuccaggacagccagagcuacacagagaaacccugucucaaaaaaaaaaaaaaaaaaaaaagauguuccuggcauuaacaggguccaaagcagccuucccagccccaggcuggguccuaggagaaccuaacugauugcaugggaaaccucagucauuuacauauucauuuauuuauuucuucaucaaacauucacugaagguuccugaugugcucugaguagauuaagcacagaauauaaaacacugaauggaaguggucaguaucugcccucauggaccuugaauggaauugacagagaaagucaguaaacuuguuaccacaaacaugcgguuauacauuaaaaaugagggaugggggugcaguucuccaugguucagucugaagcugagaaauagccuaggcacguuucagccuaaaaucagcccuagcuugugaaggugaaagucagaggagagcuuagcacguuuaaagaugacgccaagagaauguuacaggagcugggcaccuucggcagaucgacuauucccuggcuuugugaccugggccccagacuugaucacucuaguuucaguuuaucucuaaaucagaaaugguagauaguauucauaugucagaagcugccgugaggauuagugaaguuauauguauaaagcccucagcauaaugccugagaacucuuaaguaguauuagcucaggauuauucuuuagacugacauugugcucggagugagcauguuuucuccuuaaacacuagaguggugguucuuuugaaauacccaguugguaaaaucgggacucuccuguuacuccugccccuaggacuccuucuggaugcaugggcaagcucuagugaggccuaguacucagaagaaaagagaaggcuuuccucuacccaugcucaggauguuguagaguuuucuggcuucuuucggcuccaggagccugugucugucauagaacagcuuggcucagccuagaaccggcacucagagcuaccuuuuggagaugaguacauuguauauguaugcauguccaucauuuguguacacauuuauuuguagggcacagcuaaaaaucuccagaaauauccuggggaagauaaaauucuuucuaggcuucaugguauccuaguggggaccaccaaagccuaacuuccuacccagagucugaggaugguaaggucaacugguuccauuguuuccagagcgcucacagaaaucgccaaucuuuaucugaguuagcuuagccccacgagccuucacaugggggugaagaaugaguuauacaacuaggggucccaggguuggagagacagacaaaacagaggagaaugguuuguccuggaacucacagaagagagcauccugcuucugccuccuaagugcuaggucugcaucuagucuaccuucugucaaagcuagugggcuucuuucuagccucccaccuucccuuaacauaauauaaaagcacauuccuuggaauccuuggaauccacccgucccccagcauugagaauagaauuauagaauuuucucuuucucucucucucucucuuuguauguguauguauauguguauguguauguauacacacacguucuuaaugacauuuucuaaaauacuguuguaaagucuugaaguaaaaauuccacugguaguggggccacagcgagaagaaaaaaaauuccauugguguguuaaucugacagugcuacauaauaaaagaacacacaucuaacaaaccuaugauggcuaauauaaaacucuuacauauuagccaagaaggucuggcaguuuaaaaaaauguauagaccugaauuaagaucauagcaggaugcaaaaacauauacaaccugggugagccucagaggugggcagacggagggcuucauuuucuuuuaaagauggcaugcugcuuggcucaauucauguaacauugcuauaaugccauguguggcaguauaugccuuuaaucccagcauucaggggcaggggcaggggcaggggcaggugaaucucugaguuucagucaggguauauaaugaaaccuugacucaaaggaacaaacaaauuucagugacguacaggcuaguaauugccaggggaucaggaaaguagggcuggaaagccugagguaccauaaaguggcuguacauaggggcccuugaggccacagaaacauucugcauugguacuguacccuaagcuugauacguuucuauaguucuaaguauguugcuggaggaaacuggucaaagaguauagggaaucucuuugcuauuguuuacaggcauaugucaaucugugguuaccuuagaauggagugcuuaaaaaguuacaucucgcuuaagucaguaguacacuuaaagauaccaagaggugaauuaaaaaauguaagaggaagauagguggguggguaaagaguuaaacaauauagagacuuucuaguucacuugagcauugggaacagcgacuucuccuuaugaauggacguuuucuauuuaccaaggugauucuucuuucaucuaaaauaucagcacaauaaggaagguuacacacaggugaguuaugcuaagucuuguggaaaauguggcaugucccauguuucugaagcaccuggagccaccccuguaccucuguagucugaccucaccccuacccccucaucaugguagggcgauucuucugucaaggugagaaaggcaaugauuucuaagauuaugcucccauucugaauaaccauaaggggcugcaucugccuugcuucugacacugaugcuauucaaccagacuucccucuccacggccuugccaagcauggagaauguggguuguaggugaugaaagguaagcugaugccuugugauggaaaaugcauuuaaggagcacagcagacaacccaugucgaacaccuuucuacaugguuccauauuaauacauuucaccucugaacaacucaggaagaauguucuuuuaguaugauuuuauagaccgaaggucuagaaugaaggaagaaguggugaagccuggauuaaaauuugguuuauagcuucaggaccugcuuuuugaccauguaacauuuuaguugcacauccugaaauagaagcaccaaucaaguaguggguguggcauuccucccagccauggacaagguuggaaaaacauaauugucccugguggcccagcugagaaagggacugaguccuugcuuuacagaucaugcuguggagccauuuuuaccuguauagauuauaauagcacugucuggugcacccccuccuuuuggugacagaauuuaggggagagacugggcuauauguuaagauuaugguacuuuuaaaaguuuuuuuggggggggcgggaagggcaauuucuagggacugaacccagggccucccacaugcuagcuaagugugcugaacucuacuuguacucaaaacccaaaagacaaaaccucuaacccuuugccuugaauuacacauuguucuccuguuuucuccgaaugugauaaauugucuuacgauggcccuaaagcaugauuagauauguacccagauggcuccugugucuggccauaacauacucuuuggauguugccuuaugagggagccucuaagauaaguucucauggucccugaacaugguuagcuauugaggacuaagucaggaguuaaggaugugugucacucauagccauagccaugcuuagcucacaggccagucugggagccacucacuaguugauacauugugaaugaacacuucaugccaccuggguuuugauaauguacgaagaagccaugacacacagaaggacaucucauaaaguuauauaauaacaccagcaggaccaguauaguucuaaguagagccuggaaacagacacaaaaucaggaaauacaaucaagauagcuguuaaaaccagcagagcaaagauguaaguuuaguguugaaacaaccauauaacuguggaaaauaagucggcuuuuuaacuauuccaaauccagauaaacaaauaauauaaacauaaagcaugaaauaaaagaugauagaaaacacgggagacuucauuaagacagucacacagugagcuuauuuccagaucugauacaaaccccucaaauaaccagacugaaagaacugacuuuguaaaaaaaaaaaaaaaaaaaaaagcaauauccaagaaacagugggaaaaaguguuuuuaaugacccaaaccaaauguuuuagguauuuauaaaggauaaaacccucaugguggagagauggcucagugaguaagagggcuuggcaugcaaacaugaggaccugaguuaggaucucagcucccaugucaaaagguggguguaacugcauucccgccuguaacaguaccuguugauagauagcuaggaggauuguugggccuuacuggcugccagcucagguccagguucagggagagacucuaucucagaggagucagguagugauaggucaggacaccugauguccuccucuggccacuccaugugcaugggcuccugcacagcacacguguucuccccacaugccccccccccauccauggacaccgcccccccccccccagauaaaagaaaaccaaagcuguagcauacgaugcuuuaagucuuuccaauuaacaggcccauccauauguacucuuguugucgggaucuagggaaacaggcauauuugggcagcauuuacaauaguauagggucugugaggcauuaucuaccuaaaucccauuuaaaauaggccgaagagacaucuuaaagugaauccauuugaaauaaaaaucaauacauugugauaagcagaugauuggaagguuaucuugaaaaaguguuaaguuauaaaaagauuugcucauauauaauaacacuaaugucugcagacacacacuuuuagaaaaauagcaaauugaaaaccuuuauuuuguaaagcacuaugcaguaccaucuugcagagaaaggauguuguugcagaaguauggcaaggccuggcugauuuugagaggggcugcccugaaucuuccaugaccucaccaacucucccuuaaaaugcuuaucuagaauuagccuggcucuucuuuucaauagauaacuggucuaacugucugauuuuuccauggagaaauucaucagcaaaucucuuuccaacuugaugaauucuucuauaagauuuauaguuucucuucauaagugauuugcuuugugugugcuuaauguuguuugguggacaagagcagccuagaaggagcucagucaacagagaugccagcagggauaacauggauggggauggggaggcacagccauguucaauggggagagcaauuucagagggaacuaauuucauaaguggucgguucauaagugaauacacuugaauggauaaucacuauuuuuagcugcucuauacauucaucaauaggggacuuguuccauaaaucauggcauaaucagaggcucugcagcuguuaguagaaaggaugcuugcugcuugucugaguaaagcucuaucuucgaauucauguccauuggugcagagcgcccaugcuaaacgugcaaaguuucauuuggcauggccucugggacauaugucucagucccuggccacugugugcugucggacuccugauuucugcauuguauaguagcauccuugggaauguucacuuucuucauagacuauccuuuggaagagagucuggguccaccaauuuauuaaagguaccuuuaggaaggugguuuuuuaacaccuaguuuagcauuccuaauccugcacuaccaucuacaugacuuugccagauacuguugaguuuacguguugacuagaaaugcgccugguuccaggaauacagcuaacaaccugaggagaauagugagcacguucugucuggaaaaagccuggcccagagcaaaggccacaucccccuuacaacauccuggaaucccagccacgagaaaaacagcacugucaccugcucacuugaaugugcauauauaaguaaaacugcuacucagaguugcaacauaucguaacaagccaguccugugcagacaucugcaagacuacggcaccuaccuguacauaagacacacguacaaguauacaagaaugugugccacccauguccaaaggaggcacagagacauguaucuuugcuuauauaaagucucugggaagaccuagcagaacuaaaaacauuuaggagaagaaacuugggaauuaggguugggguaggagacccuuaguuuuguguuuuuguuuuucuuugccauauuccuuucuguacccuaauuuucacuguuugauuugugcauguauacacaaggauguguggugcauuugugguauuuuuuuuaacauaauacuaguauaaaagguuugcucugaugugcagugcauuuuacugugauguuugcuuuuuuagcacaacauuaauacuuuacaaaagucuuguuuggacauagcagguguaguuccagaucgggauuggcuguaggcagccacaguaugcaugcuggguggacagcaugccuuggagcugggagucucugguucaugucacucuggagcaggggcugcucuagcacaaagaagguuuugaaaggcaaaggcagagccagagucagggcaggcucugggcaggcuccaagagagccagcaacccucugcugaaggguacccugaaccccauugcacaggcgggcaccuccugugaagugagacugcuacacaagucucgucauuauagacuuuugaguggagugauucugaaagaagagaaugaguacggcguguccuacugugccucauuaaauauggaaguuuuuauguaacuuuccuccauuucagguaaucucaaauuugauaaaugaagaaugacagcaguucaucuuucaguucauuugugccucuauugaucuaauugaauguuuucuauacaaauuuauuuuuaaaucuaucuuagaucuuagucuacaaccacauuucauauugccaaaacugcauuagggagggccaaguuaucuucaccauugaaacaggucugcuaguuuggcucugucuguccuguggaaaugacacaauguugaccuaagagggggguccucacuucucccuacugaguccccaugguuggggaagaagaagcugugagcccacccccagaccugcccacucaggacaugcccauguugggcuugucuguggacucugcccuuggcaucccuguugcccaccugggcucuggcagagaaguugggcgggaagaggccagccgaguacccgccaguauaagaggaaacggagagaaacagcuccagucagccccagaagggaggccuggaaaaacucugcagcuggagcaaacacaaaggacuuuucagauccugcagucaaggugcccagugcuuuuuuuuuuuuuuuuuuuaauacagcuauuagggugacaagccuuuccaaaggccagcaguuggcgagaguuuccaggaagcuggucuggcauggggcugggaucauagcaacuuuuaacgagugaaguucagaaggaaagagucaucaggaaagguuuaagguucaacaaacuuuuugaauuauuuugcaaaaaaaguucuggcuuuccaauucaaaggcauguuucccugugaugguuuuaagccagagcuuauuucaaaggcaacacagacugcacguuucuaauucauucccuggagauauuugccuaauccuagagacaagcuuugcaagugccauccagugccuggagacacuagagccauccuacuaucuuuucaaacagccauccacccacgugucucuccccucuaccaguuucugugguugggaguacacauaugcacacaccuucucuaagcaggaagcugcucuuugccaaaagugaauggaauucagauuuccagaggguauccuuggucucaagcuccaacagccaucugacgaagaaagaugcuagugugcgcgcuggggcugugaagagaggggcuuccguguccauucaaaucuuucugggccccaagaaaaaccaacaacuggcugugcucucccuagccccacccagccucagucacauuccuucccuuccugagcccacccuggguggccccacaaaccagcuuccacuccucccuucccacuaguggggagaccuaacucauguacucaucgaacagccaacagugaaaaugaaggucacacugcaagcccagaacagcuuaaaagcagagaaggguccuccccaaugucuguucucaccccagucagaggcuauucccuuuuucucugucuagcagccccuaggacuaagcguucauaccuuccugugcuugcuuccaggaaauccuagccuacuucugccuguaacauucuugguccgggaaaugaagaggcugcuguuugggcugcuguagccuucgcuacuagaauguuccaacauauuagggaucucuaucccuaccuaagccuuccaagccccaggauccagcaucccugggacuuguacauuuauacaugcugacaugguuuugauaaugagucacaguagggaucagcagugacaagguagacuggcugguccuaagccuaaguuucugggauuuguacuuguccagccagggagggaacauguggagaaccuucugcagcugucagaaggaaugagugacuaugguggacauuuugguucugugcucagcaagauaccuagggcagagacuuggcucaaaggcugcaaaucaaauccuuugauuucaaaugagacuauuuucaaugccauagucuccuggaagcaggauuauuucuccugagaucaguucuggaggcgauugaggcuuugccauaugggcauugcucucucaccugguucugguugcuaccaggugcucagcuugucuaauuacaguugacugucucuacugucuauggcucuaaggcccagucugauccucuugcuuggucaaaaguaguguuguccuaguggauuuucuggguguucuguaaaguguuauuaugguuuuacuggccagccuuacuuucuuuccuuggccagucucaggucucaucuguaaguaucugcaucauaaccucaggucuaccaacuucuuccuggcagagucuguagugggcuuguccucaucaccuuggaaggaucuuccuguuccaguccuagguuuugugcuacuuaagaaaaugccccagguaacuagcaguaaugcagccauuugaucuagcccugcuggaggugacugacagaaccccauacagaggagauagguuccaucaguaaacagaacauagggguaagaauugggcccgcuuucuggcucuggucaugccauuagguggccguauacucucuuaucucugauugacuuccauucucuugucuuuacauuauaugacaccuccaaggauguugugacccaaacccagaccgcauggucuccugagauccugugauggggccauugcccauuguugagacagucugguaaagaaaagccugguagcauggaguaugcaaagccuuagggaagaauaacuguuuguuugagacaggucucauuuagcucaguuuguucucaaacucauugucacugaggaugacuuugaacuucugaucuucuugccugaagcuccugagugcugggauuacagauauguacaacuagaccuaguuuaugccguguugggggucaaacccagggcuucauaaaugauaagccagcagcucucuaacugcuaaaccauauccccagagggaagaauaucuucagugaggcccugagccucugggcuggacuacuuuaccccucccccugugcacauagcaugcuaaguucagucaagccuggagccuuuugucaagcauugcuccacugaagguugaccaugcuacccucccccccccccacaccccaggcaccugcaucuggagcccacacuccuagcugguagaguucauaggguagguuuuuguuuucugaaaaagacuauuucaguguuuugaauuagcagaguuucaauuuaauuuaacaauuucaagcucggcggugguggcacaugccuuuaauucuagccuuuuaaacugccaagaggcagaggcaggcagguuucugaggccagucugcucuacaaagugaguauucuaggacagccaaggcuauaaagagaaaccuugccucuaaaaacaaacaaacaaauaaacaaacaaacuccauauccaaaccugagggaaauaaaagucuggcuaccuccaaaggagguagacuuaggcaagagaaaaagaucuuggaguagagggcaggguguuggcucacacauauggccuaaguguagucaaggccagggcaaggggacaggcccagaacaaaugagcacuuuaagucccaguaugaccuucgcccuaccaucuucaccucagguacagagaccagcugccuaggaaauuaaugguggggcccagaggacagcugcuuagugcuaccuacuucaaugaaccuaguucuguuggggcagcaaguuuaggcccuaaagcaggauagguaagaacccugccugagaguauguguuuguagagagcucuauguucucuaagccucaucuuucacccuucuuaccugccuacaaccccacaacauaaauaccuccuaacuaccuugcaaaugcagccucauuucugccucaguucuccaguagggcaccauaagccacuguuaggacagaguaauacuuagaguuugauuuuauaugagggcuuacagccagaguccucagagagaagccagguagaauaaaagugaucccugaaaacaucuugaauuacacccuuccccaguaaucucucucagagcccucugaucucuugcuucuaaguuguucucauguccccaaagaagaaaaagcucucaggggaccugccaauugucucuggacuucuggggcagcagcuccaugugugacgagauuacguaggcagaauaucuaagcagauggugaagccaggauuauggagcuagaaaugcuuggcugaguagagacuuagacuagaccccuaucucuugcacgcgccggacucgccagcaguaacaaugcugcaacaggauccuucugcacacauuuauugggagagcuugauugcagaggcgaagagaccccgagcccagaacuggugcugcuuauauaggccuaggagaggcgugucucacaccuggauugguuaugcacuaagccucauuugcauguuccucaucugauuggcuacucucucucuguaccucacagagccucauuaucauaccucauuugcaugucucacaucugauugguuauacucucaaagccucauuaucaugcccgggccaggcagugucuuugcaaaaaauuuuacugcauguguacacauugguuguuuguccaaacuuaugcgugguggccagcaguagugagcgccacucugcaacagcacauguggcuucccacaccuaucuacuuccccccauucucuuccauguuuccaagaugucacccagaucacccauagauccagccaugggcuuaucgucagaccucugcuaaccagucauugccaaggagaugcgucucagguauggcuuuugccaaggacaccugaacucuccuaaaaggaauacaaauauaggcauaaauacugaguuggaggcuucggggcaccaugagaagcuuaagaggaaaggacauccuaguuccuagucucugagaucuagagaugcuggcauggccuggaagccagugaaggcuccuggcuuccuuauguggcaaugucaaucacgguauacuuaacaggcugaauucacagaauucucauggcagaaggugaucagaugaccagugcccaaacccaccauggacuguucaaaucuaccaauggucauaaacucucacguauuacugagagugccagcuuacuacuuacucucaggacuucaaccugaccuucaccaaaggagacguaggcccccagugacaguguguccuagaaugagccuggcucuuccaguauuucuugugugauaguagcaaguuucugcccuuccugaaccuuuauuguccccuuuugugaagcugaacacugacccacuaaguucuccagcuuacacagauauacauuauguauaucagcuaacuauaccaucaccaacucuagcaccagaagugcagcacaggcuagcacugaaaaacuaguuuguaaauacuguggcuacauuuggguuuaucuuuucaacagagagccugcuuccuaucacuugcagggccaaaggaaagcaggauauaaaacuuaccccucuccuuagucugucugaagguaggugcuuuugaguaagcaagucagcccaaugaugaugggaccaaauauugaagcacacagaggaaccuuuaacugccaaaggcacaguccuuggaucccauguccgacuuccucaucagaguuaugggugcuagucuccugcuuguaucucuaauuauaggagucaaaacagcucacaagccccuuccccagcuacuucaggcuuuagucaggacuuguagccuuccccugcugcuacauauuccagaucaucccagagcucaguccucuuaagucuaauuuuauccuguuuaggacagcacuugggaugcagccugacccauuuguagcccauggaaaaucauuaccuggcaguuuuuaaagcugucaggucaaauaagcaaaaccuuauggggucuccagucacaaagggauacuuuauacuuucucaaguaguuccccaagucagguauaugacuggauaccuguccacauuugcuaaaauguauauaccaacagaggaagauacauucuaaauguguuaauacacaaagagaacuguagcucauagacauuaagaaaacugcuuuaggguccugugagcaggauuggaugacccaagccugccaggguuuccugaaagaugguccguagccacugugagcccacagcaaaugcaagcuucccagggcuuccuggaagacacuguucuuagcuauugcgagcccacaucagaccauaagcauaugcagaaaacuacaguaagaggacaggaaggugaccgaaauggcuggagaaccaaucaggccauuguuccgcagagcccucauagggccauuacaaaggacauuuuccuagaaacugaugcauauauauugaagcaaaggccuuacagagccagccaagccagccaugaggaagaacugagggagccugcauaccccagcccucagguccuacugguaaacagcaaugauaaugaaaggguaacacuggccaaagagaacaaccugaaagcugaccaguugaacagaggacaguccagagaauaaccauaugccaacagcgagcugauuuauagugacacugauaugacagggcagugggagaaggauggugcuguaucagacuggauguccaaguggaggaaaaagcuuaucuugaccuugacuucacacaggacacaaaaaucgauuccagauggacugcagaucuacaugugaaaggugagcuuuuaaagcuuuagaacaaaccagaauaucuuuaugaccuuggaguagucaaaguuucuuaaguaggacauaaacagcacuauccagagaggaaauguuugauuaacuggaccauguuaaaauuaagaccuucuguucaucaaaagacaccaagagggggcaggacaguccgcaagcagggcaguauuuacaauacauguaucuguguaucugacaaaugacucacacuuaagaacacccaggacagagagagauaaacuugugccugaagaagaacagcucucaguauaggauauagaugucuuacagagaucuauaaagaaaugagaauauagaauggggcuuagcucacugcaaauuacagauaccacucugauguuaugagaagccaggauggcuaaaaaggaaauagugaaaaauuccaagugugugugaggauguggaaaaaaguggaauauucacaugcugccaagcagggguaaaaguuggggugacugccaugggaaacagcugaucccgcaaugacccagcacuucucggcauacaauuagcagagauagccauaacuuuuaccagacacauauauguagaauauucuuaguaacucacuacccagaucugcccaguggucauggguaguagaaugaaagagcaaaucacaggccacucagaacagagugucaacgaucaaaaggcucccgagaccacuguuuucuucagccucacugggaggggugggugguucucagacaucagagugaaugaaagugccagauacaugugugugccgugugcgaucuagccauguagauuucaaacucgggcaaagaaggcuguugugcugggaagugagcuuaugguuuguucuugguguguccaugauaggaaaugggaucuaggggacucccuggggauucuacugcuuucuuuggaugcuuggcucucagguagggagaaugcaguagguuuguacuggaaaucuguauacguuacucuuuugauguguucccuuucuacuauaaguaaguuuguaacccagugcucuauagaagacaguauuuucugagcuuuaguagagacacaacacgguacaagcccagagggacuggccuugccgccugacuaccaccuuguuuagaaggauauauuacuccaguaccccugaccagaccaccagcagucccuauuguucaguuuccacuuccagcucuaggcaaagcaaacagaagauguauuugaggggcucucucuguuuuucagaguaccuuucuuuuaugguaucgguguaguauguacugucacacuacucucccuggcuucucugucucccucagaacaauucuaggagguugcugcaucccuuuucaugugcuuagaugaaggaagugaaacuagggaagguuaggggcacugggggcugccuauagcugggccagugcaggcugggagccagauugagggcauucgauucccagucccucucuuucccacugagccacugagccacuccgccucgcuuuuaauuuaauuaggagaacauuuaaucccccgugcauuucagagacggguuugagccuggccggggccuuguggggcucugacagggauccugugacucauacagccuugcacagcccucccgggagggcucucauggggcuucuuuggcaccuuaugcagacagagguggucuggauauucacagaagacaggacacuagucuggaaagacaaacuggucucaucuguucuugacaaguccccuucccuauccuccuggacacugcccccaacauggccccuccaucuucucccaucaucauuugcagguugagaagccaaguaagagaaaugggugcucacugagguaccacagcaggcccugauugucuccaggcccugaauaucccaggcaaagcagucccaucagaagagcuagcccccuaguccacuaaugcuccccuuccagaaggcauaggcuggccccagccucgcugacaaacgcagaauucaggagacauuaguagugauguggaugaaagccaggccacagcgggccucccuggaaaagagaaacucgaacgucuuggcgugagauucugcaggguccaggagaaaguugaagacauggaaauucuaauuaacgcacgaggggcugguuuugcucaaagauuuuugaagcugucaugucaaaagaggcccggcaagcacaugcucgcccgggaggugcuugugggcaccuggugggauucuugcaauguccuagccuguauucuuacuuucccucuguccucuagacuuuucuccacccaucuugguaaacugguggccccugaaugucaucccagagugggauggcaggcugguuaguaaauaaauguugaggcuuccaguugaaaaugucacaucaaaaaagucugagggcucaggaaccaaccucuuggaagaaaccuuuagggaaacuacauggcagagccaggcugagcuauaggcugcugugcuugugguaggcuuggcauuuggggauguucaucuuagauauccuugugcaacggauggggcaaugguuccagacaaguucugauugauucaucggcuggaggguggggugaaguggcuguaggagaagcucacugaggucaaacccagacaugcuucuuuagcguugagcuauaggugcucauguccugggcccuguguaugucucggcaucuaugggacguaccuggagaccuugcuucauuucaggcaaggcuaaugaugugcuuucugugucagaguaggacuggcaaucuuaggguucuuucauccuggaguuuuggggagugcuggaaaaagaguggccaugagcagccacaacacucugcugcuugccugacccaggcuagaaucagggagcuuugaugauagccucaagaugaugugagaggcauuccuggggaaagggaggacugaguagacacuggaaagaugugcaauucugauggcuacaggaccgacaaggacauuccagcuggugggaugcaaaugagcccuugccaguuaaucccaguaagcagaauccuggagacuugcccuauuaguuguaaagauacuccccaucucucguggcagugggucucuauuuccuacguggcccuuagaagucuggagcaaggcuuuagauagaggauucauguugagggagauugaggaguacagggcucccuuccagugauguuagaaccaggaagacagcaucugacugaaauauguaugcaacaccgaggcccagauauccagaucuggacgaugccuggggcuuacuugaggagcugcugguacgugccuguugagcuggggucagagaagcaauauugucuucucagcauccuucccuauuuaccucucugguuuucaauaggccugcaccuuggccucucuguccccaaacuaucaguggccaaccggcucugaaaagaggagcuucacccagccccagggaccuucccauaaucaaggcuacagugaccucaccucccuagggccccugggcggggagagcuugagauggaaacaaaaugugucuuuauuuaugcuuuuaauuugaauucuggaacuggcccagcaugguaauacauuuaacaucaguaaaaugcugaagaaaaauggaucuguuuuucugcaacugcuucccacccacucugcucccugcaagacccuaguacacaucucugucccugguagacacguacgagggugugugccucuuuuuucaguguagguucauagggccagcugcccacaggagccaugcugcaucagugagcugcuggagccuagcuuaauuacagacaucaaucaacaggcugacuaugcaagaggcaaaggaaugcagcccuggugugggcacgugggccccuuacacaguacccaugauggccuaucugcuccccuagaauggggaggggucuugguaaggccaguaguccugggagcacaucagguucuaggacccagacacacaccaggccuauggucaugcucucugcuaggacuuccaccaaggauggcacuagacuucuacagaugugggugucuaaauucuuagaugccucaacccugacuccaacucugcuuugaccagauuauauuuuuugcuuaagccuaugaucucucuaucucuaccuuaggucuuuuaacucagccccaccgugggcuccuccuuuccuccuuucccaccuuccuagauuggcuuguucccagcugcugcauuuggaauaaguuggccuagaaagagucuugguguguucuuggguagagacuugacuggauaaagacuguccaccuacucagguuccaggagugcuggccugagaagagcugugguaccuggaaagauggugacacacuaggccuauagagaccaagaaagcaucauucaugucucugagguucuguuacagaucuguuaucagauuuggccuaguacucugagcagagucgucuaaguggcuuagggcugcuucuagaacagauagacaguaaaugucuggcuccaggagcuuugaguauacuaauaccagcacagguggccuuuugcccccaaaggugugguuauagggcaucuauggacugaacuauggucauguaucaccaguuuccacccucccuugggaccucguuggugcucacaguagcuaggagaugugagacacaucuaucaagguagaugguuuguugagagcgcuacucucauuguagcugcuucugugucuggagguugcuccauggccagaagaauaaaauggaauggauaccaaugagaggugagugaucagggggauaagaaggcugacuggucuuucuaggcguaggcaauucccugaggccugcuaugguugccauggugcuacuuacuauccuuacuccuaagcaggcacuggcauauccaacaccagccacaagacaccaguguuuacacuuugaguugucucaugccguggacuugauggagagacuuaaccauaguguaagcuauuuuucuacccucugacgccagccuauaccugccuagccugucuggacuccuguucccacaccucuguucccgcuugcuaaugcagccagccuguaaggcuaucuuaggagggagagugaccccugcuucucaauaacauucucgcucucucuaaacccaugaacccucucuacaucuuacaaaccacgaggcacugcuaaccucguuuaaguuuggguggucugggaagauagugggcaugccuuguuugaucauaaucauuccucugacaagccugccuucccccaggguggccucaacuuggcuaucugguuacuuaagaaacccccagcacugugaguccaaguuucuucagucauuguaaagucaagccugaaaucuaggcauaggccagaagcguuaugacuacacaagguuaaggacaugaauuuuaguagaaagaguggaagagucucagaaugcgaaucucaggaaaacuaagagcauggcauuaacauccuggcacagaaacacuuuucuagaggagugccccguggggcaguggucagaagcagucugagugaccugccuccaccacaucgcugccucuccugaguuuugguaggaacauuugagucacauguugcagagaaaucauggcauggcuggguacuaggguuuguccuggugaugccuugaugggggcccaaauggggggagaggaugggcaugugucccaggccagcugugccugggggaaggccaacuggaaggcguagaaaaucagccauuuccuccaccugaaggagccccugaggacaguaguggcaacuagcaucugccccauggcuuuggccaaaaucccacagggaaaugcuaaaaaauaauguuaacucucuugaaggagugguggagggguagaggggaggaaaacaacaacaacaacaacaacaacaaaaccaacccaaguuucucagacgcucaaagcaugcaaacaaguggaaaaugaucagucugguuuuccauaagucaaaacaagaggaucauguuuccagauucagugggaaagccccugcccuucucuccugccugagcccugaggccagccccagcagccaguguccccagguucauaaggauaggcagugaguuguggguacuggguaaauagacugcaucccagcaagaggauaagcuuugcccuaugcuagggcaguucccuugagccccagccuuugagggcaaauggacacucacugugacacaugggugaugggggucagcagugucuccccuuccagguccagguccucugcaaagcuguuuguucucaagaaauggggugugcuuacuuccagcaguguagggcucuuccuuacugugaagaagguauggggacagcucauuaggcuucaauagaaacuugaucaugaaggggauccagaacuggacagaacuagacucaaauguccaccccaaccugcuauugcuaugggauaaaccuguaagcucucaagaucaggugaagagugaggacagagcuuggaaguuuuagccuuacccaucagguugguuuacacugaguggaauaagugagugggcauucacuuauuccauucacuuaugcccauucacuuauugauugguccccagguaccuggggacuuagccucccaggguaaaccauagaggcugguacauucuccccaguguuguagcugcccuggggcugaguuccaggacugaguaagguucugcccuauguauguuaaguucuaggccucucaccagcuucacauaaaacauuugugccaagaacaaaugaaagcacugaucuccacuacugugcuauucacacacauacacugacagaucaguggaccaugcaacaaaaggugcuaguaccucugcuuaucaggaaucacaagcugaauuccuuguucuggucaugaugccuuauuaaccggguucucucugagggaggccuccagacugucccaauagcugacuuccauagcucagggcacugauccagauuagucuucacagcauuuccagcuuacuaguguuugcucucaacucacuucuccuuuaaaguaucuaauauaguauuaaguacuucugaugaguggaauauugaaaaauucacagugguccucaauuauaggaaucaucugcugcccgggacccuggcuuuucugguagcacaaaugugaggucauaaacuugggcagacuucuguucuugucaguuuuucuuacucugcgacauucuuuucuuuagguaugcagcuaugcaucuaaugaucauuuuagcagcacaugagcccauagcuuaggucuaccacaauuaacuuuacucaucccauauuuuauggauguucagucuuguaguuuuaugacaaccagacagugauguaauauccaucuucguuguuaaaaguuguugauauacugggcaggugagauagcaugacuuugguaauauuaauaaguguuuuuggauuguucuucuguuaaguuguagccaacuauuccuccccuucaauuuugcuuggccuuuuaagcauggauaaacacugaggcuuucucauuuucaaaauuguuauuaguucuuugagacuaugaucaacgaacuuugauccucaaccaccuucuaacuucucaauuuuguauccucuuguuuuaaaauucaauaauucaucaacuucaguuugugcucuccauguaauucugggugugggggcuguaauacugcaguaugaaugacccaccaggaguuagaauguuaaggaaaaacucuccuuucccaggagccauuaauuguccauagcuuuucaagaaccucuugggguucgugaaauucuuguacucaaugauacaguguugacuggcuugaucuuguguaggcaaucaugcaacuguccugucaugcccagaaguuaguuuguuccagucgucgccuaucucuggcucuuacaguccucccauccccuuuuauaaugguccugggccugugagagggggaugguuuucucauuuucauauucacugacugcuucuggcuuguuugggauucuucuuucagaauugcccguuaauaaccuuugcuuggcauuucaaaggaacuuuuaauucauuagagauaauaaccuuguguuacaugaagcauaaauaacuuucuuggucuauguuugucuuuuuaacacuccguuguuuuaucauaaagacugucuuguuuuuuuuacagugaugcauuuacuuuauggaauggguuucccacaacuacuacagcagucuuuuacauuuauuuccaauauaaacauacaaaugugggcauacaucuguauguguauauaaauuuuaacacauuuagcauuuauguguaaugcaaaggauguuuagaagucauacaauggaaauacaagaacacuauauauagucuuuuaaaaaucugaaauagaacauaaaacuaaaaaaaaaguuaagaaaacuucaaaaucucuaggacuuuagauuugaaagagaauugagaugcaacaccgaaaacuuaauccaagugggggaggggacucaauuuuauuauaauuagaaacaaaugaguuauuccugcaacaagugcauuuuucuaaguagcaacagaagcaaggaggaacaggcucacugacuguuaaaaugcugugcuuugugaaggcaaugagacaagucacagauuuacugcauaucacuuaauggaaucaagggccuuguacccagaguauauaaagaagaaugaucauaauuugacaacagugaagcaaacaacccaucuuaaaaaguggauuacaaauaagcaugggaaauugugcucagccacagucuauggucuuuauggaaauacaauauuaaagcuucagugagauaacccugaaaauuaucaugaagauggauaaagcauuaaauuaaaaccuuguaacagccagcacuucaaggaggcagaaugacugcaacccucaugugcccgaggugggaaugcaaaguggcccaacugcucugaagaacaaacuucauagccuuauaaacacacauaugauuuaugacucaguguaugggauauuuaaguucacauaaaucugcacacaaaaauauacagcaauuuuaccucuaguugcaccaaacaaguuauaaccaagauggcaacagugaaaugaauaaagaaaucguggugugucuaucugucccaccuaugcaguggaauaauguccagcaaucaacuagaauauuggaggauccugggacagauaauagacuauggugaguagacuguguguugugaauacaugauagagcacugaagagagaagguggggucugggggaggaggaacuugcuaacguugcuuuaaaaaauaauguuuggacuaaagaaaaccuagagaaaaaauacugacauaaacacaauauucuuguagauaauuuuguuucacacagggguacuguauaucaaggauuauacaaaccaguaucuauacuagaaaaugggagcugaggacaaaguaaggauaaucagaaacaguauaaacucgagguaagcugcauaaagauacaaacccugaaacauggauguauauagacuuucauuauagacauacauauuuccuaguucuaccugcagaaaggauauguuaucagugacccuuuuguggcaaagaacacacucugugcccaggucauauauaacacuguuagucugccaauaaaagcgaauauggcuccuuggaagaauggccgcuucuggggcuagcacagggaaacuacacgaugaaccuaaaaggaacuaaauggaaagcaugucuaaagggcuccuguacaaguggcuaaaguagaaaaagguuagccacaaaacaauaauccucagcuauaccccagaaacacaguugccaaguccgucuguauuucuaaauaacugaaagugagaugaaaaaagugaucucuguaaguguagaaggaacgaguuaaccagaagugcaccguagaaaugcuugaaagauccguggaugaaggcuagaauagaauuaguaggugaaaucuuuuuuuuuuguaauuauuccuucauucucuuuauugauccauguugaacauauacaauaaacuaaaaagccacuuuguucauuuaauuaucauauaugauuguauuguccauuuuacaguuauguuguuuuccagugacauugauugaaucccgggcuuuguucaugcuagacaagcauucugccacuacacuacauccuuagucccaaaauaaauuuuaauugcuuuagugauuuuaacacauucacagagucucuaauacucuuugcaagagauagaaugaaauuccucauucuccgaauguuggccagaccuggugacuugcuuuuaauaacuaggucuaauaaaggugaaauagugggucaauuacagugagcuauuuaaucauguaaaguugacaccauggugauggaagaaaaugagaaaagcaccuugccuuaaugacauuuacgacaccuguaacccuauucuaauuuugagagaauguuauacagacccagaguagcacugacauuugauaaguauuuaaaagcaucaacuccagugacaguacugacaggacaccaagguccugcugaaugagcgugaugguagauauuggacaggcucuuggagcaucaaacugggagaaagacuaaaguguagcucuacagcauuguauuaaauuaaacuuguuuuaguuuuuaaucaaaguaacaugguuaugugagguacuucgugaaagguacauugcaagacuauuuuuucuuuuacaagaauauguaauauaugcaaauaaaacacacaaauuaaaagggaaaagaagcagaauaguagaaaagaaucucuaguguauaaagauagauuaaaaacuauuaagaaaagcacaaaacuuuaaacagagacaccgacaaacagaaaacugccuuuauugcauugacaaaacacucaaaaaauucugaaaaauccuaaauuuuaauuaaaauccuaauguuuguggugaauacucugacaaguggauucugagauguauuuggaaguguaaaagaccagggaaaaguaauauucuuuaagaacaggguggcuaauaggcuuaucaaaaacaaguacuucaacauaguagucauuaauacaauguagaacugauucaaggagagacuuaacuggcuagugggauagaaauggaugucagaaaauagccuacccauggacacuugcaauguauuaaaggcuuacuuaucaugagauggccuuuuaaaugacacauucaaggacaaggaaauucacauggggaaaacacugaacugggcccuuaauuuucucacagcguacauugaaaacacauucuugguguuucagggcuuaugacaaguagaacuagaaggaccauaggccuggauauagaagaauaucuacauugcuuugggguagaauaacuaagaagcaauaaucaaaaagaaaaauagcaauuuagccacauucagagucaaaaccuagauaucuaaauacauuuuaaauaguaaaaagggauucaaaaaugauaaaacauauaaaaaguuagguaaaucaguaagaacaaauagauaagucugguggcgcaggucuguaaucguagcuaccuaggaagcugaggaagaagaaauauuauguucaggaccuugcugggacaacagugagucaagauaacucucaaagagcaaaaugagggcuagagauggcucagugguagugucuucccacuagguauaagaccuuagguuuaauucucuaguacugaaaaaaaugaccuaaccgaaaaauaagcaagacacccuacacccacccccuucaaaaugagacaagaauucaaaagcgugaugagcuuauggaaagguguugugccugacuagcaaucagggaaauauaaauaaacucaggagcucauggcccaaggggccagcagcagacuuccagcaggaaacuauacagacauuacuuagucauagcuggaagaagggcucaaguaaagggcucugugccugugacauccucagagagaccagggaaagaccuguaaaccuugaggaaugugugcacaugaagaggcccacaggucugggacguggugggaguauguuacuguucccauucuagagacucagggcugagauucaaguguacuggguuauauuauacacuugucaagucacagcuacaacuucauccaggauucaaauguucuuuuggaaaaaaaaagaaaaagaacacaaauacauauuucaguacuugcaucacuuguauacacaagaaaggagaagcaaagaggugacuggaagagggggcuguguucuacacacccagaaugacaagugccaucuccaagccugagggcccagggugagccccucaacuccugagaaaggcucuguccugguauuaggaaauuaaaaugugcacaucaguuggcuguccacagcgggcggggccugcaccugccagagaggaauguggacucuuugguuuaauccugggaaggguucauggggccccugcagugagggucagagaggggcucagcacaguuguuuuuccaagucaaaaggagagacuguugucugcuaggcauguuucagagacuuuaggggugcuucucuuucaugggagaaacacuauucaggacugccacccacuuuauauuuggaucuguacucacagccaggucagacaucucaaagauucugaaagggaguugagagggcaggguuucaacuuaaacacacugguggugcuccucuuaggcaagagcuuggggcaaguauuguguucuaagaagccccauugggcacuucaucucugaagagcccagaguuugucuuucauaaagauauaaaaagauagcccaacugcagaacaaacugagaccauggugaaugugacaagggucauaugaccacuuagacccuguguagaggauacuagagcaaugucagguguucucuucugaaccaaccaaugucaguguaccugguccuggaggaaaaguacuguuuccuagugacagugaagucacauuuuccuaaaacgauucuaguuuuugaugcuuucauuccuuggcugcuucugucuugucagagccagaaucuggaccuaagugugcagggcagaacaaaacaauuuuguuuucuaggaaaaugggaggucuggaauggcgaauguagccucaggcguggcaacugccccagcugggacuacccacugccaaguuucacccucucucaagagaaccaaaaccagacuguacgcagcaucuuccuucucagccaaagggccuacucguuagggugauuugcauuguacuuaagcauugaaaaaaaaaaaagacuggaaggaaauagaucaaaaugugguauguuugccuguggauuaaaggacuucaaaugauuuucauuuccuuccuuauaguauauguauuuucuauuugaaugaaugauacauuuagaagucagaaaaacaguucauacaagccuccuguauuugccuugcccuccucauccugggguuagcacaaugcaucuaaguguccuuacucagccaccuccuccagucuguccuuaagaugcccaagagacccaaugacacagagcuccuacuucccaagcucuccaagaccuucccuuuccuagcuccauuacuccugcauugagcucccagacuuucccucugcauacccgaucaucugagcauuccaaguccaacucucugcaaggccccaggccacccuguugcccacugcccucugcugagacuugcuggugucaguaacuucacccagcugcucaccccugcccuccuccuccuccuaacugauuauaauccugccugaucucccagauguaaccuaaaccaccuuccuauguaagcuccccaaggcucuagagauugccccuucaauugcuauggggcuuaugugugccuggcccucagcacaggaaccuugcuuucuuccucucccaugucaccuccggugccuggcacaggcaaguccccugagccagcucacuccgauggaauaaacaagcugccuauguccuccccuagcagaggcccuuucccuguccccccucaaucaauuuccccgucuugguggauuugccaaagcccuguggauccugcaccaugaaggaaaaaaaacccucccuagggcaucuggacagcugcagccagguccugcgugacauugcugagcugcagccccacagccugugccagcugcccaugcccuguucacagacccugagccagaccagacccaacaccaccugugucuucacucagaggggagaaguaagagacaaggacagaaaguguaaaagcuauucccacaacagcugccaggaacaaggcgagagugcaguguaaauguauauucacagcugguacccaguuccgcuuaggaaaauaccuugcuugaguggacaccuguuguuuuugcgaacucugcaaccaggccuggcuucuggaaauaguucaccgaaucuuccuuaaagggguccucauuuccuacuccccaguguguaagauuuaggaauucauuggcuauuuccaaagggggcuuuguggcuggaucacaacuucagaaacauaguugcacuuauaaagauggcuuguacuuugguugggagcauugagagccuagccugagccuguggcagaaaucauuuggaaaaagucuggcaucuuucuucugguacauguaaaauaguggacaucuuacauuuauuggaaagugaguguuuaaggacacagaugaauauagcuaugcauguaucuauaggcagagagagggaaagagcacaaaaaggacaggguagaaggaggagagaaagcaucaccagacuagcucuagcugugucuggaacagccagguucagauucauaaacuagaaaaaugucucauuguccuuaucuagauugaaaugggcucugcagucuguuaccaagagcacuuaggaauauaaaaagcuagggguaagauaugaaccugaggagauaggucuggggguaagucuagguugcaaaacacagcaaacaaaacaacaacaaacacccuaagacagucuuguuaagcuuugcagaguagaagacaggaaagaagaagguuagcuagauaaaucuggcccgaggccccagcuucagcucuacaugggccaggaaacucugggaaaggugcuucguacagcuguccacugacuuucuacuguuauaaugcaaacuucucuuuagagagcuucucucucuacccuguguuugcagcacuuuauggaacaugcuguauuuuguguucaagcaaagacugaggauacauuuaacuugagauggacagugacaugacaguugaagaugaccuauggaaucccaagaaauccuaggaacaaugcuaggcuuugugcaacuacagaguucauagugcuggagacuuuucacugaaugccuuuucucauaauggagauaacaggccuaacacauaaaucucagaguaaauggaaaugauucugugggcccaaggguggggucugaaugguaaggugcuaaagaggacaggcaaugacagagcuagcccuaagcaagcccaggaagcagagcaugaguagcacagcugccugcagaacaaaacuagucuacccagcuuuccaugcugcaagaagucacuguccaggucucccaagacacauuuggaagggaagguuccaggcagcaagagcggccccaggaaacuuuaauauacaauggaaucuggguuaagcacuaucuucuccaaaaguugagcucacaggacauuccccagaaaccucuggagagguggggaggaaaguuucuggaggucuuuggacgaagaaaacaaaaaaguggccuugauuuuucaaggagaaauuacacaggaagaaaaaaauguuuuuaaucuaauuaagagcgaucuuuucaccuucaucacaacaucacggaaaugugccaguucuuaacuucacacaauaaucaaagcaauuaaggagaagccuuggaaacuggugcagauguucucagaauguuuaauggggaaaugaguugcaggccucauucucagcauccggcuccaggcccuggcuaccaaauccagacaucugcuggggccccacucccaggccuggagggugugugcuugagaaacacaggucucuucccaggcugccucuagcgaggccagaucuggggccccagaggcuccccaugguuccucaagccagagccuggacauagucagaaucaccccagagcuagggagaagcuuaaugucaaaauuauguuaacaacugaugucaaaaguaaucaacucaaacuggcucccucaccccugcuggcugcaggaggacuaugaguagaggaagggggggcaaagagccccuggcaggggcugggagagacucucuucuuugaccuccucagcaugaagaucacauaaagguguggcagcauuggugcagucugacucugugugcuuugguucaauguugccaagcuagacccgagaagcaaauuaguccauccuugaguaauuuucaaaaaucagaaaccauguagaaaggagggugcugcucacuuaguaacuagccuguuuuagagagcagaagggcauaugacuaaaguuaaauggcuugaaagugaagaccuugauguaugguucaggcagcucauuaaaccacacuggaagcccugcuguaugguacacacaaagaacauggaagaaaagaaaacaucccugguuuugaggacacauaggcaguauggguccucacacauguacgacauuuaccauucauacugucuucauaccaaaggcuucuuaauaaaagaaauaccagauaugacuccagggcuuuguuuaaugcaggguaggccaaaggcaauggaaagaaaucucucaaaguaagccuucaguggagucaauacuccagguccacauuacugguagaucuuuaaggaguguuguaagcugaauuccagcuguucacuaaauagaccacuuucuugggaaguagcuggcacaaguuuccuguuauucucuguccauaaaucuagccccaaaaaagugauaggaagggguuaaagccuuuaagaaugaaaguagcaugaugcacuuuuuaucgaaagaauuuuugggauugcuauguauaggauguagcaaaggaaagccagggagacuugggaggccagugaagagugaaagggacauccaaacaaacagacaaacagacaaaccccuaaacaaacaugguggcauuagcaggggaagaagcuauagaaaccaagagugggaaaagucuauaugugaaaaagcauaauuuuaaagauuugcaggaauguuuggagaauaacaacauucuacucccccaccccaaccccuggacuucaaaucuucucacuuacucaaaaaaucagaacaagcaauucaacaacaguaagagcaaaauaaaaccauauaugaucuauuccuucaacaguaggccaaauacauagaaauuacccaugagaggagagucugcccaccauuguauaccugugagugcaaaagaagaggccuacgaugcucugucaaaagagugaggaugcuaaguagugucaacaaaaauaagguuccccucuccacagaaauauuuuuauaggaacucagaauuaaugucagugauuaauucugggaagcagucaguaauucacagcaaccaagugaauaucacaaaaagaaaugggcaauuaaaaaguguuaggggcccagcaagaugauucaguggauaaagauucuuguugccaagacuaacaacuuuaguucaaccacugggaaaaaaacccauuuaguagaggaaagaacaaguuugugcaaaaauuacagaaacuugggacauuuucacuuguccuuaaauacucaucuucccucuacuaagccugguuugguggcacuguugcagaugauagguaguauggacccugguccuuguuucugaagugugcaguacagaccuugucuaaaauaauuauuuauguuuuacaauaauuuuuuuuguuuuauauuguuuguggguagccugaaagacugacuuaagguguuuucauuuuccccccaaauaguaauugcgaauuuucucagugugaaaaauaguggacaguacuugcaaacgcuguaagaccuucagagcaguuauaaugacuugagcaaagaucagugguugaagcacacagcggcccacugaaaagccucagaaggcaaucuagagagagcuuccuuggaauuuuagagcauuuaaaauaauaguaugugcuaauaacuuacaaaacaugcacagagcuagaugcuaagaagagcccugacaauacuacaaaccaguaucuaugagagauuucuauacguaaguuaccucaagcuacaagugaaagcaaagacaggauuguuaauagucuguccaaauauugaaggaaaauuccaguuuaguuaauuuacaaaagcuggacgaauccugcccuccuuuuauaccucgcugucauaaugaacugaacauaaaugaaaggaacagaacuucaaagaccacacauaacuucacaaaagaaaaauagcuugggaauaaauaaaaaaaaagcuuaaaaccacuuaaguagcauuaaaaaaucuggaggcagaaaagaaucuaauguccacaguuauaauauaaauaauugaaaauauagagcuuuaaacaaagaaaauauggacuauacagagaaacaauaacaaaguuccuucccacagaaagccgaaagaaguauagacacacuguacuuaacuugacaaaaaaauaauuuuuaauuaggcuaggaauguuucagcuggaaaagggucuugauacuuaagcccugugaccuaaguuugagcuccgaucccauauaaagguauaaggaaagaacuacauaaaaucagccccuaaccuagaaaugggcaccauggcauguacaguaaucucauugauaauaaaauaaaauuagucuaaguuaugcugaaagauaaaaagaaaaugauaaagaacuaaagaaaacaaagaauaugaagaaugagauaaaauuagaaaauggaauuaaacaaauucuagaacugaaaaguauuaacaaaugaaaaaauccauuagaggguuucaucagcagaucugaaugauauaagaaucaguggacuuaaggaucaagucugagcaccagggggggaaaaugagcauuucaagaauucuaugguaaacuaccaaguaugcuaauaucuuuguuggaaaucccaaaaaguaggugaaagaaggagcaggaagaagaauugaccuaguggcuaugccuccccaaauuugauuaaagacaaaaauuacuauguacaggaacauaagcaaaaggacccagaaaugauaacugagucacagaaaaauacacuaucaauuauugaaaggcagaacagacguuaaaaagaaaaaaaaagacuuugcuugucauguagugauucucaauacaauuaauguguuuguuaucagcaaguauagagucgacugagaauggaauagcauuuuuaaguacugagaggaaaaaagucugucaaccaacaauuuuauauacagcaaaauuauucaaacauggagaaauaaugagcuuaagagcuucucaaaugaauaaaagcugggaagcucauacuauauuggcucuacaaaaacuauuagagaaaguaauacaguuucaaauaagaaaggacuagaaaguaacuggaaaccacauagagaugcccagaccuugaggaccagguagcuauguaaaacauaaaagccaguauuauauauaauaucuaaguuuuuaauguuuauuauuuuugugauaaaagaacaugauauauacaucuggcauauauaucauaugucuuuggauauauucaugcaauagauauaaaauuugaaaccauguagaauugaaggagauagagcuguauaggaucuugaauuaauuuguaaaaguuggaagaauccugcccuccuuuuuaccugcuauaaugaacuaaaccuuaaugaaccaaaucuaaaugaaaggaacaauauugaaacuauguuggcauaaacucaaucuagaauuuuguaaaguuaaguguaauuaauucucauaaaaauuauucagaaaacaucuggaaaaguauaaaucucaacauguaaacagcuuagaaauuacaguaucucaacaaguaaaauggugaguugacugaaaagucgauuccauuucuguaucagaaaugaaaagaguaaaacaaugccuucaaaaugaggggggggggagaggugaugggagauugaaggagagagacagguagacauggagaaucagaacauauuacaguagacauugcuggaaucagcuuggcuagaaaaaccuaauuugugauuuaacugcuggaguuuagauguagauagauguaagaacuaaaaagucaaaggcacuaaguuuugggaagagccuuaacguuuucaugaaguacuucauccaggaguuugaucagauucucaaugcgaguaguagagaaaaauucccuugaaacuuucaauauugggagggaggaaagccauucugaaaacaaacaauaguguuuuucgucaaggguuuaccuucagggaaaguuaguuuacuaggucuuagccagcuaggauuuaucacaagcuaacugaacugaccuaaagcaauucaaauuaacucuagauuucuuguggaguagaaauaaccaaacaccagaccaguucacuuuagccauccuauaccacccaagaaaaaauauugaagaaugguugugacauucagucaagaggcucaguaaaagugagaccuaaacacagaacuauagaauguuucuuauauacgaaaccuuucuguauuguuaauaaugcccauucaauagaaguuccuuuugucugauacaucauaucugcuguccaccuauugaaaaaaaauacaaggauucuaaaagacauuaacuuuuuaaaacauagcagacauuucagauauguugaaauuaucggagauauuugaacuauaaaacuaaggacaacauccaaggacaauagcaaggaaggaaccaaacucauagggaaaacacaaaaagggcugggaaccagcaauagcaauguaugaaaaauacccucuguagacucauuugauugcacacagaugagaaaaaaaaucagaguaucuuuuuguacaaacaacaaaaacuaaaagacaaaaaugaacaaaacagugagaauuuggcugaguugguuaaguguuugucuuauauacguaggaccugaguuuggcucccaaguaaaaaaguuaucuaguuaucuccauuccuggggcagcauuagaagacaugucaaucccuaagaauacuagaaauagucauauagaagccaaaaacaaaacaaaaauaaaaaacaaauagaaaccauuugaaacaacaggaacuaaaaauuuccccuaaauuauuaucauacauuaaacaguucaggaagcugaaagaauaccaaacaggauuaauaacaaaacuugcaucuaaacauaucauuaucuacagaaaaucaaauauuuaaaaagcccuacaggaacaccuacuauaaaauagcaauaguacaaaccacauccaaucuguccucagaagcaagaagagcgaaauaacagaacaaaacaaaucgcuauauaucauucugcacucugcaauugucuuaagauuggccaguuagguaagauuuuguucaaaacaucuaaaaauguguuuaauuauguuuauguauacuuaauugaaaugaaugguaccagugauuuauagaggaguuaaugguuacuuuaggucauacaauguaugaauugguaugguaugauuugaaagagggcuuagcuuaguugaaaauguauacaagauccagagaaaucaccccaaaauaaugcuaguaaacaaacuuuuccaaaaacaguauugcaaauauauagcaaaacaaguuuguaguuacagguuguaucuuagcagccuccuggguccauuguaccagaaucccacauauaaaucucauguuuacaguagauuucagauugggaaaucuguuuugcauagucauuguuauuuaauaaguaucuucaccccauuuuguggcaaugcuaguagaggaaagugaauugcuacugagcuauaucucaagacacuaccauaccuuucuaauugcacaagcucuaaugccaucacaccuaaaagaagcucugaauuaaauacaauauaguucuuaacucguagguauuaccuaagagacuuaaagugauuuuugagcaggcuaaaaccaaccagccaccacuaccacaacaaaagauaucugcuaacaagccaucagauaggauauaucuaguaguauuccuguuguugccauugauagaaaaacauaucucucccagaacaugagaaauaugagaaacaaauuaggguaggauaaggaagggagaguugcuauauuuucuucuuguuugggagagauagcuauuugucaaaagaaaccaacauaauacuagauagaaacauaccucuccggaauuauaaucuugguaaagagaaaauuggaauaggaagguguguugacuuucugcagcacaacucuguuuaggggaaaugucuguuugucuuaccuggcuucuuguaaaaguaugguagauaauauggcccaugauaaucucauuucaaaguuccuaucaaaguaagaucugcuuauucucuauaacccuguggaugaagccauuucagauaaagaugagcaaaggguuacuaugcuuugaagagaaauuacaguauucaaagagaucuuuaagcccagacauuggauuuacuagacacauacuuaaagcaauuauuuuaaagaguuaaauauauugguaaucauaauaaaaauauaagcuacagacuaggacaaaacauuuaaaaaauauauaaggagcuucccaaaacuuaaaagggcugggaauguagccucacgacaauaggguacuugucuaacaugaacaaaacuuaaaauucuauccucauaaauugaaaaaaauauguguaugacugaauuuugcuuucugauuugaaaaacacccaaacaauaugaaguuaaugaauggcaacuuuaccaauaugcaucaguuuugcaggagaaacaccuccauuuagcauagauguuaaagacccacaucuuaaauccaaucucuagaagcacaauguugaugaaagaaagccaggcuuccaaagaacaucaucccaugccugagucaguuuaguaaaaucuacaaaacuggccaaugcaaaaugagcucuauugugaaggauaaaaagacaaugaagaacaagcaaugguaagauuauguuagaucaucaauuugaguacauugaugagaacuucaaaacuaucuaagaaugugcagugagggggguagguaucuuuuugccauauucucaaaugaaaaagcuuuaaaaaugaaacauuuuaguuuaaacaucuuauuucuugagggucuaaaagauucuaaaguugucaauguucacugaaacaaaaaagaugguaaucacauggaaaugucuuuuguaagagguuaauauacagggaccucuuaguuuucacaaagguaggauuuaugggcaggaugauaaacuuguuuuccugauagacuuucuuuuccagacuuaacaggcauaugaggaaaaaugguacacugaggcuauguauaagaagauaauaggcaaccuaaacagaaagcaccaugcuuggauggauuuacugauaaauucugacaaaucucaacuauuuaauggaagaauguauacuaaagguucuacagugucuuuuagaagguaggaaauauugcuuaacucauuuguugagaccaauguugcccuuauuucuguagcaaacaacacauuccaaacaagcuaaauaccaguaacucaugcuguauguguaaaacaauacacuacgcaacauuaauaugccaaauccaaaaauaccacaacugcucagugcuaugggacauuaaaaacuaagguaaguuaucacaagcauaaaauaagucacaggauuaugucaccagacagaaauauacauccgacaaaaaucuugaccaacccaugguaaaaacaacaacuuuggaacauuuagccucagguacguaaucauaagaaguaaaaagaacuuuuaugauuauaucacuggauacauaugaaucugacaaaauucuuuacuaacacaugauuaaaaaaaggacccuuggaacauuaccaaaucagguaaguaaucacaagaagaaaaaaaauguuacaugacaugauuauauuucuggauacaauaauucaucuagcaaaauucuuuacuaacucaugauguuuaaaaagccguuuggaacauuaaaaagucagguaaguaaucacaagaagcaaaaagaaguuacaugauuauauuauugaaaugcaucuggaaaaauuuuauaucaauuuuaaaaaagcccucuagauuauuaaaaccucagguaaguaaacacaagaagcaaaaagauguuacaugauuauauaacuagacaaaaaauuugacaacauucuuuaccaacucaugaucaaaacaaagagcauuaaaaucucagguaaguaauaagccaaaagaaguuacauacuuauucacuggauacaauuaccaacucauaauaaaaguaacaacaaccaacaacaacucuacacauuaaaaacucaggauaggguucacaagacccaaggggaaaaaaaaaaaggucugacaacauuauuuacuaacucaugauuaaaacaaaacaaacaggaaaacuucuggaacauuaaauacucaaguaagugaucacaagaaguaaaaauaucacuggacacaaaagugcaucugagaaaauucuuuauuaacuugugauuuaaaauaaagaaaaagaaaagaaaaccaaacaacuggggaucauuaaaaacucagguaagugaucauaagaaacaagaagcaagaaauaaguuacagaaaucugacaacauucuuuaccaauaauaccaaacaaaaaauaagcacacacaaaacccucuagaauauuaaaaacuuagguagcugaucacaagacacaugaagcaaaaaagauauuacaugaauauuucacuacacacaaaaaccugacaacauucuuuaccaacucauaauacaaaacagaaaaaaaaagcauacauaagacaucuggagcaucaaaagcucagguaaagaugacaagaagcaaaaagaaguuacaagauuauaucacuggacacaaaaaugcaucuacaaaauucccuaucaacucaagauaaaggaaagaaaagaaaaaccuaacaacucuggaccauuaaaaacucagguacaugaucacaagacacaagcaaaaaagaaauuacaugauuucacugacacaaaaaugcaucugacaaaauuccucaucaacucaagauggaagacaagaaaaacccaacaacucagaaacauuaaaaacuuagguaagugaucacaagacgcacacacacacacacacacacacacacacacacacacacacaccccacaggaaguuacaugauuauuucaguagacacagaaaccucacauuccuuaucaacucaacauaaaaaacagaaacaaagcaaacacaaaaacccucugaaacauuaaaaaccaugguaaguaaucaaaagacacacacacaaaacaacaagaaguuacaugauuauuucacuagacacagaaacaugacaacauuguuuaccaucucauaauacaaaacaaacacaaauccuuuggaauauuaaaaaaucucauguaagugaccacaagaagcuuaaagaaguuacaugauuauaucuuuggacacaugcaugcaucugaugauuuuuuaccaacucauggauuuaaaaaggggggaaaauaaaacccaacaacucuggaacauaaaaaacaaaaaguuacaugauuauuucacuagacacagaaaucugacauuuaccaacucauaauacaaaacagaagcaagggcuagaaagaugguucagugguuaagagcacugacugcucuucuagagguccugaguucaauuuccagcaaccacauaguaguuauauauccaucuauaaucugacucucuccugacgugucugaagagaacaacaguaugcugauauacauaaaauaaaucuuuuuaaaaacaagcaaaacacagaaacccucuggaaacuuaaaaaggugaucacaagacacagauaggcaaaaugaaguuacacgauuauuucacuagacacagaaaccugacauuauaaacucacaauauaggaacaaaacaaacacaaaacucuggaacauuaaaaaacucagguaaguaaucacaagaagaaaaaaaaaguuacauaauuauuacuggacacaagcaugcauccaacaaaaauuuuuaucaacucaucucaaaaaccccaagaacauuggaauauuaaaagcuuauauaagugaucacaagacccaagaagaaauaacgaaguuacaugauuacuucacuagacacagaaaucugacaacauucuuuaucaucccauaauacaaaacagaaacaaaaagaccacacaaaccccuggaacauuaaaaacugguaagugaucagaagagacaagaaccagaaaagaaauuacauguauguaauuucacuacauacagaaaccugacaacauucuuuaugaacucauaauacaaagcaaaaaaggcacacacacaaaacaucuggaauauuaaaaacucaggugagugaucacaagaagcaaaaggaaguuacaugauuauaucacuagacacaaaagugcaucugacaaaauucccuauccaaaagaaaaaaaaaucaguaaacacuauaaggacgucauuaacuuuguaaauaccauuuaccaaaaguauauaccaaacauaauugacaggaaaaaaaggggagguaaggauggugcccacucauuuuucaaaaucuuguggaaaacuccuaaguaauggaccaaaauaaagggaauauauauuuuguuuaaaaggagcaaaguuuuguuuuaaguggcauuaucuauguagauaauaugaaaggacacauauacaaauucugcaacuauuaagggaccacagcaagguuacaugacucaaaauauacaauaaucaguuacuuuccuauaugccccaaguuaacgaguggaauuugaaacaaaguacauuauugcuuuggcaucaccaaaauaaacagauaaaaauauguacaauauauuuucaauauuuaacauauugaaaaauucaauauugccagauguccaauaacccaugcugauccccacauuaaaugcaaccuuaagcaaacacaaauguuuuaucaguauuggaaaauggacucuaaggcuacuguggaggaaaaggauagaauaugaaacauaauauuaaaggauaauuuaaaauuaaccuauuuuaaugcauugcuguaaagcuuuggggauccagaaacuauauuacuuguaaaagaauagguaaguaaagaugaaaggaaaagaaaauagcauguuaaaauacaaucuaaguucacucaacuaaucuguaguaaaggaacaaaaauaagaauggagaaaaauguucuuuuuuuuuucaacaaauggugauaaaauaaugauagccacauggaaaauguaagaaucuagauacagacuuuauacccaauaaauaaaaaauaaguugagaauggaucgcagacaucaauguaaaaguagaaaauagaaaauaucuucacauaauacagaccuaaaaaaauuccaaaccuugcacuaaagaacuaagucauuuugcauuuguaguuugauauuaagaaaaaaaaaacauguuaaacuguugccaccucuauucaacauaauggugaaugguuuaacuggaucaaauggauuagcuggacacauguaacacauguaaauuggaaaggaaguaauaaacaagauuccucauaagauuguauaugguaaauucaguagugcaaaagaauaucaguacacaaguuucauuucuauacaucaaaauugauauuuaagaguaccauugacauaauuucauuugaggcagcaguauguuauccacagcuuugauggccaggcuaccucguaauuauucuugauuucauagaugauaaaucugaaaaacuauauuguuuugcccuuacuacaauaggaaccacugcauccaaccaauucuugauucuugcacuuaaauaggucuuagcucauucauaccagauuguaaauacaauggauguauaccaaaauuaaggaacacugucccaauauaaugagaaauacuaaaaacccaaagagagccgggaagauauccauuugguaaagcauuuggcaaaaugcuuuuaaagcaugaggaucugagggugagcccuggaacucaugugaaaaugucauguauauuggauguuugcagucacagugauggaauggaaggaagagaauccaaagaguuuaguaauuuggcagucuggccuauuuggucaagucgagacuaucucaauggagguggauagcauuucuaguuaagaaaguggaggcuguccucugacuuagaacacaugaauaugcacaaacaugcaccuacauauauaucuuuguauauaaaagaacaaggccauuaucaaagaaauacaagucauguuccaguaaccgacuccaaaaaaccaggcacauuaacuuagugacaauuuaaaaugaguuaagaauagccaacuaaaagagaacugggagaguacaaucugaaaaacaauacaugaacaaaugaguuucaauaaagcuauagaaagcaaagccaaauucuggaggugaagaguacagugaaaggaaaauuguaagacuggcucaaaacaagauuuuucaauuaaaacuggaaaccuugaccuugaaaagaacacuuggaccaaauggauuuaacagaucuauagaacauuuuaucucaaaacaaaagaauauauccucucagcaccucaugaaccuucuccaaaauuggccaaauaaucacacacaaaaagccuuaaagaauccaagaacacugaagugauuccaugcauucuaucagaucaccacagacuaaggcuggacugaaauaacaacaaaaacaaugaaaaucccacauacucauggaaacuggaugcucuagucaaugauaacuugguccaggaaaaaauuuaaaacuuucuagaauucaaugaaaaugaaagcauagcauacccagacuuaaugggacacaaugaaagcaguguugaggacaauagcacuaagcgccuucauaaagaaacugauccuauacuagcaacuuauagcacacuugaaagcucuaaaaugaaaagaaguaaacacauccaaagggaguaaauggcaauaaauagccaaacucaagauugaaaucaaccuauuagaaacaaacaaaauacaaaaacucaacaaaaccaagagcugguucuuugaaaaacaccaacaagguagauaaacccuuagccaaacuaucuaaagggaacagagccaguauucaguuuaacaaaaucaaaaauguaaagcgagacauugaggaaauugaaaaaaacauuagaucuuacuacaagagacuuaacaaaacuggaaaaucuagaugaaaugguuggcuuuccagacagauaccauguacuaaaguuaaaucaagaucaggcaaacuaaaacaagaacaaacaaacaaaaaccaaccaaacaaacuacaaaaaaaacagcccagcgccagaugguuuuagugcagaauucuaccaacauuaaaaaaugagcuaauacuaauacucaaacuaucccacacaauagaaacagaaggaacacuaccuaauucauucugcgaaggcacaguuacucugacaccuaaaucacacaaagacucaacaaaacuucagaccaguuuugcuuuugaauauugacacaaaaauacacaauaaaauucuugcaaauucaauccauaaacauaucaaagccaucauuuaccaggaucaaguaggcuucaucccagggcuucaggaaugguucaauauaugaaaauccauaaacaucauccaccauauacacaaacagaaaaaaaacaugauuaucucauuagaugcugaaaaggccuuugauauuaaaauucuuggagagagcaggaauucauggcacauaucuaaacauaauaagagcaauaaauagcaaacugacaaccaacaucaaauuaaauggagagaaacuugaaacaaucccacuaaaaucaggaacaagucuucccacucucucccugucuuuaauauaguacucaaaaguucuagcuagaguaguuagacaacaaaagaaucaaggggauauaaauuggaaaggaagaagucaaguuauuacuauuugcagagaacuccuacagcggauaaacaacuucagcaaaguggcuggauaugaaauuaacggaaacaaaucaguaaccuuccuuuauauaaaugauagaugggcugagaaagaaauuagggaaacaaaacccuucacaauagccacacauaauauaucuugguguaacuuuaaccaagugaaagaucugaaugacaagaaggggaacggggagugggagagaggaaccugaucuuguauugggugagggaaaaggacugaagccccaagggccagcagaaagaauguaaacaggcauccucaggaaauaggagguugggggacccccccccagaacguaccauugaccugggaggugaaagacuuccaggacucaaagugagggaccuuagaugaaaugccugacaguagauagagggaacuuauaaacuccagcaggaagacaggacaucaagugagggaugggauuuccaucccacagucacacaucugacccaaaaucguuccugucugaaagaauuacaaggauggaaauggagaggagccugaggaaaagaagguccauugacaggcccaaagagggauccagcucacggggagaucccaaggccugacacuacuacuaaggcuauagagugcucacaacaagggaucuauuaugaaugcucucugaaagacccaaaaaaacagcugaaagaagcagaugcagauaguugcacccaaccaauggaaagaagcaguugaccccuguuguugaauuagggaaggcugacagaagcugaggagaagggugauccuguaggaggaccagcagucucaaucuggaccccugagauaacccaaacauuggaccaccaaacaggacauaccaacugauaugagguccccaacacacauacaggagaauuccggaucuguguucauucagagaugaugaacuuaaaccuuaagagaguggaagccucaggaaauuggggauggauggggggggggugacaaauagaauauggaguguaaaaauuaauuaaaaauaauuuuaaaaagaacuucaagucccuaaagaacaaagaugaaaagaucuccucccaugcacauggaccuguggauuaacauaaacaucuuaccaaaaguaagcuacuguucaaugcaaugcccaucaaaguucuaauacaguucuucacagacauggaaagaguaacucucaacagaguuacucaacaucauauggaaaaacaaagacccaggauaacaaaaacaguucuuaacaguaaaagaucuuccggggaaaauaauaauuccuggccucaagcuguacaaucaagcaauugugaugaagaucacgugguauugguacagagacagaaguugcccaguggaauagaaucgaagacccagaaauaaacccacacaccuauggacacuugaucuuugauaaagagggcaucugaaaucaagaaaauagaaaagugaaaagaucuccuugaggguucguggaaugaaaucaugaucauuaaauuucccaauuguagaguuuaaauagaagagacagagaaagaaaauucauuugaguacauaaacuauugagaaccaggccaauccaaagcauucucagaggcccuaaugaaggagaaaaguaaucucuuuauuccaaacuuuaaucuauccccuauuuuuugaaaaccugauccucucucucaagguucuguuacugaagguuugccagcuaguccaugccaguaaauaaucauugaaaauucagauauaugaacaaaauggacauucagguauaugauagguucaauacaacaauguagacaacacacauuaaagauugaaagauuaauucuaucagugcauuucuuagcauauaucaaaguaugaaauucacugguuaaguauagagguaaaacaaaacaaccagccaaacaaaagacagucacaaaccucauuuuagauuuaagagcauauagacugaaaaacaaaauagaaacuagcaauacauuacacauggaaaacaggagugacaaaauuaugaagauauagucacuauauaauaauagaauccauuaauggugaggucuaacauuuguaacaauaucugucuuaaaacuuaaaacauaaaccugaaaagauuauccuuuagcauucuccacuuauaguaguggauaacucaucuguacaaagaaucacuagagaaccauuugagauauauaucaauaaauaauaaauaaucuaaguuuacaucucauggaacuauaaaggaaaaaacccuauccuacaugucaaagggauaaaaagacaggcuagugcagguauaaauuaaagacaaaaaauuaauucaccuucaaacucuuuaauaauugaagauagaauaguucuaaaccaauuaaucauucagaaaaggccaaagucaucaacaguguuccaguaaaacaaaguuucauggacuaaugucacaucuaccccuauuuuacaagagucuuuuagcuguacuacagagcaauugugauaauuaguaauuaucuuaagagauaaagaaauuuuaugauaaaaaugucauauuuagagcugaaauguuuuaauggagcacaugugugcaacgcuuacaguaaauauugaguaacugaauuauuuucuugaacuaaaguaagaaaaugauaccuauggaacggguaauauggcuaguagauaaaaggcaauugcugccaagccugaugaccuaaacugaauccuugggacugcuaugguagaaaugacuuuuuuaaguugucccuuuaugaucacaugaguguaaaggcauuugcacaugcaaaugcaugaacacaaacacaauaaauaaauaaauaauuuuuuuuaaguaaguuauucccuuuuuuaccaauuggauucaagauaauguugaaaguucuagcuagaggaauugaggauggggagugagauauauaaauaagaaaggaaaaaauaaaauguauauuugcaaaugauauaauuguacagaaaaauguuauugccuaaagaauuauuacagucuucaaaucaaaguucaauauauaaaacacacaagaaauaucuacauuucuuuauauuaacaguaaacuacccaaaaggguaauuaagaaagcucuuaagaaaauaguaccucaaaucagaaauaaacauugaauauaucaguuaguuuggacaagaguaucauaaccauuuaucaacaaaggucuguuauuugaacaaauaguuuuggggaaaauggguauuaagauuuaggaaaaugaauguagcaccuuuaaauuacaguauauaaaauuaacuuaaaagggaucaaaaauauaaauguaaguauaaauuuugaagaaaaauuacauuauauggggcauuaauuucaugaauauaacaccaaagguauagacaacaaaagacugaacuucaugauauguaggcauaaguuuaaccacagcagcaaaauuuuuguuuacuaaaaauaaauacuuaugaaaaaauugaagaugacaguaauagauguauauuuguuaccucuuuguggauccaaagacuuucagcacauucaugcagcccaaaguaaugcgcagauugaaaaugauuuuauucuaguuuuaugcuuucuuuagauaaguaaaauucuauaaacauaugaaaucacaagaaaaguugaauagcugagcauuuaugacauuaaaaauagcuggaacuaucacccaccuugauuaaccuacucacagggaaagaccaauuguaagcaaugcagauccuuauauugacacauagauggacaauuuaccuuucacacaggaauuaugaauaaacgaugagaacagaauacucaucaaaagaugguauguaaauccuggauaugaaaaugaaaaaaauugaaauugguucuauuccauaaucauauuaacccaaaguauguuaaagauuuaauucuagaugagaacuccuagaauaaacuaauuuuaacagugaucuuaacaauuacuuuuuaagauacaacaucaaaugccuagaaauaaauacaaaguugcugccuaucacagguuugguaguaugaaggggaaacaaaaauaaaaaagauaacauacauaauggaauaaaauauuuccaaacuacaucuaauguguuaacauauaaacuauaaaaauaacaaauauuucaauagcaaaugauaacaaaaauuaucuaaauaugacucagacaaaagacagaguuaaccauuuuccaacauacccauacaaaguauuaagaagaauacaagaagugcucaguaucacuaucuggggaauguaacucagaacaaucaugauaauaccucaaauauuuuaugaauuauuuuuaaaaguccaaaaaauagugaagauauggaaaaaugaaaaaucugauucuauguuugaggugaauguaaauugacauaacaagauauaaauguaauauaaaauugaauguaaauuggcauuugaaaaaaauugaagcaccuaauacugugucuuugugcucgaguagaaugacaaguuguuauggucaccagcauuugucucauacaaggaacacgcuaauguuacaguuaacuguaaaguucacuggcuuuaaaauacaccuaaauuuaacaacaaaagauugaagauauaagcugagugagacaucucauagaaagaauguaccuuaaaaucuaccaaucauaguucaaucuuuagaacacacagaaaaagagaggaacaaaucccaaaauuugucaaaugaccucuacauaugagcuauggcacacaugcacccauaguccaauauacacacaauaauaaugacaaugauaauaauaaacaaaauaaaacaauuucaauuuuaaaaugaaaaauaagucauggaugguuuaaucaauguuuagauaacuuguaauuuuuaucauaacauuauucauauuaaucaagauauaauacugugucaaaauggauacaauggauaaaauuaacagaauguuuaaucucaaaaaagaagucauuuacuuugugacaguauggaugaacuaagguuaaacugugaauuagaaagaacaaauacuucauguucucacuauauguguaaucuaaaaauguuaaacucuaaaagcugaauauaagauugguuaguaauuuagacuugggucuuaaagaaaacauugguugaaggaauuauaguuauaagaugaacaaauucagcauuguaaaccucauucucuacaaucuauauuuagaacuugaugaauauaucuuaaauacuugcagaacaccaauguaaaaucuauguggacugauacaguaguuucauuguauuaguauauuuauaaucauaaaguuucagagcgugugaauagauauugcaaauugugucucaauacaacuauuaaaaccucaaagcaucaaggggugaaaaauauucagcaauuaaauuaauuaagauggaggaggguuauauacuuaaaacuacaaauuauugcuaaagauaaauaaaaauagucaccauucauaaaguugaagguaauauauaaauacuacacaaagcauuuuaugcccucagggcauccauaaugaauauccaaaugucuacagaaauuagaaaaauccaucauaauauucacaaccuuuagauaauuacacaaaacuguuacaugaucauggucuucaaauuaagcacaaacagugcugagggacuccauuuucuaacaucaaauggucuuaccauguuaccauugagaaaagugaaugauaguaauuuaaauaauuuaaagauagacuuacagaucaauggaacauauuaaaagagagaacucagaaaugauccuugguguacaugacauuuuacaguguuggccagacuaauuuaaaaagaaaaagucaucuugacaauauauagugcugguaaaacuagacauccuuauguaaaaggguaaauguuggaucuuuacuaaaagcauauauaaaaauuaauucaaggucugucaaagaccuaaacaugaccugagaaguauagaauucauggaacuggcagugacuucuuagaugugaaacuuggggggaagaauauagaaaacucuaugaguauuuuaaauguuugaacaucaaaacacuauuucucuauaaaaacccaaccacaaagaguaaagcauuugcaaguuacauaucugauaagugauuaauaucuguuauuuacagaaaaaugcauuacuuauauaagaucaauucaaaguagguaaaagaccuugagaaguaucauaagaacaauuauaaaugacauguauacacauauacuaaugugaauaucaauuauuaaugaaauguacaucaaaacucuaaaaacaggaucacugagaucgcucaucagguaaaagugcuugcugucaauugaugcaagacugacgaucuaauuguccuugaaaccuguaugaagguggaugaagagaacugacuccauaguauuaucaucugaucugcauauauaccauaugcaaugugaaccgcccccacaucuaacuauaauuaaauauaccucacaaucacauaucauuucaugagagagagagagaaagagagcagagaagagcuucaucaagacauauuacaauaaaaaagucuaaaaagaaaagugauaagucauuuauacuauuauggacuacaguagauuucaaagaugaaauucuacaggcuaugaggugaugaaguaagauauuccaaguucagaagcaaagcaaauuccaaccauuaaguucaagggcauuguuagaaaugaaggagaaauaaugcccauuuaaaacaagcaaaaucugagggaaucccuaagcaauagaccagcaagcauuauaaaaccacaaaaaugagagacaagaaaaguacucaacuaaaagacagcaaaaucaugaagacaucaguuauccauaauaaccuuugauauauauaagauacuucaaauucuguagccaugguagcacacaccuuuaaccguagcacucagcaggcagaagcagauagaucucuaugaauuugaguucagucucgucuacauaacaaguuuuaggacagcaaggacuacuuggagcaaccuugccuacaaugugugauaucuacaaaaaauaugagaugguacuauagacaaauggucaagaugauuauuucaaaacuauauuugcucauuauuggagcauauaguuuuauaaaacaacaucagacagaagcauaugugagaguugucaucaucauacugugucaaugcguuauccagacucucccuuucaaaaaaggcaaaaaucaaugaaaucagacucccuuaaagaaauacagaagaacaaagguaaacaucuagaagcccugaaagagguaacacaaaacaauccaggaucuaaaaauggaaguagaaacaaagaagaaaucacaaagggagacaacccuggagauucaaaaccuaggaaagugaucagauggugaaaggcaaauacaagaaucuuaccaacagaaaccaagacuacuuggcaucaucagaaccuaguacucccacaucagugaguccuggauaccccaacacacccaaaaagcaagauuuggauuuaaaaucauaucucaugaugcugguagaggauuuuuagaaaggacauuaauaacucccuuaaagaaauacaggagaacacagcuagacagguaaaaguccuuaagaggaaacacaaaaaucccuuaaagauuacaagaaaacacaaccaaacaggugaauugaacagaaccacccaggaucuaaaaauggaaguagaaacaauaaggaaucacaaagggagacaacacaguagauagaaauccuaggaaaaaucaggagucauaaaugcaagcauaacuaacagaauacaagagaugaaagaaaaucucagauacagaagauuccauagaaaacaugggcacaacaaucaaaaugaaaaauggaaaaagauccuaacucaaaacauccaggaaauccaggucacaaugagaagaccaaaccaaaagauaauagguauaggugagaaugaagauuauugacuuaaagggccagcaaauaucuucaacaaaauuauagaagaaaacuucccaaaccuaaagaaagugaugcccaugaacauacaagaagcuuacagaacuccaaauagcuuggaccagaaaagaaauucugccugacacauaauaaucaaaacaccuaaugcacaaaacaaagaauauuaaaagcauucagggaaaaagaucaaguaacauauaaagggagcccuauuagaauuacaccagauuucucaccauagacuaugaaaggcagaagauauuggacagauguuauagagauacuaagagaacacaaaugccagcccaggcuacuauacccagcaaaacucucaauuaccaucgaugaagaaacaaaguauuccauggaaaaaccaaauucacacaauaucuuuacauaaauauagcacuuuaaagaauaauaaagggaaaacuccaacucaaggagggaaacuauacccuagaaaaagcaagaaaguaauccuucaacaaaccuaaaagaagauagccauacgaacagaaucccaacucuaacaacaaaaauaacaggaagaaacaauuacuuuucuuuaauaucuuuuaguaucaauggauucaauuaccccaauaaaaagacauugacuaacagacugacuacauaaacuggacccaacauuuugcugcuuacaggaaacccaccucagggacaaugaaacuaccucaaaguaaaaggcuggaaaacaauuuuccaagcaaauggucccaacaaacaagcugaaguagcgauucuaauauugaaucgauuuucaaccuaaagcuauaaaaaagacaaggaggggcacuucauauucaucacaggaaaaaaaucucaauucugaacaucuaugcuccaaaugcaagggcaucuacauuaauuaaagaaauuuuaguaaagcucaaagcacauauuacaccucaaauaaguaauagucugugacuugaacacccuacccucaucaaugaacagaucauggaaacacaaacuaaacagagacagagugaaacuaacagaaguuaugaaacaaauggauuuaacagauauauagaacauuucaucauaaaacaaaaggauauaccuucuuauuagcacuucauggcaccuucucuaaaacugaccauaucaucagacacaaaaauauugaaauaauuccaugcauccuaucagauaaccauggauuaaggcugcucuucaauaacaacauaaauaauagaaagccaacauacauguggaaucugaacaacacucuacucaaugauaacuuggucaaggaugaaauaaagaaagaaauuaaagacuuuuaaugaaaaugaagccacaacauacccaaacuuaugggacacaaugaaagcaguccuaagaggagaagucauagcucugcucugcgugccuccaaaaagauacuggagagagcauacacuagcagcuugacagcacaccuaaaaucucuagaacacaaaagggcgcaaauucacccaagaaaaguaaauggcaggaaauaaugaaacucagggcuaaaauaaacuaaguggaaacgcaaauaacuauacagagaaucaaccaaaccaggagcuguuccuuucagaaaaucaacaagauagauaaaccagacuaacuaggggacacagggacaguauccaaaugaacaaauucagaaaugaaaagggagacauaacagaaucugaggaaauaaaaaagaucaccagauccuacuaaaaaagccuauacgcaacaaaacuggaaaaccuggaguugggcaugguggcacaugccuuuaaucccagcauuugggaggcagaggcauguggauuucugauuucaaggccagccucuucuacacagugaguuccaggacagccagggcuauacagaaaaacccuguccaaaaaaaaaaaaaaaaaccuggaaaaccugaaauggacaauuuucuagaaagauuacagguaccaaacuugaaucaggaucagauuaaugaucuaaacagucccauauccccuaaagaaauacagacagucauuuauagucucccaaccaaaaaaaaaaaaaaaaaaaaaaaaaaaaaaaaaaaaaaaaagcccaggaucagaugaguuuaguucagagugcuauaagaccuucaaagaagaccuaauuccaauucuccucaagcuuuuccacaaaauagaaacagaagguacucuacccaauuuguucuaugaagcuacaauugcucugauaccuaaaucacacaaagaaccaacaaagaaagagaacuucagaccaacuucccuuauauauuuugauguaaaaauacucaauaagauucucacaaacagaauccaagaacacaucaaaaugaucauccaucacaaucaaguaggcuucaucccagggaugcagggaugguuuaauauacagaaaucuauccauguaaugcacuauauaaacaaacucaaagacaaaaaccacaugaucaccucauuagaugcugagaaagcauuugacaaaauccaacaccccuucaugauaagauucuuggaaagaucaagaauucaaggcccauaccuaaacauaauaaaagcaauauacagcaaaccagaagucaacaucaaacuaacuggagaaaaacacaaagcaauuccacuaaaaucaaggaguagagaaggcugccccacugucucccuaccuuuucaauauaguacuugaaguccuagacagagcaauuagacaacaaaaggagaucaaggggauacaaauuggaagguagaagucaaaauaucacuauuugcagaugauaugaaaguauuuaugugugugugugugaguauauauauaaaaaaaauuuuuaccagagaacuaaaccugauuaacaacuucagugaaguagcuggauauaaaauuaacucaaacaaaucuuucucuacacaaaggauaaaugggcugagaaagaaauuagggaagcaacacccuucacaauagucacaaauaauauaaaauaccuuggugugacuuuaaggaagugaaaguuuugcaugacaagaacuucaggacacagcuucugggacaggcccugauuugagcugcagacaucgggcaccuucccugccagaggagaggugaccacccaagaggccucugaccaccagagcaggugagggagccauccuguguccgggucccucugagaccagucugcgcagaucuucucacggaaugcauagggugagcaacaggauuguagaagcgacacagcuucugggacaggcagaagugacauggcuucugggacagaccccguuucaggcuccagacaucugggcaccuuccccaccagaagagaggugaccaccugggagggcucugacugcuggagcaggugagggagccaucuuguguccugggucccuuggagaccagucugugcaggugaguacacagacuacagaagcaacacaucuucugggacaggcccuuuugggggccuucaucuucagacagaagguaguucugaaugccagaccucugugcaccuucucugcaagaggagagcuugccugcagagaguacucugaccacugauacucaggagagagcuggacugcugacagaggcuaacagaauuacaagaggaacaggcuccagccagagacaacuauaacaacaccagagauuaccagauguugaaaggcaaacguaagaaucuuaccaacagaaaccaugaccauucaccaucaucagaacccagcacucccaccucagccaguccuggauaucccaacacacaugaacagaaagcaagauucagauuaaaagucauaucucaugaugcuaguagaggaccuuaagaagggcauuaauaacucaaagaaauacaggagaacccugcuaaacagguagaaguccuuaaagaauuacaggaaaacacugcuaaacagguagaaguccuuaaagaggaaaccaaaaaaaucccuuaaagaauuacaggaaaacacaaccaaacaggugauagaauugaacaaaaccauccaagaccuaaaaacggaaguagaaacaauaaagaaaacccaaagugggacgacucuggagguagaaacccuaggaaagaaaucaggaaccaaacaugugagcaucagcaacagaauacaagagauggaagagagaaucucaggugcagaagauuccauagagaacaugggcacaacaaucaaagaaaaugcgaaaagauucuaacucaaaacauccaggaauuccaggauacaaugaguagacaaaaccuagggauaauaggaguagaggagaaugaagauuuucaacuuaaagggucagcaaauaucuucaacaaaauuauagaagaaaacuucccaaaccuaaaguaagagaugcccaugaacauacaagaacccuacaaaacuccaaauagacuggaccagaaaagaaauuccucccaacacauaauaaucagaacaacaaaugcacuaaauauagaauauuaaaaguaguaagggaaaaaggucaagugacauauaaaggcaggccuauuagaauuacaucagacuucucaccagagacuaugaaagccagaaauccuggacagauguuauacagauccuaagaaaacacaaaugccagcccaggcugcuauacccagcaaaauucucaauuaccauagauggaaaaaccaaaauauuccaugauaagaccaaauucacacaaugucuuuccucauauccagcccuucaaaggauaauaaagggaaaacaacaacacaaguacagaaaccacacccuagaaaaagcaagaaaguaauccuucaacaaaccuaauagaagauagccacaagaacagaaucccaaguuuaacaacaaaaauaacaagaagcaacaauuacuuuucuuuaauuucucuuaacaucaauagacucaauuccccaauaaaaagacauagacuaauagacuggcuacacaaacaggacacaacauuuugcugcugacaggaaacccaccucagggacaaagacagacacuaccucagagugaaaggcuggaaaacaauuuuccaagcaaauggucagaagaaacaagcuggaguagucauuuuaauaucgaacaaaacuacuuuccaacccaaaguuaucaaaaaagacaaggaggggcacaucauacucaucaaaggcaaaaaucuaccaagaugaacucucaauucugaauaugcuccaaauacaaggacauccacauuaauuaaagaaacuuuaguaaagcccuaagcacauauugcaccucacacaauaauagugggagacguuaacaccccacuugcaccaauggacagauucugguaacagaaacuaaauagagacacauggacacuaacagaauuuaugaaacaaauggauuuaauagauaucuacagaacauuuuauccuaaaauaaaaggauauaccuucuucucagcaccacaugguaccuccuccaaaauugaucauauaaucugucacaaaacaggccuccacagguacaaaaauauuaaaauuaucccaugcauccuaucugaucaccacggacuaaggcugaucuucaauaacagcauaaauaauagaaagccaacauucacaucaaaacugaacaacauucuacucgaugauuccuugggcaaggaugaaauaaagaaauuaaagacuuuuuagaguuuaaugaaaaugaagccacaacauacccaaacuuaugggacacaaugaaaggaguccuaagagaaaacucauagcccuuggugccuccaaaaugaaacaagagagaacauacacuagcagccugacagcacaccuagaagcucuagaaauaaaggaagcaaauucacccaagaggaguagauggcaggaaauaaucaaacucagggcugaaaucaaccaaguggaaacaaaaagaacuguucaaagaaucaaccaaaccaggagcugguucuuugagaaaaucaacaagauagaaaaacccuuagcccgacuaacuagaggacacagggacaguauccaauuaacaaaaucagaaaggaaaaaggagacauaacaacagaacccgaggaaauccaaaacaucagauccuacuacaaaaagcuauacucaacaaaacuggaaaaccuggaugaaauggacaacuucguaccaaaguuaaaucaggaucagauuaacaaucuaaacagucccauuucgcuuaaagaaauagaagcagucaucaauagucucccaaccaaaaaaaaaaaaaaaaaaaaaaagcccaggaccagauggguuuagugcagaguucuaucagaccuucaaagaagacuuaauuccaacucuucucaaacuauuccacaaaauagaaacagaagguauccuaaccaauucauuccaugacgccaaaauuacucugauaccuaaaccacacaaagauccaacaaagaaagagaacuucagaccaauuucccuuaugaauaucgaugcaaaaauacucaauaaaaucuuugcaaacugaauccaagaacacaucaaaacaaucauccaucaugaucaaacaggcuucaucccagggaugcagggaugguuuaauauauagaaauccaucaacauaauccacuauauaaacaaacucaaagacacaaaccacaugaugaucuuguuaggugcugagaaaacauuugacaaaguccaacaccccuucaugauaaaagucuuggaaagaucagaaauucaaggcccauaccuaaacauaauaaaagcaauauacagcaaaccaguaaccaacaucaaacuaaauggagagaaacucgaagcaaucccacuaaaaucagggaguagacaaggcugcccacuuucucccuacccauuuaauauaguacuugaaguccuagccagagcaauuagacaacaaaaggagaucaaagggauacaaauuggaaaggaagaagucaaaauaucacuauuugcagaugauaugauaguauauauaaguuacccugaaacauccaccagagaacucuuaaaccugauaaauagcuucagugcaguagcuggauauaaaauuaacucaaacaaaucaauggccuuucucuacaaaaaggauaaacgggcugagaaagaaauuagggaaacaacacccaucacaauagucacaaauaaaauaaaauaccuuggugugacucuaacuaagggagugaaagaucuguaugauaagaacuucaaaucucugaagaaggaaauugaagaagaucucagaagauggaaagaucucucaugcucauggauuugcaggauuuauauagucaaaauggcuauccugcugaaagcaaucuacagauucaauguaauccccaucaaaauuccaacucaauucuucacugagguagaaagggcaauuugaaaauucaucuggaauaauaaaaaaccuaggauagcaaaaacuauucucaacaauaaaagaaccucugguggacucaccaugccugaccuuaagcuguacuacagagcaauugugauaaaaacugcaugguacagguacagcgacaaacagguagcucuauggaauagaauugaagacccagaaaugaauccacacaccuauggucacuugaucuuugaaaagggagcuaaaaccauccaguggaaaaaagacagcauuuucaacuaauggugcuggcacaacagaugguuaucacgucgaagaaugcgaauugauccauucuuaucuccuuguacaaagcucaagucuaaguggaucaaagaccuccacauaaaaccagagacacugaaauuuauagaggagaaaguggggaaaagccucaaagauaugggcacagggggaaaauuccuaaacagaacagcaauggcuugugcuguaagaucaagaauugacaaaugggaccucauaaaauugcaaagcuucuguaaggcaauaggcacugucaauaagacaaaaaggccaccaacagauugggaaaggauuuuuaccaauccuaaaucugauaggggacuaauauccaauauauacaaagaggucaagaagcucaacuucagaaaaacaaauaaccccauuauaaaugggguauaaagcuaaacaaagaauucucaaguaaggaauaccgaagggcugagaagcaccugaaaaaauguucaacauccuuaaucauuagucaaaugcaaaucaaaacaaccuugagauuccaccucauaccagucagaaugucuaagaucaaaaacucaggugacaguagauacuggcaaaaauguggagaaagaggaacacuccuccauugcuggugggauugcaagcuuguacaaccacucuggaagucagucuagcgguuccucagaaaauuggacauaguacuacauaaagauccagcaauaccaguccugggcauauacccagaagaugcuccaacugcuaauaaagacacauguuccauuauguucauagaagccuucuuuauaauaggcagaagcugaaaagaacccacaugucccucaacagaggaauugauacagaaaaugugguacauuuacacaguggaguacuaggcagcaauuaaaaacaaugaauuuaugaaauucuuaggcaaguggauggaucuggaggauaucauccugagugagguaacccagucacaaaaguacacacaugauaugcgcucacugauaagugguuauuugcccagaaacucaguauacccaagauacaauuugcaaagcacaugaaagucaagaagaaggaagaccaaaguguggauacuucgauccuucuuagaagggggaacaaaauaccucuggaaggaguuacagagacaaaguucugagcagagacugaaggaaggaccauccagagacugccccaccuggggauccaucccauaaacaccuaccaaauccagacacuauuguggaugucaacaagauuuugcugacaggagccugauauaucugucuucugugaggcucugccagugccuggcaaauacagaagagaaugcucacagucauccauuggacagaacaccggguccccaaugacggaacuagagaaagcacccaaggagcugaaggggucugcaacccuaaagauggaacaacaauaugaacuaaccaguacacccagagcucccugggacuaaaccaccaaucaaagaaaacacauggugggacuccugucucuagcugcauauguagcagaggauggacuaguugaccaucaaugagaggagaggcccuugguguugugaagguucuaugccacaguauaggggaaugccagggccaggaaggaggaguggguggguuggggagcagggagaguggggggauagggaauuuucagagaggaaacuaggaaaggggauacauuugaaauguaaauaaagacaauaucuaauaaaaagaaugauaucauagaaaagaaauaaauuaaauuaaucaaaaucuuaaaaaaaaagagagugaugauucccaacuuaaagggccaauauauaucuucaacaaaauuauagaagaaaacuuuccuaauguaaagaacgagauguucauaaacauaaaagaagccuacagaacuccaaauagcuugggccagaaaagaaauuccuucugacacauaauagucaaaacaccaaaugcacaaaacaaagaaagaauauuaaaagcagucagggaaaauguucaaguaacauauaaaggcagaccuaucagaauuacaccagacuucucaucagagacuaugaaagcuagaagauccugggcagauguuauacagacccuaaaagaucacaaaugccagccugggcuacuauacccaacaaaacucucaauuaccauauauggagaaaacaagauauuccacuacaaaaccaaauuuacaaaauuuauuuccacaaauccaggucuacaaaguauaauagauggaaaacuccaacacaaggagggaaacuacacccuagaaaagcaaguaaguaauccucuuucaacaaacccaauagaagauauccacacaaacauaaaaauaauaucaaaagcaacagcaagcaacaaucacuauucuuuaauaucuuuuaacaucaauggacucaauuccccaauaaaaagacauagauuaacagacugguuacauaaacaggacacagcauuuugaugcauacaagaaaugcaccucaaugucaaagacagucauuaccucagaguaaagggcuggaaagugauuuuccaugcaaauggucccaagaaacaagcuggaguagccauccuaauauagaauaaagucaacuuucaaccaaaaguuaucaaaaaggauaaggaaggauacuucauacucaucaaagaaaaaucuaccaagaagaacuuuaaauucugaacaucuaugcuccaaaugcaagaacacccacauucaaaaagaaacuuuacuaaagcucaaagcacacauuguaccucacacaauaauagugggauauuucaacacccuacucucaucaauggauagaucauggaaacacaaacuaaaaagggacagagugaaacuaacagaagcuaugaaacagauguauuuaacagauaucuauugaacauuucaucauaaaacaagaggauauaccuuuuucucagcaccacauggcaccuucuccaaaacugaccauauaauuggucacaaaaaaaggccucaacagauacaaaaauauugaaauaaucccaugcuuccuaucagaucaccacagacuaaggcuggucuucaauagcaacaaaaacagaaagcccacauacacguggaagcugaccaacacccuacucaaugauaacuuggccaaggaagaaauaaagaaauuaaagaauuuuuagaacuuaaugaaaaugaagccacaacauacccagacuuuugggacacaaugaaggcaguccuaagaggaaaacucauagcucugggugccuccaaaaagaaaccagagaaagcauacacuagcagcuuaacaacacaccugaaagcucuagaacaaaaagaagcaaauacacccaagagaaguagauagcaggaaauaaugaaacucaaccaaauaaaaacaaaaagaucuauacaaauaaugaacaaaccaugagcgguucuuugcgaaaaucaagauaaacccuuagccagacuaaccagaggauacggagauaguauccaaauuaacaaaaucagaaaugaaaagggagacauaaccacagaaaccgaggaaauucaaaaaaucaucagauccuaccacaaauccuauacucaacaaaacuggaaaaccuugaugaaauggacaauuuucuagacagauaccagguaccaauguuaacucaggaucagauaaaccgucuauacagucuaauuguaauuggugguaauguugcauaacuaaagaucacaaaauaauggguaaagauuccaucuagaaaucacauacacauaaauuagacauuaauugaaaggaauacuauacaaugaauaguguaccaacgaaggagaacuaucugugaaugggugauauauuucuuuuuaaauaaauaacuugaaaugauaagaugauuacauguauuuggaagagccacacauaaacucuaaaccagaaaacuuacauuuuguuacuuacaagaguuggggcuuaugaauauagaagggauaugggaggaaaaggcuucucucaguagauuauuuugugucuuuuuuuguuuguuuguuuuuuguuuuuuguuuuuuguuuuuuuguuuuuuuuuuuuuugagacaggguuccucuguggcucuggcuguucuggaacucacuuuguagaccaggcuggccccaaacucagaaaucugccugccucugccucccgagugcugggauuaaaggcguauaccaccacaccuggcaugugucauuuuugacuuuuggaaauauauugauauuuucaauauuuuaauaacaaacaugugggcaguuucaaaaaaacagugggauaagaaacacaggcuaaagucucaguaggguagccauaguucuagguacuggggaaaagauuuguaagaaugauaccuuaggaguucaagagcagucuggauaauggcaaaccuccaucucucuaaaccacuggcucucaaauuugaugucauguccccuuucacaaaggucacauaucagauacccugcauaucagauauuuacauuaugauucauaauaguaacaaaauuacaguuaugaaguagcaacaaaaauaauuuuuaugacuggggagcaccacaacaugaacaucuauauuaaaggggcacagcauuaggaaugcugagaaucaccacucuauaugaacaacuagcaaauucucauuuuucuaaagaaacaagcaaauacaguguuuaaauuuuuuaccauuguaaaucugaacaagacugucaaaaacagugauuucagaaauauaaauuaaagucacauaacaaacugaagaaaaacauuaggguuguggagcagaaacagaguacuuauuucaguugugaggacccuauuuaaucacaauuauuuuuaaaaaaaacuacaaaaguaaaaucugauaaaucuccauagaaauugcaaggucuguggaaauuuaaccuaagguugccuuucccauacccagaugaguacaauagccuugaagacuagcaucuuuucuuccaaugaagaagccuaaccugauuugaacucuauugccagucucauucuuuaugucaaaaaauaguguccucaaggcauuuacugguuaaagccacuguuauagcaaucugaugcucuagcacugguuguugcacauaaauacacacacacaaaaagauaguaaauucuuagagauaagauggucuguacucucaaaaaaagaccagaaguacucuccuuaucuacacugcugauugugagacacuauacagacaagaugguaaaacaaaggacaguuguaaagaguccaaauguugaauggaaauccuaaggcaaagcccuuucaggaaaauuuaccagcuugagauacuuaaaacaaggccucugacuaaugguggcuuaagcugaucaauuaaagcaugcuuuaaaaacaaagacagucauuuucuaaagagcaaacuugaagauaaaucagauacacacauugccgggaaaugcaaacacuauagaagcaaaauuggcacaggcauggcagaaacaagcaauugcccacguagaugggaaaaaauucaaauguaguguuccuaaaaaucaacacaucauccuaaguggagaggggggcuagagagauuaaagauuuguaaauaguaaugaucacugagagaaccuaaauacuaguuuuaguaggucaagauuucaaaguauaaauauucucacacuaaaauaagccuuguuuuaaagaauaaaaguaaaacauugugacaauaacucaucagaugaaauguuaauaaagagauauauuauaaaguugucaguacaaauuacaauaacuuaaaugaaaaccuuacuuguagagccagauugcaagauaagcugggagcagagaaaaagaaucagugaauuuaaauauagauauauaaagauuauucaguuuaaaggacagaaaaaaaagaguaaggaagaacaaugaacagaaccucagagaucuguuagcuaccacaagaguagguguuaccacgaauuuauauguaaauugcaccaugcaauccucugcuccauugaaacagauauggugguagaugcugauaaccucaguauucaagugguggaaauaagaagguuuagaagcucaaggucauuuucagcugcacagugaguaguuuagaccacccugggcuacaggagacccugucuauaaacaaacaaaacaaauaccagugccugacauuguacuuaaugguggaagaugaaaugcuuucccuucaaaucaagaauaaguuaacucaguauaauggcauacaaauauaauuccaucuccccagaggagggagaagaagaagaaagauaaguuagaugucaucuugggcuauauaguugucucaaaaaauaaacccagccacccacaauugagucaaggggaccuguuuuaucacuuuuauuaaauauuguguagaaguucugaucaguuauacaaggaaaagaaacaagucuggaaaaaaguaaaauuaaauuucuauauuuaaccaaaaucccaagauuguaaaauauaaagcucaaucauauuucuauguaccaugagggacuaaugaaaugaagaaaacaauucauuuuauaauguaaaaaugaauaaaucacagguaugaauguacuuaaugccacaaaaauacauuuaaaauuauuaacuuauaaauuauguucuuuuuuuuuuuacaaaacuaaaaggaacaaaauuaaucgaucuauuuuuuaaaguauacaaacuauacucuaugaaugacaggauaccacugaaagucuagaucuaaauaaauugauauauagcuuguguuuaugaacuggaaaacuugaaguuaagauacauauguucuucaagaugauguagagaccugauccuuaccaaaauaucaggugucuuuucuagaaaauaacaagcaauguuuaaaauuauguaagacccaaaugaccuacaauaguuaaagcaaucucccaaaucagucaaguuaaaggguucauacuuuucaauauauagauuuacuauaaaauaacaaggcacuauguaagcaucacaucaaacagacauacauaagaggggauagaauuaauagucuauuaaauaguuuauuaaauacagaaccagauagcuaugguaaauggacuuuuaauaaaggugccacagaaauaaaugagggaaugaacaguguuuuggauggauuuuucuucaacagcauguuauauauguaagggaaauaaaguugaaugguucccugccacuauauguaaaagcuuaaaaucaaucaaagacuuaaaaauagcaauuaaaucuugcagaauucuuacaaaaaaacauagagucaaaucuuuguaaccaaauguuugacgaaagguguuuuguuuugcuauuuuuuuuauauaaaccgaaaguaaaauaaagagcugauucacuggacuuuauuaaaaauuuuuaaaaauuuaugcuuggggguauacuacaaagaaaguggaagcuguagagauggcucagcgguuaagaauauuggcugcucuuccagaggaccaugguugaauuacuaacaccuauauggcagcuaaaauaacuucaguuccaggggacccaauaaccuuacaaagauauauaugcaagcaaaacauuaauacacauaaaaaggaauuaucaaaaaauuuaaagaaaguaagauggcaauacauaggugugagaaaauacucaaaaauuguuuguugauagaauauuuguagcaggauaaauaugauauauaucaauauacacacauauauacacacauaauucaauauauacaacacucagaacucguugcaauucacacacacacacacacacacacacacacacaaucccaauuuaaaaaaugaagaaucuauggccugugaaccuuuaaucuuagcacuucagaggcagacaagaagaucucuaugaauuaaaaaauagcuccaguaaagaccaugucaauagaaugagauagauagcuauagagggggcaaaaaacugagaaaucauauacuugacuuaggcucuguauucagaacacaagaagaacuucuuaaaacuuaacauaaaaggaaguucaguugaaaaauuaguaaacaauuuaaauaaacaguucacugaauggaagaauguggaaaaaaugauucauuauuauuauccauuggcaaaauacaaauuuaaaccacaauaaaacauuacugugccaggcaugguagcauaugccuuuaaucccagcacucuccuacacaaagaaacccucucucaaaaaaccaaaaaagaaaauuuacugcauguuuaccagaauugguaaaaugaaaaauacugucaauauuaaaugaucuauaguaauuccaaauuaggaauaacuuagaugucuguggaugagugagugguuaaaaaugugguuuauacauaccaugaaauucuacccagcaacaagucugaauuaacuacugauauauaaaacaacuuggaugaacaucuagagaauuaugguaaauucuaaaaauggucaaauuucaaaagauguguuugauucuauuuauauagcaaucucaaaaaagcagaucuauagaaucaagaacagauuagugauuacugggaauuaagggaugguaggagggaagacgguguggcuauaaaaggacaaacagggaucuuugugguaacaaauaauauucuguaucauugaaccaguguuuccauccuccuuaaauugcacuacaguuuuguuacuacugggaaaacuauauaugaguuuuucaaacuauagaugaucucuuugcauuauuuauuacaaaugaaugugaauuucuaaaauuagauuaaaagcuugaauuuuagaaguaugcaaaaggaaaccaguaagaaagugggcaaaggggcuuucugcugagcuuaaugacuugaguuugauccccaagacucauauuguagagggagaaaagaaacucccacaaguuuuccuccauucuccaugcauguauugugguaugagugugccaucuccuucccauaucugugaaaaaauacaacugugcaaaggaucuaaauacauauaccaguaaagaagacauguaacugaccaauaaacacauacaaaaauauucaauaccauuuauaaagcacaucaggacugaaaucagauaacaaaauacuagguagacuuuuuuuucucagcacuuuuuggauggaguauuauagauggaaaaucauuuuugcagcuaccauaauaaagacuaguuccagaaagcaucuuaaucaggacagaccaagguauuuuaaaaugcuuauaguauacccacagcaaguucaucugccucaagguaaauaauagugacuacacaguggaaaaacagacagugccuuaauggagugaucaaaccaucaccaucauugaauauauauauauauacacacacacauacacacacaucaugggaaaugguauccuaagaaggacauuauauuguuucuggaauauuccagaugggaauccacaaucuguaucuaauuauaaagaaauaucaaagaaaucccucaaaaagugacuuugauguaaaaagaaaaaagacuaagagauacuagaaauacccagguucacaguaacuaaauaugcacaaccaagggcaacauagaacauggacugggccuugcacuuggggacagcugcaccaaaggacuuuguuguguucacugacaagaguagaauauaggcuuuggguuauuucagugacuguauggauguuuaauugccaaaguugaugucuguuauaucacuuucaaagggaggaaaugugauguugucauccuccuuaaacuguaguacaguuaggaaauaaauuguuaggaaauacacagcaaaaugucuaggggugaggggcuguaaagugugcaauucccuuucaaguuuugcaaaggaacacaguguacaaauacacauauaaaaauauugaaaugaaaaagcaagugaggcuggaaugguaauaaguguaccucaaaucuuaaugaaggauaugaagaugucuuauauaucguucaugcaguuuuucuguaguucauuauuacuuccaaauaaaacaguuuuguuauguuuuaaagaaacaucuaugagauagcacaauauuccagugauuuuugacucaggcuaauuuugcccuaacucggggaggggguagauuugauaauauguagagaguugugguuacuuuauuuuauuuuugguugucacaacugaaggaaugcuguguuagcauccuggcagaagccaggggcucugcuaaacauccuaaaguacauggggcacucuucguugacaaagaauuaucuccugccaaaugucaaugguuccgcaguagaguaucccugccccacuuggcuaacaagauggaaaauuucucugccaauaauggcuggcagggaugucaggaaaggggaacccugccuguggaaaugcgaggucagacagcacuugaggaaagcaaccuggcaacauacaugcaauuuaacaaugcauccaucccuguguaaggggcugaacuccguccccaucaauuuucuaaguugaggcccucauuuccaauauuucagaauuuuaacaggagaucagaccuuuaaacagacaguuaaauugaguccaauuuuacuggugugccuauaaagaaggggaaauugggauacagaaagagucccaaaguguggcuauauagacagaagacacagggauauauuggccaucugggaguuaaggagagagguuuuaagagagaagcaaccugcuggcacuccaaucugagucuugugggcuccugcuuuuugagaagccucucaauucagcauuuguuuuugacaacccuggcaaaugaaguuugugaauucacugcauagaaauaaaagccuuuauacugggaagugauuuuaagaaaaacuuuuagaaaacuagcuuaaaccuaaagcaaaauauauuucaagcaacgaagaauaucacgguauaggcauacaagggagaaugaaggagagacucuaagauuuaaauagaagugagagaugaacagaauuguuccugaagcucagaggaagcuguaguaguaugauuguaagaaaagcaaggggcagaaaagcaugcaugcugugccuuccauguguuucaaagacaacaauaaggccucuucaugagagguaugguuuauuucacuguguauuauauggacaucaggaaaacauuagagaauaaaaucauuguuaaucaauguaggcaacagagaagaaacaugcagaaaaagauuguauauauacaauauagucagcuguaaaucuaagagcauaaguaagugauauaauuuuuaagaaaaaauaccccucuccccccucccccccccaagauuuguggcaugaggaauaaaauagaagguuauggagcacagaguugucugauaggagagauuaaggcuggcauuguugcagcuugggguuaaaucugaggagacagacaccagcguuuucacuguaugcaggguagaaaccgacauccucauauuuguucacugcaguaauucuugccguagacagauagacuuuucuuaccauuguuuuaaaauuuuauuuuacuuacuuuauuuuuuguguguacaugugugugcacacaugcauauguguauggacagugugugugugugugugugugugugugugugugugugugugugcguguauguguguguguaugccagagaacaacuuccaguaaccauuuuucuccucauagcauauggaugcagggaauugguuucaggucaucagucuuggcagaaaguaccuuuacuuagugagcuggccccacaguuggaagcuugauuucauugauguguaauagaggcauaaaaaguagauggaucagggucacauaauaauaaauagugggaaagggucguggucucaagaagcauagcuauaaguagugcccugaacacuacgaauuugccuacauuuuuaaaaagcagagcuguaaaggaaggauuuaauuucacuauuucaguuggaaaauugcuauuucaguugggguaaaguaaauagagggaaaaagaaauccaaccaauuaaauaaauaaguaaauauauauggauggauguauaauccaucgucauguauuuuaucuguuuauacaaacaaaucugagccccucaaauagagaagguauguuuuuaacuuagguggguggaauaggucacaucccaagcuaaaaauuacaaaagcacuggucuuauuuucagacuuugaugcugcaaaggagcucuuuuaagaaaacuggagcuuucacagacugcaugcuuucacugggagccuauuaaaugggaaauaaauaacggugauaaaaauguauugcuuaaaaauuaagcaaacauuuaaaaagagcucuagauuaaagagaaaaaacaaaacacgaaaaauuaucaaaaagggaaugaaauuggucauauuucauaccaagcccuacauaucacagcuaaagcugugaucagaggaaaaauuauaacucuuaaaaugucucuugguaaagggacuuuaaauaagugaacuaaauauuacccuuaauuaaguuuuaaaagaaaauacauaaauuaaagauaauuaggaagauggaauuaauagauauuauaguccaagaugacuaagaagaaaacaaauauagacaaagguaauuuucugauaagauaauaaacauaauauuuuaauaauuaacagaauaacuaaauuucucaugaacuugacuaagaaaaaagcaagacuauaaaagcacaggcaagaaaaauuuauagaaaagagcauaaacuacugaaagaaaauuaguugcuaccaagugucaacacaguugaaaugcuucaggaaauuacauagcaaugaauaaauuaucccuuaaaacaugcacuaaacuaauuuagaauacauuaccgcagaaaagacuaaaagcaauuacgauuucguauuagguccagaugguuauacaauuuuguucuguguaaauuuaaaagauuuuacacuuauuguaugugcauguggucacaugugcaugcaggguggugguagugugugcaaaucacagcauguguguggaagccaaaagagaacuuguaggaauuggcucucuuuuuccaacauguagguaccaguuaucaaacucagguaucuugagcaggcuuggcagcagguaucuuuacucacugagccauauuuccagccacugcuuaaccuuuaaagagaccaucauucuaauguuuucaaacuguuuuggaacacaagcagacagaucuucaacugcauggcacugcauucacaaagacaugguggaaccuuuuacacacugcugagccaagagauucuguaacuuacaggaucagauaucagggcuguccuucauacugcagaaagaaagaaaaagcccauucucacaguuuuaaugacugauagauccccagcaaauaagcagaucuucauagauggauauauuagcaauuugcauuguuuugcuacuuagcaaucauagcaucaguaucuccagacaaaaacagcuuucaaauguauagaaucaauuuauagaagaguugaagauugcauacaguuuuacuuuagauagugagauugcaucacucuuuucuuccaacaucaaugacuaaggccaaguuucccuauauacucaccaacggaguauuauuggugucuuacuuaauaaucaaagaaacaaccguugcuuauauuugcacucuaucauaagugaaacagucuggcauuuuccccccuggaaucaguagcauuuccuuuuuaaaaaaucauccucucaauauaaagagcuuugaaaaauugaaugaaaauaauucacucugugucuacaauauggguggcaacuguuuccccagguuaacacuuaaauuuuauuuuugguggguuuuuuuuuugcugugcaaauuuuauauauucuauuaccagcuuugcugagguacagcuggcauauaauaaaaggcacguguuuaaauuguaggauuugguaacuuuugacauguguugaaaucgcugccacaauuaagguaaugagcauauccagugcucccaggagcuuccucuugcccuuuuggacuuccccuaccacugcuccaccccucgguaauuauugaccuuucugucacucuagguuagacuucauuuucuagagugcugugguaacagaagacgacaguaugaacucuuugucuggcuucuuucacucacuguaauuacuuggugauucauccauguuagguguaucaauaguucauuccuuuguacuucugaguaguauuccauuguauggacacagaacaacuuugccaaaaaaacucucuacucaaauguugacugcuuuuggaauguuuccaaauggagagagagagagagagagagagagagagagagagagagagagagagagagagagggaaaccauuaaacuguuuuucaguguuccugaaucauugugaccacgacauggcauacaacugguugaguucuuucauguccucaccaguaccuggugaaucuccuuaauuuuaggcaauuaguaguuaugaaguagagucuaccuuugugcacuucuccaauaacuaaugaugcugggcauugucuuacaugcuuuccuauaugucuuccuugcuaugaaguguugauuuaaacaauuuacccauuuuuguaaugugugaguuuucaguuuaaaguguccaucacauauucugaauauaaauucuuuuuuagguaucagguuguaaaauauuuucagguuugggauagugagcaauaauguuugaugugcaaacauggaaacugguguucaaauccucagcauccacgcuuaaaaaaaaaaaacuggcaugaaugcacauaacuguaauccuagaacuguggguagggugggcagagacaggcagauccugggagcuuagugaccugccagucuggcuggaacacugaacuuccaguucagugagagacugcuugaggaaaagaagguagagagccguaaaaaaaugaggcuaugccagugccuggcaaacacagaaguggaugcccacagucagcuauuggauggaacacagggcccccaauggaggagcuagagaaaguacccaaggagcuaaaggggucugcaacccuauagguggaacaacaauaugaacuaaccaguaccuucccagagcucaugucucuagcugcauauguagcagaagauggccuaguuggccaucauugggaagagaggcuccuuggucuugcaaacuuuauaugccccaguacaggggaacaccagggccaagaaaugugaguggguggguaggggagcgggggaguggguaugggggacuuucaggauagcauuugaaauguaaaugaagaaaauaccuaauaaaaauugggggaaaaaagacagcaaucauuuguccucugcaugugaguucaugggcaugcacaauuccacgugcacaugcaaugcacgcaaaaccagaaugcuuucuuucaauaucugucuuuuucauugugucuuucaaaaagcaugcuugagaagccuggcuaaccaauuuguuccuaauacucacaugcuuuugaugcugugucaaagauauccuuaacuauauuguuguuguccuauaagguuuagccuuugaauucaguucuaugaccauuuuaacaugguuuuggggaaaugauaaaaguucaugguugaacugaauauccaguuuuuccaucuugucuccuccccacagaacaaaacaaaaccuagcauaaccuuuacauguggauuagaaagcaccugucaauaaauuugaauguccaccugauccccaguuucccccacuaucuguuugguuuuuaugcugacauuauacaucugguguucauccucaaaccuuguucauguucaaaguugcuuugguauucuagguuaucugcaugcuagucuuugacuggcuuuauacugaauuuagaaaucaauauugaaccuuguaauuugugaaccuaauuauauaucuauauuuauuuuuuugaaguuucaucagcauaguuauauaggcuccaaaggagagcucuuuugucaaauagauuucuauguuucacauguuuagugcuacucagaauaguauuuaaaaguuuccaauucugccuuacuuguagcuagaauuuagaaguagaauugcuuuuugcagagcuacuuuguauaugcaacugaauccauauauucugguggccaaucugacacaucagauuuucuauacagacaaccaggaaaucuacaaauaaugccaguuucauuucuuuuccaacuugcuguuucuuaccuuauuccaaaggcaagcaucuccaacuuaauguugaauagaaaucauaacaccagauauuuguacuccugacuuaugggcaaaacggauauuuguucauugaauauguuaacugcaugcaggccuuuuuuuuuucaauaaccuauuucaauuggaggaagcuucuauuuuuuacuucauaauuuuuuuugcuagauuucuuucaaguacuuucucugcaucuucugagauaaauauggcuuuauuuugucauuuauuaauauguuucauuuucuuuauaugccccaguacaggggaacgacagggccaagaagugagaguggguggguaggggagcaggggagggggaggguauagggaacuuucggaauagcauuugaaauguaaauaaagaaaauaucuaauaaaauaaaaaaauaauguuucauuuuacuaauuaaauucaaacuaacuuuguauuccugaacccuaauugauucuuuugcuuaaaauuuuuggauuuguguucacaagugauauuaccuacaguuuucuuauaauguuuuuauaauguuuauaauguuucuuuauaauggcuggguuuccuaucaggguaaugcuggucccagaauuuaaaaagaauucccuucauuaaaagaaaccagaguuugcuucuuaaacauauggcaggauucaucaggaagcaacauggucccagaguaugcuuaucgugugugugugugugugugugugugugugugugugugcauuauccaugauagauaauuggguuacaucugucugcacuuuaccuuuccuaagaaauuuuccauuuccucuaaguuguagaauauaguaacaaagagcuguacaggauaguuuuguaguuuuaaguccugucauuuauauagagcuggguaucucacuucugacacugacaaguugcgacaucacgcuugcucuuuggucuaucugguuagucacuuauugauuuuccuggccuuaaaaaaaaucaacaaugguuugauuauuuuuuuuccuguuuuuaguuucuuacgccccucgcaaauucuuauuuuccuuuagucuacuuauuuugguuuauuuagcuguuuuauaguucccagucugaggccuucaccgcuugcguggugcuauaugguccucuaagaacuguuuuagcaguguccuauaaacuagagcuuguuguguuuucacuuucauuugauuuaaaacacucauuuuucucuuagguuucuucucugacccugugcuauuuggagacauguucuuuauuuuccauauaguucagaauuugccaucuucuuaauugauuuuuaauuuaauucuacugugguaaaagaacauaugacuugaguaacuuuaaguuuauaaaguuuuuucacagcucagaauauggucuguccuggcauguggucucuguguaguuggcagccauaucuauccugcuguucucuaccagcauuaagucaacuugguucaaaguauugcucagauccacauuucuguugauuuuugugucuaacgguaccaucucuaauaauaaagacauuaaaauccacaaaacuacuuauagauuuuuuucuucuccuuuuauacauauuauuuuccuguuuuuaguuguaaguuguuuuaagaaacaucaacucauggagcuggaaagauggcuuagcgguuaggagagcauacuacucaugcagaggacucuaguuugguucuuagcaccuacaguggauagcuuacaacuccuguaacuccugcuccagggaauccgauaccucuaguccuaugcaggcaccugcaauuauguacauaugccccuccuauaauuaaaacagaauaauuagucaccaauaauuuacgugcuuuacauaugugucauagggucugauguugauuauuuucaucauuauuuuucuaaauagucacuaauugggacuuuauuucuucuucaaaggaauaaguuuaaaugccagaagcagcauuguucagaagaguaaaguacuaaauagauuucuaacaacaacaacaaaaaaguaaagcugguaggucacuuuucccaucagauucaaacuaguuuguagagucuauguagcaggugaacaccacaaaauuauuggcauaaauauuugccuagaaacaacacaaaccaguuucaaaagaauuuaaaaugacaggcauuaaugcucaugucacaguaaguagauaaaagcaggauuaaaacugagcagucaauguggacccaacccagggaugacagucaucaaagugggggugcacccacuuugucaucaggacacuggggauaggagugagaggccagguguggugcuaauaagaagguucugauucaggcucagaacacacccaagagaggacaguuguccaaaacccaacagccguaagacagcagaugguuauucuuuauccucuucuccucuguauuugugcuccauggugaauauaaucuacuuuucuaaucagaaauauauauauauauauauguauguauauauauauauauacauauauauauauaaacuuaaaaguggacaaaucuuccacuuaaagauauacaauauaguguguagacuauugggcagcugugucagaugggaaaguccagccaugggucaagacagaaaugguugaguagaacacugcuggaaaaaugagaagagacugggcucucagaagucacaugacacuucuagguguagaagggccauuaacugcccacacauuggucagucuacucacuggucaugcagacuagacuugaugcaauaaaccggaggugaaaaggcaggaucauagagucauguucucaaggacagccucagagagaaggggagucaucaggacacuggggauaaaagccagaggccaggugugaugcugauaagaaccugauucagaacuuacccaagaagcucugaccaaccuuccuauuggucucaccauagccuacauaacuaucagugagggagguuuucuaacccaaaagguuuucuaacugaccaacuuccucaggucucugaggccaccgagugauuugugacaacugggaagauuaguagaaguuucuauuaagucuugggccagacacaccugaggcccagaacagaagugcagugguacaaagagcaguaggccucccauuauccuauagucaggccuggcccuuccacccugguagcucugaugcagcauggugagaagucacagaagagcuacucuuaccccugcagcuggcacuggccucgcacuuggaguuccccagggcuaaucuauaagccaccugccucagaguaacaugagugccucauacagauuccaggaccuaagcacagucaacacagcccacaguacggagacaugagaugcuaagucugcugcaggugaggucugguccccuguguaaagagaacuuucucugacacagagaggaaaccucugugucuccacucccugcaaguaccugggcaaguuuguggaaagagaacaccugccuugcaugucccucugggaucacucgauaaauguggcucuggaaucaguccugagagcugguaagagagcaggugcagcugggcagagcacauccagccugaaacagcucaccugugacucagccugugacucagccugcccaaguagucaccuguggaaucugaugaucccuaaagaaagaaggugagucuggaaucuuuaugaggcaagaagugguaacugagaacugcauccucuacuucccaauguagaacuaggcccuauagaggcugcaaacgaguagacucaagggaaacauaaacaaagcaaaugaaaaagcccacacuggugggaagggaaaugaaggaaauucauuugucuuggucuauucuugcuggugaauaaaaccaaaguuccuugcuugaccugugugacagaggccagcuuucuaagacauaagucuccacccccagugcaugagcucucuacaaaauccuguguaaaucugaguccccaaagacccugauuguguucccuggguuauccuguuugggaguaauguggucucccccaggaaccuuagagacaaaagcuacuaugaaaaagagcacaugguauuagacuacaagcacugcagagguuguaauuaucaauagauguugcaaaaauaaacacauuaccaugaauucaaaauuaaaacuugugauguaaacuaugagagagguacaagcugauuuaaagcuccacacaaggaugcacagaacugggaaaaucuaagguaacuaaaggacugccucaguggccggguaaggccgugcaugagacauaccugcaguuagcaacaguagcaguaugguuagccugagaaggacaugagauaggcaaggccaagcugagaugguccaacagaaaauucuaggacagaggcuugaaagauaguucagucuguaaacugcuugcuuuacaaggaccuuaguuuuaucuccagaaccgauauaaaaaugcauggugugguggcauguguuugcaaucccagcaauguggaagcagagauagcgagauuccuggaguucccuggccuaauuaaugaacacuaggccaauaagagacuccaucuccaaugaggagacaguguucugagaaugauacccaaaguuguccucuggccuccacacauaagcauauguacacacacaguuuccgguagauauaguagucacuuugcuugcuugauggaagacauaagcccucagauucagucaguaccacaacccgugauuuaaaaaaaaaaaauccaccauguugacacaucacaguuuagguaacaccaaacucaaaggagaauuuucagucaccaggaaugaaaaggucaugcacaaagagguauuccuauguaucuuucuccccaacuaaaucaucaccuaggagugagcacacaauuaaaagaugcaacccagcugcagcugaaugcucaccaagaccagcccuagaagaagccuauacuuaaggacaaaggagguccaguuaaaccugcaagcaagccucagagguucacacuguuagcaaugugagcaacuaaugagaagaagaaucuaaaaaagauaaaaucaaaacacugggcaacacauuccaggaaggguguguguguguguguguguguguguguguguguguguacgugaguauacauguauacguguguuugcauauguguauguaaguguaugugaguacguguguacaugugugcuuaugugucuguguuuguguguuuguguauuugugugugucagugggggauuaacaguauaccuagaacacaaccagaagucacggggcucaagagauggguccacaugagacaacagucagcaauauauuuaaaauauaauccuauggggaccauagaaauucacagccugccuggauuggaguggagugcauccagcaagcaccucugucacuaacagcuuugugaacuggaagucagaggugcuguuugacacacaucagcagaccuacugugugugugagaauacucaagccuuacccacaguggcuacuaguguggagaugcccacuaauccuacauugaguccuuaagaucccuauggacagcagcagucaaguuaccagggucagguucucuggaccugaacuuggacaauggcuucuccaucaaccagggccuugggucuugcuuugcacuucuuccuugagccuggauaucaaucccucugggaugcuaguaaguugaauggcauguggcuugaguccuccaagagugagagacaauacuucucaggccuauaugguccccugaacccucucuguuagcauucuguccccuguaaagguacaagauccuggcaagaguggugggccuuugggggaguuguagacuucuuucugcuuuccacaguguuucuuuacaggaggcacagacccauuuuuacugcaggguagccugagcccuaaugcuaccauaaaaagaccccuuacuuuaccugcuuccaccaguccaauuccaccacaccugcacacaucucuuaggugagcuuaguagaguguccuuacaggggagguccccgcaugauucugggucucugcuagucaucuuuaguugggaccagcacugcagcucacuucuacccacuguauaguaaaagaacacuauacagguagauuuuugcacaccaugaacagguaaguguccucugcaaggacaagaugauggcuuccuaguucucauacacaaaugagguccaagucccgguuuagccuggcacuagaagucagugugucugcuugggaucugccucgugggagcaggcacucuggggcuuucccagugauggcaacccucccuccccgccugggauuagcaccucgucucuaugccagagugcucaagauucccaagagucucuugggugagaagauugggguguaucagguaaccugugaaguaaggguugccccagauccuuagaggggcaagaccaguggcucggucucuaaaaucugguggcucuggacuaggcugacuuaucacauuaacagaaagagacgacacggugugggagcauuccacaagcagugcugcuuucucugcucgugcaccucauuaacaugccgcagacaucacugcggacuucauaacacuaagcaggcugaauggacggcagggacacugcugccccguauucagaaaacaucgagugaugcuucuccugggcaggcacagggcugcaucccugccgccucugcucacgcccaaccugcccauuagcauuagcagaaagccccuauuugcauugagacaaugguccuaccccugaagcagagcugcaggggcacugggcauuuguuggcacaauugcccuuugugcccgcuccagugggcaggcggggaguaugucccaggggcucauggagauguggccagccccgagccaaauccccaugccaucugaugaggacgcagcagcuuggcgcucaguaaaguggggcccaggcuggguccugacagacgggaugccuaagauagccuucgagagcauagaacagccauggccccuuucuugaacacuucccacccuccugccaagaugugguggugggaacaaugacacgggacacagaucagcugcccuuagagaagcuggacuugguaggcuggggcccagacacuuguuagaagaaagaugaagaauaauacuguuggucacccucugcuguaccugaaacuguccuuacaacugccaaugagcuggaaguuucuggaggauccuggagcauucuacuuagucacaaaacauucuggcaggucccaggcacugggaggaagucugagaagggagagacacaccuacaugacagcagaguggagggauagagugucaacucaggagacacugcuacacacacacaguuggucucaacccuuaguucccacucuaccaagcauccaacaucagugccuccuucuugccaggcacaagaccuggccauuguggcacaugagacuggacacucagucucuaacaggacacucaaaugaagccuucccauggagccugggauucuugaagguaagcagaacaauucugaaugagaggcaagauucugaugggagaaaccaggaccuuaggagccagcucuagguaguggguugccuaucauugcuguagcaaacaaguauucagguaggauggggagagaggaugaggugagcauuggugccuuuggcucaagcuuccaccucuccaucuggaaaagggcucucuccugaccucaaguacugagguccaacuaucacuuauugugcuuuuagucaggugcccccuccacccaggacugcaucuugggcaaagucucuccucccugccuuugggagagugguuccugggcugccccaauucauggguacucugaucccuuagauaaaauggcauagcauuugcggagaaccugcuuguacgucuucaugacaccucccgauucuuuagaagaggaacuuccacguaauagucuguaaacagauugagucagaggaugaagaaccuguggaugcuggaugucuggacuauuugccuuagcauacagucuugggaggaaacagccagcaggacaguguaaggggcuucccaggagaugcugagcaaaagguauacggugacaugggccacaucccaggccuagcucacaaucuagcuuacuaucucgauacccauacuuuucaggggaaggaaaagaccagaacaguucaaacuugaguuauagacagcugcuagagucauuuacccugaggugggcacugaaguuuuuagagauauaugagaacuacaggggaagucccuuccacagccaccuaugcugucucccagggguuaugcuguaaacucaggagacacugcugcacacacacuguuggucucaacccuuaguucacacucuaccaagcauccaacaucauugccuccuuccugccaggcacaagaccuggccauguggcacaugaggcugggcaugacucuuaguggcccagauacugaaaggaguguccagucuccaacaggagacuguacauccacaucugagaccagaaaugugaaaaccccagacccacagagcccugucuccugggacaaugcuugaccguaugucuucauaauggaaacagcacccguaccuccugagaaaucucucugguaaggagaccuuuuacuccugcugugguccccuuccaguccagaggaaggauaugaagagugcccuugccuaucugcuuuguaacuggugacccagaggcacuucuaggagcaugccauauucucacugcauggucuggaaaauaugcuuaaccucucugaguucccuuaucacagagccucacuaugaccuuacagaggaaaagcuaacuagggcccaagcaugcaaaccuuucacaggccugcggucuuaucacuaugucccaugggcuuggccucacccaagccauggaaggaaagauacagggauauaggauggugaugcuagauagaaacccagggcuguauaagaaauguauccaucaagacauugaccccuacaaaaugcccucaugguuucaccagcuagccacugauccccccagggccugcagagacuucaucuuuaccacccucacuucugggcuuccccaucagugggcaaaccuccaagaggucaccacagccaucuuucaaacaaagaccuugggugcuaaaaggagaagcccagugaauagaacacacaugucaccuucccucuuauggccaggucaggccaugcugacccucaacauucuaaaccaguaguagguaucccuucaacagacugcauagugauuaccaccugaaacagacuaggagagcacggcuucaaagccgccagaagcuucuaagucuaguccaguagcagagaccucaagacaugcaucguuuccaagguaggcaagugacuguguaugugcucugcggccuuauggacagagugccaggggaggacuagggacagguggcauggaagcuccccacagccagguugacccugcuguagggucagcacugaauguccugccccugcacacaugguagcuugcuuaccugagcugucauagccaucaauggagaaauggucuggccuccuauccucugggggaucauaagugaugugaggaacauugaacaucuucucuccaggacucaucccauuauccuuauccagcuugaacuucuucuucuuuaccuaaaaaguccacaugaggaguagcaguuccugagcacugucugccagaucuuuaaccaaccccagagcacccguggagucccgaauccaggcuugaaauguauacccuugagggaacuuggguaaaggggcugagcuccaguuccugcagauauugaugaaauggggcuucaguguguuaguguugcuggaggguuuucggggguugcuuggcccaguguggcccucuaugagccacagccuaagaaaggcaagcaaacaaaaauccaauagacuguaaauaugcaggcuugcaccagggcaguagggcugaaggccaaggcagcaaagaggcacuggggccucuuuaaagaggucucucagagaaaguggggaagcagguugugugaaaccauggagagggaagugcaaguucaaggguccagugacaguuggaugcugagaagguuguuuuuucaaggaggggggagcaaggaaauggaagagccccaaccuuuuccucacuauuccaggccaauggcaggacucuuguccauagcuacuggaacuugacucugugggcuagaguuccaacaccuuccuguucugucugcuuuacccaguaaggaaagcccagcaccaggguccucucaagagcuuccuuacagcagcugauggagcugcccucuccuauuccagaaguacucucuuuaggccuaucauauccuggucuuggcaguccaaucuggcuccaaggguggaggaaaugaagucaacauggaucaggcauggaguagacauccucugacuucagaaugaugugggcacccuaaugagcaguacacggaguggcagugccagagucucacacaccgccucuccagcuuccuguccugcuaacauguaguucccuuccugauggccagugaggcugcuuaccaugacagacuuuuuagguuuggggcugggggacagaagcgugugacuccgagcaggcuuccggacauagaucuuccaaguggcugagucaggguucucagcggcauagcaccuccaugcagucugaaaucaggcagaggggaaaggaaagaaggcucauugguccagccacucagcaguaccucucaaaaaaucuucauguccuccccgagccccaagcccagcuuguuccaaggccccuucccugacaucaaggcuuagcccucuagagggcuaggaaggagaaggccucauucauuaacuaucuguuaccugagccacuccuaaagagagccuugagcaagucccagacauacagagaugcucaacuaaggcagaguuagauaaccagacuugacucagaggacaguagaaaaggacugccugagccuuugugagcaccagcagguuguggagggguagagccccagggaccagugggcgaugaggccuccugggacuucaagggcuagacuguggcuacgaggagucucuggucacuacagaugaaacucuuggccaacauucuagagggaaaugcccuccccauagucaucacaucaagaugaccuggggaagacacuggaggggccuaaaggagccaagggagcaagaagggggaaggaacagauaccaaagccucuuauggggacauaccauggugacucugucauuauaggcccuaugggcaugagaaaguaaaaccaguugaaaguucucuaugcuggccaggcuucugagugacagccccaugcuaugacagcaaccuagcauagacacaaaauccaggcagggauacuuaugaccugggacaguuggagccccuucgaaggguuuuaugucccauguauaugcccuaucugggcagcuccauaccucaugcagccugcagcuccucccagcacacuccauguugccuguguuuccaacucccaccaguaagaucccuggcacaucuuccacuguggguauagcuucugaaggagucuuguccacagaccaugcaguuccugagcaguggccucugugcucagccgaggaacuacauaacugccugacuauguuaauguggccaaggcagguuagugggucugauuuaagguuuuccaagaaugagaagcuguggggucaagccaggccugggaaagcccacaacugcaacugcuggccucguggcuguugcugucaguggccagguaaauggcucuggaagggcaucagaggaacaagcuggggcccagaacugugcuagaagcuuagauaagaccaugagagcuacgagcuuugagaagggcugccaugccccucauccaggguucuguccagaucagagaagucaggaaacugaggcugaccagcagaguacagacuggcuaaguagccauggucaggccuugcccuagucugcaaguauggcccucagugggaacagcaugaggagcagugguccugcaucccuuugcccacccuaucauccuaauagugaguacuuucccagagagccaccucaccaugggaagagccgaagcaaagggauccaugccucucaaguagugggcauggcugggagugguuccaacacccaaauggauguaaguacacagcacugauagccugccgggcgcaccgcauaccuggaugagugaggcugcagcugggaucugccgguugaagugcuucugccucugcuucugcuggaccuucagcgcgaacccagagccaaguauccccugguaagggacagaaggugcccacuguuacauaagccaugcuagccagugcccagcagaggaugagggucccaaugaagagcaagaagcaaaagcaucuggauaccagguuugcacagugcccagggcuguggccaggcaggcacuaucagaagguggguuugagacagcagaugucacaugcgggcagucuccaggcucagccugccuggccuugccagcuggggaggcagaauccauuucucagagucgacucaacaugaagcuuggcucuagaagagaccugagacucuacacauuucuuggcaccaccugugggaauccagguaauuuagccaucaccccuugccccuggggcagaggauuccuaacccuaggagagggggaguuugaggcuguccucagcaagaagccuacagcuacuguagccagcaguggcagagauggaauacugacucugcagcuggggacacacacugugugucaugacccauauauaugugucacacaugcacauauaacagacacuugaacacauaucaucucccauguguuacagaaacucaugaaacauaaauaauauauggauacggaacaugugugcaaauauagguauauacaugacauacauggaaucacaaauacacacacauacauauguauauauguacacauaaacaguacauaugguaaacaugcuauucaaauguaauacagacacuuguacauguaacacauguauacaguauaugcacacaacauguauaagacacaccuacaaugacagauauauacaaguaaccaguauuucucccaccuagcacacauguguagacauagguuugugauuuuuggaaaagucacaagacagagccacuccuggcuauagagcagaccugcagguucugcccagucugcuccccuguaccuugccgcuucugugaaguaccacaacaaggccuccuuacucuacuucaaggaaugccuagaaguuggggcaagggugagugggaaacaagggaaagggcucuuaauagguacccaccgcugggagugcaaagaaggauauggcgaagacagagaaacaggaggcgauggucuucccaacccacgucugagguaccuuauccccguagccaaugguagugacugugaccugcaaggaagaaggacugcagucaguggugggcuggcugagagccucagaaaagacaccugccagccccaacacagcggcuugaugacaaaagagaccaacuuaaaacccugccuaccaggauagugaggcgcgguucugagaaaguaccaggaacagcaauauggugaguugguucaagcuucugagucuccuaaguccuucaacucugauuaccacagauggcacagcccuaggcuuacagauagauuggggugugcaggacaggcaaagagcucagagcccacccacagggaccaggcuuccugccccaucgaaaagaucccucuccuggccaccaaaguugcagugcacuggcccccaggaggccggaagcucccacugaggccagcgguccacaaagccccaggauggggcugacaugcugcuuccugccaccagcccagggauccagauguuuuauuuuuccuuuucagagagaauaaggcaaggcucuagccuucuucuuagugggggagcagcguccagggugugcagugggacaauaggagugaggggcugccccccccaggcaguccccugcugacaucugagguuugcuccuggggccucugaugagggacuugggggcccacccuggcugugccuaacugcuaggucacaccaugaggcugccuugggccugcugggagaacaggguggucacauucacuaacacgaagcccuuggggucacaacacacuguccagaucaggccaucagugaaggcaggucagugugaugggauacccugcccacucaaggucuuuaaagucugaucacucuagacaccucagcugucaccccuuggggccaggugacaaccacccagccaagaccuauaugagaaccucuaagugaaccucugcccaacaaagauggggccuggggaacaccaucgaauagacuccaaccaaagugaggcccagagaggaagccucaagauccccacacuauccaagcccauggccaucacuacccacuccauuuccagauggacuucuguggaccacaacuguuccccaguggccacugaagaggaagggaaggcaagagaggcaugggggucagaaguuaauauguacauaucgugagcauagagauaagugcucagagccuaggcaagcacucugaccaacuucagcaggggagcagaggacaaggacagcaagagugaccccacagugccaagucuguugcuuuggccaguauguuaacaggucaugaagcaacaggucaauuuuuccuggauggcaaacaacagagcaggcuacagcugggcccaggccaucacugggccacccuucagugcuguaccauuaaauaagaggcugcaugcauacugguguuuucucccaauugcccacaugaaaucuuccccacaaugucauuauccuuaaaaaaauccacacccuacaugaacagaggacauagcaaaccaucaugugaaaucuuccccacaaugucauuauccuuaaaaaaauccacacccuacaugaacagaggacauagcaaaccaucaugauggcugggcccuuuaaagggaccaaccuggucuacauaugugggcauacaguuguaaacaugcuucacauggagacaaggacacccauucacacucauaugcacacgagggaacauggggccacugagugagcugaggcaccaugagggugcacauacacacugcguaaguucacaaaggggucuagagguuauacucaggacugacagccagggcacgugcuguccagacaucuuauacacacaccugaaaccacucacaugauguaaguugaagacaagccauuccagggacggaggacauggcugccugcaggcugugggaugagagggcucaggagagcugaagcuccucacaagugacgucuucccagagggugugcaccccacaugugagagcuaacccacagcugccuucucuagggagacaggcacaugacaggagcuacuugugaaagcagaccugggcuggagccagcaagaguucaagaucaccugggauauauggcuuauuugaggcuagccuuggcuauaugaaaccccauccaaaaaugggggauggggaggaaaacaucuacaaagguggagggagaauggccuagagggcaagcugggaagaagcaugggugaauugagaggaaacuccuuauguagguaaaaauaccugaggccaugccuuuucccuauaggcuuagcugucccuccacuccuuggaucaguaggagaaagggcccagugcagugguccugagugcuggucaguugucuguuggaaggcaccuaaccacuaggacccucuuucuccugggccaccacagagcuccgaaucuaguuuaugaguccucucucccaaguagccugucccuaucaaguuguuuuuccccaagucacagacucagcaacucaggaauggaucauuuuauagagcuguuuggaacuuguccccaauggcuagaucugcaagucucuugggccaaugaacagaggggaccuuucaagggcccaacuaacaauaggucaccugagucauacacacuugaguucauagauugcugucccagugacagaaccugucgggcaggcucuguauaguucauggcucuccucgucccccugaacaggccccugggaaggauuuucagaacuaguaguaccuagucuccuccuuuugagucuagagguagccuggcugagaaucuccaaccacaaccauuccugaagcucaccuucugcaugcucacugacuuaacuugucuauaucuauuaacuagcugugcccaaagaggcuaguuggcaugcccauggcuucacagcugaugccugguggacaugggaggugaguacagauuggucucuguguugaccucacagcgugucaaccuuguaccuuaugcuucacuacuuccugaugcugucugcuuccucguggugaaaggguuucugggaagcucuauuccugagauuuacacaggcaacuccucaauaacaugauuucaacccauguuuagcaccaccuaaccugcugagucuguauaauaacucuaggcacugcuuacugaauagcagcuacaaaaagauggacaugcuuuguagagacuccucaucauucuauaaggcccaacuauaaagauuccuccuccuugggaagagcuuacuagcaaggagucuggcaggccuucagccuuugcugcauaauucucauagaaccaacacagaagaggagagggcuuagugcuaccagcccugaccccugcucuggccuucacuucuccauagucagaucaauccugaagaauaacgucucucguggauaguuccacgaggcuugcaugugacuaucuaagagacuuccucaacuccaaggcccuucuguccuagcugugcaggaugcagcccagccugggaggugggaacuuuccagagccuccaggugaggaaugaagagccgucagacuggguuuuuuaagggacugaaauacagggugggguuucagccugcucacuugaaguucuguauuuagccacucaagguaaacagagcccagcagccgccuguuuucagagacccccaggcauuaaacagaggagcccauguuugcagaaaugccauuuuccugcacucaaacuguaauacaaacaaaugcauucuguuucaaggguaaaggaaagcuugaggggcuccccaaauacuucccagcccacacuuggacauuauuuuaggggguucuggguuccagggaccucacacccauguggguauucccacuggagaaaggggaugcaguccaugaaguuugcuuuccagcuguaggaacucacaaucuaugaagacagggccaccucacaaaaugcugccuggauaccuacauucuggacuuaucugugucccccacauggcucacccagccucaccccagauuauggccuuccuucugggucuccuggguggacccuaauccaaugcugcauguccaugggaaacacauaggagcgacacaggauccuagggcuaccagaaacuuaacuuaauacuaaaagucccuucccagagucuaccaagugaguguggccugcccaugccucggcuucagacucugguguucggagcagaacaggacauacugaauccaccuauuggcagugaacaggcuuuccugccccuucucacaaucugguuuacuuacucagugaauaagcacuagucagagaggacccucaguuucaucauaggcucugcaggcuaacagggugagaaacauuccucccuaugcaggcaugccucuaugcccaaugccuaccucaguguaccuuaggggaagcuaguccaacucucagggacaacauucucugggguaggggacagggcuugaggccuaguccaggacagggacaucagacagagaggggccugguguuuagaaaaugcucuugccugaggguaugcacaucacccccacauuaaacagaugaggaacccagggacaaggucgggaggggccauacuucccuuauggaaugagggagacaaaggagaugccuguucauuggcucagggcuacagaacucugagccuggcuguccuguccuacagggcucaaguucugauuacccuagaggugccaggaacccagucuugggcugcucccacuagacagcugcagagacagccacugaaugaaugaggguacuggggggcccuugggcagccaagggcacagggccucacaggaacaauggccaggccagggugcgcuguggucgaggccugggcugcagcugacggaguaggccagacagagcaccggugccaagcugggcacaaaggggccguguucccggcuggcgggcggauguuugcacaggugccggagugggggcaccuuucugccgagggcuggggggccaggggcuggggggcugggaaauaguuccugcaggaggcugggaacauaggcagggcagcaucaaggcuggguacugcuaaggcugggcaucacuuaucagccacacuguagguagucacccauuuacuuccugcuguaccucagcuaacacugcccaucucccaccagagaauucugguuuggaguugccuggcccccaugcaggcccugcuacaucccugggauguguccucuuuccacaggcaagcuuucuaacuuuccuacugauuuuuccuaccaacccuguuugguucuaucaugcuaggguaucgggggacauuggccccaagaaggguaggcagcauuuugaccuggggccugucccaaccuggaagcuucucaggguacccuuaccuccugaggcuguuuaggaugcuagaaacuucuagaaaacggacugauucggccaaugucaagaggucuugcuaugugcccugcuuccugcaggcacuugggcauugugagaacauguguuuauucagcucccauucucaaccccagucuagaagcucugagaguaagcaggccucggagacugcucaguccuggucggggugggggcaguauucaggccagggccugaugcaaucaucaucaccauggauggcugcuuguucugaaucagguucccagagucugugcuggcccuuucuauaggaugccacagcccacccaaccuucucaccagccuagugaaccccaaagucaacagacugagaaugccauuuaggaucguauugaaauccucgugccuacccaggggugccagcccuggcagcuccucccgguaugauggcauaaagcaucuggacagucuauugcucuugaaacugaggggaggagauagaguuuuaaucgagggcagaccauacaugcucugaacugcuugcuccuguuagguccuuguguuuccugcagcuuagagggccccaaagcucaguggcuggauaaagccugccuccagaggaggucacgaaggccauguagcagcuaucccauaggcuuuuaggccaugagcaaugguugcuaggucauggaguacaccuggauuucuucagcaucacucucaccagaaccucucccuccucuaccuguuaucugacacccaaggagccacauaccucuacacacacacacacacacacacacacacacacacacaccacauucacaccaaacacuggccugcacacaguaucaucauacuuugggacauucagcccuagcacgagaggucacugucacacaccagacuccacacagacuggcagcucagugaguuuggaguugcccuaacccgagcgguuuauggccaucuuuaugaccuuagggccugacuggcacucauacuacugcugccuggggcagcggaagccuuugcagaccucauauccaaaagccccugugucuuucucuuagcucacaagguuuuaaugguaguauggcauugugugccuugaucucuggcacaggugugcucccugggucaacauagacaccacaaacaugcaaaguauguuuuugaccccuuccugcacccuaaacccaggaucccucaggguaaggaucaccacaaggcugagauaugaaguuccagguugcaaucccuugucccaucagccuucccuuccaaaacagaaguugaaagauaacaaugcucaaauuucaagacagggacuggagaacgcuuacuguaguauacauuuguaagcuguaaguacacauuuggugguucaaaaguuuuuaaaacugggguuaguaaccucaguggagaagguaaaaacauugagcaaguagaguucaauauccuaaccccacugcccagauccauguaucucccaccugagacccccaguaaagaccccaacuuaccaccccccaccacagagcaucugcguagcugccaaacucgaugcggccggacucguucaccgcaucuuucucagccaaguagacaaaguaggaggagaagauaaggcccagaaagccaauguacaggguggugaucagcuccuagggacagacaacacagaggccauggucacauacccuggugguccacaugaguauggugagaggaggaaaguuccagaauuugcuguuagauuguacuguguugacuguagcauguuauacacacagaaucaccuuccagaguaaccuagcuuuugcaauucacaaaaguggcaaugaagaagucucagcuauuacccuaagucagccauuuggguccaugcagucucccuuguacccaugacaagauaguacuuagagccagcuguccccagcagccucucagacagaguguccucuggaaagugucugaggcaccacccuugauuuccuagguuugauuucagagcuucauaaaucuguuguucaucuuacauuuucuacaagaugcaauggucuuuugucccaagcccaagugaagguggcggcagcucugcacuguuaagaagccaaguauuuugccaucaugaaugugggguaggcucaggcugggaaggcucugggguccuggacccuguccucagacucacaugucuugguaucugccuagaccugguccacucagcugggguccagguacuaagauaucaccaucacugcauccugaccucauaagucuccagaccuccuguuuauaggcuggccagcuucuguucugcccacaccaggcuuacucaccuggcggugaaugaagacuacagagcccaggagccuccagguaccccccuggcgaucgacaugcagcauccgcaggaucugaaggaagcggauaccccuaagaagcaagaagggagaggucaagagggcugugguggacacaagcauuugcuuccuauguuccugucuccaccaagcuuccaauggguagagaagacauguacaugacacuuuguacuggagccaucuugcuuccuauaggugccugagaacccucucuccaggagcccuuuuauauggccuuuuugggggagaccagaaacccagggucacccauauggcaaccacacagucaggcuaucaucuaagucuuagaagcuaggaaguacuggggucaaaccuugaacucaggguugcauacuguuucaauaugaugaacuauggccacccuuccccugugccacucaccaugaaagagacagguagagggagggagagacuacagcuuaggaggaaagggcuuuguagugggucuucucucacaggaagaaauggaagagccaacauaccugauagcugauguggcgaacacuuguccuuuggaacccacgcagaggacaaccauagaggcuacaaccacgaugaggucugugggaggggcagggggucaugacuucugguaaccaggaaucuggggaggguaggcuaccacccacaccugaggguuaugccacuaaagcaagaugggacccaauaaccaagggcacaggaauaaucuaggggucuccauccauggagauucucuggggaugacuguaaugggaauguccuucuggacccaugaauguguggaauggaaugucugcaggauguguaggcaggacucaccaaugauggaaaugggcuuccgggcaaaacguagccggccccagaugcccacguacuugcugcggcagccugcagaccagaggcggaccacauauucugucccaaagaacaccacaaggacaaucuccugagaaagaaagcaauaagccuguguuagaggcuaugaccacucaggcuagagcaccuacaccaagcuaccaugccaggagccucugcugagacacaaccgugacuagcaggcucagguauccaucugugguaacucauaguaccuauaacaacuguccagagagguuaacacacugagcccagggaugcuaagaguagacagugucagcuguuauuugcuggggaagacuccacaccaggguugggguuuaaugaucuggucugguaacauagugcugacauuuguguugucuagcuucauggaaucaacagagcucaaguucuauaucugaaaaugaggguucaaggacaugugucuuuugaggacugucucccuuagagcauagcucacagcucugccucacacuggagacaccguacccaccauccauagccucuauugagguuuggguacaaaaguccccccaauccauccagaggcaguagaggaaucaagcaagggcacgggcagcaacggaugugaaauaacucuccuaggucaauucacacagaccagaccucucccaauguauccacauacacucugaagucagagugcacugaaagggaggcuuuacaagcuagagaaacccaggcugucauccagguuacuuacugcaguggauggacagaucaacacaaagguggauggauagaagaggagaugggugaguggacaaauggauaggcaugugaguggauggauagauggaugaauggaagaauggauggauagguagauggauggaugaaugagaaggugggaggaugggaaaguggagagauggacagauggauagauggacagauggauggauggauggauggauggauggauggauggacggauggauagauggaugggugugucgaugguugguugaguagaugaauaggaagguaaauaaauaauugcaggugacuggugugagaaccaaguuaaaaaaaaaaaaaacaaaguggauccauuagcucucucaauaaaaacagacucagccucugaccaugauuuauaauucagcuagcagcaaucuuggggccuucccagucugugacagcacugggugagagcaacuguacugcuuuguguucacacagccuugacacaaacugaagggacggucgcuggcggccuggcaaucaccaugagagaagucaagguaagccuggggccuugccuuugauuggugaauagccucuccuucccuagccuucacuaucugccucuucaaugaaacacccaaagaccugucacaugcacaguaucuggagggugaggcauuggcuggcuugcuauggcauagugaugucagaaggucuggucugggauacccauacucugcugccaguuuccguucucucccagcucuugccacagggucauugucagggacuggcugcccugagugagaauccccuuccugcuuguuccaccccugggcagcucaggucugauccucaguccugcuauggcgugaaaaugugaguagccgcaccacaagugggugaugggaggauuugaaauaaguauacauuccaugcgaacuacagccuaugguggccuccaggucuccagcccugucccagaccuguuccccagcucccagccagccuucuuugguaugaggcccuuggggaaggccuggggugaggaggugaaaccacucccacauauguuaggggacugugcaaagccacaaacccgagaagccacaaagcauugugcugcucaggccugcuuccagcuggcucccugccuggccucccucaggagccuggcccuggagggaacuuccucuuugaagggugacacaugcuggcccugcccccaccugucggcugcuggagaguccaccaugagugagggcugaauacugcacaucauauauaaaugcuuuuaauuaagacaaaauaguacaccaccuggcuuguguuuugggcaugagcagugacugauggaaggagugagcuugggagaucauagcuccuuccuugugagaaaagcauuuggcccaugaagugaacucauugggaaugggggggggguggcuaugugugggagagcgagagagugcuggcaaugaugggcccaguuuggcugagcauaccagggaggagccauagucucguucacuccagucagagcucaauauuggccuguugaaugaaugaaugaugagugaaugaaugaacgggcaaaugaacaaucucugagcagcuggcuugcagggauauugauucaucuuuguuucuugagaaucugggucuguagggcuguugcccaaaguacuguguguaucuuuggccaacaugaaaaacauacucccaauccccagcacaggauaugacuucaugggagacagcaugccugaccaugagaagucccaauauuuaguuacagugcuagcccaggcagaaggccucuguuccaauuucauggccauacaucacccagcuggcugaucaucuagugaguuucucucauuugcagauguuugucauuauucaaauaucuccuuagcaauggcuucugauggcuacaggugcccccugaccuaguacuuggagggaaacccauuuuggaauuggcuaugugaaacagcaagauccccuuacacagaucuccaauucagcaugugaacacagugugaagccuggauucagcggacuugagccccuucauccccugaaaaugucuggcuaguuauguccagggcaggccaggcugaguuaaucaguaaggcucaggggcuucuaggaaagagacauaggaaaacaacccuguccuagguagaauguagccauaucuaguguuuagacagagauaaaaugguuuucaccagcuuugcacauauacuggaccuaggaggaguagcccucagaccaaaggucacacuggaacuccagugaagaauuagcauuuagcaguagugugagucuguaggagacacacugugggggacaguuuaauucagguaacaacacccuaguccauagcaggguuaguggggcgagcuuagcccuuguauaacagaccacaggguugauaccagcuguuguuccagcauagucaccccugcucagucagggccaggccugaagcucaccugucuuauagacauaauccaaaugcaaccccaguguugaaugauaggccucaaauuucucaacagaacacauaaauaccuguuaccccucccucacccccaugccugcuccugcuguccacuugaggucaaagguuaugggcuaucacccaaagggucucauggcccagugcacccaaaagccucccuagaccccagacacauugcauccucuggguucuccauguccucagaggcuuagugugugggguguacucucacccccaccuuccaaccccuugccuauuuagaccaucccagcaucccccagaccuuguaacagccaccuaaaaagcuagcaugcuccccccaccaauaaaaguaccagccuaaugcaccaguauuguccagcucccuaaagggccucccugagaaauccacaugcugcugccagaaccaaggacucaaggccaggggacauugauggaguguggcccugagcucugucccagagauauaaaagaaagggcuguccuugggccaaugagcuugggcugagacaaaaggcaagagaacacaguggccccucccaccaugaccauuguucccuguacuagaguuaggcuaaauccuggcugcagagggcuuuguggcugagacuccugcgucagggauaaacagcgagcacagagccugcagcuuuuccuguauccaccaaggcaggaacccugugccucuuucuauacacagggaggaaagcccaugagaauaggagaauaccugcccaaggauucaugggaggaauagacugacaugggcacaaggcagaggaucacacaggcucucagguuugggaguggacucuggcaagugaggcuaguugccucuuggagggcugacuacugauacguggguacaucugggaacaugaggacagaagagguuuggggaauggcugugaguagggguuguauagaugagacagggucuugagugaucagggacagaaaccaagguguaaaaggaaauggccuaggauggagggugaccuagaggcauaagagccauuuaccaggccagcugugacacgaaguguccaggguaaggacaaaagaugagccuggaccaugugcagguccugguaccccauccuggugaacuucugugcauggcaggagagcuagcauuuaugcaggugagucugggauuauagugggugugaagagcccuggggagauacaauaauccuggcucuaacauacgugugcuugucuccucuagguccuugaagagcuggaggagagcagaggggccagagucugagugcuggccacuccuccugaagcugucagagaaaaaaagaggggcuugucuaauggcauacgagugccagagccaugaacaagagguucggacaggcucugaaagcaacaaucucuagaguguaccccuugcagcauccuguagccugucacuuugcccaugugcuggucccaacccacaugauauacucucugacacacucugcuuauuuccuaugcaguaaauguugagaguuguaucucaauggagugagagucccauaauugaaaacaauuuuaagggcuggcgagguggcucaguggguaagagcacugaccacucuuccgaagguccuguguucgaauccaagcaaccacaugguggcucacaaccauucauaaugagaucugccacccucuucuggugcaucugaagccagcuacaguguacuuauguauaauaagaaauaaaucuuugggcuggagcaagcagggacuaaaugagcagaguugaccggagugagcgggguuggcuggaacaagcagggguccuaaaaaauucaauucccaacaaccacaugaaggcucacaaccaucuguacagcuacaauauacucacauacauaaaauaaauaaauaagucuuuuuuaaaaacuauuuuaaaaagcaaagcugcuggcacugaggcucaguugauaaugugcuugccuagcaugcaugaagcccuggguuauauucucagaacuguauaaaccaggugugguacuagauaccuggacucccagcacuaggaggauagagacaggaagaucagaaguucagggucaucccuggcuauguagaaaauuugaauccagccuagauuaaugagacccuguuuuaaaauaaaaauaccgaagaaggaggaagaggaggagaggaggaggaagaggaggggaggaggagaggaagaggaggaggaggacaaauguuuuagaaagguagagaaccugaauaggcagcaauuuggagaagacauacaacugagaaaagaugcccacagaaacaguuauucuaugccacuaacuguggaaauacaaaucaaaacagaggcugcuguaucccucuagcaaaacacaggcaaugacuacaguggccaaggaggcagagaggcagggcuauuauacauggcugccugagggagacaccagacccaugauccuggaagcaugguucaaugguucccuaagucaugaagaauggaguuaccauccacucaauucugcucuaaacaaggaucuaucuuuaaaaaaaaaaaaguacaguugugggacuggggauauaaaguauauaaaguauauccccagucccacaacuguagagcacuugucuggugugccugaggcccuguuuaacccccagcauuacacagaaauacaucaauaaaaacagaaagaucauuuauuuuucuaaaaacaaaaagaacuuccacagagcccagcaauucuacuacauccugaaagagaggcaggguuuugagaagcuaucuguccaccguguuuacuuuggcaaaguacacaauagcuaaaggcaauguccaucaagaggacagagaaaacaggcuccagauacuagagggcacauaauauuccuucagaaggauguaugcuccaacacaacacagcauggacagaccuugggaaccuucuguugagacaaaaguccugaaagaucccccucauaguauaacugcagggccccaaguuaccaaagccacagggacacaaagcaagaugagguggcagggcauggggguggcggggugggggugaguguuuaacaagaccagagucaucugugaagauggaaaguucucaagguacgugguaaggacuacuacagugugaaugagcuucaugccacucagcugagcacucagacauagccaaggugagacaccuuaccucauacauauuucaggaaggggaguggggacaagauggcucagcaaggaaaggcaccugcuauugucaagccuauuggcucaaguuugauccccaaccccacacgauggaagaacaaaacugaccaaugcaaauuguuuucugacuaccacgugcacacacagacacacacacacacacacacacacacacguaccugagaaauaagggaauacuuguaauaaaagaagaaagagacaggagggggaagaugacauggagucacaaggcucacaggaucuacggccugcaaaggaccaaguggacccucacuguggcucccauuguaaagauaagaaagacggugguagagcaaagacaggaagcauccaaggucuaauuagguccuuugucaucucaucucacuauggcaaugcuggaacucacugaggcacaggcucgguggcauccugggcucuggauccuggcagggacaucugggaagagacacgcugccucugaaaacuucacagugggaacugaaaguuuucucauuugacagguggacucaguacccccaaacugaacccaagugauucaggggaugcagaagacaaaagcuuggcaugacagaaucucugacuggccgggaacaccuaucacacaugcauaccuacuacacaugugccucaggugcuuggggguaagcacagcaaagcagagaucugcccguaugugaaccuaaagggccgagauacaaguaagggagaugcucuaucugucaacagaggaaaggccagugcagaguucacagccuccgaggcccuuccuugaaggcugugggugucuuaucuauucuuucuuuuuaucagcuggugaaucccauuucuggaaggguggggguucagcuuacuacaauccaccuguggcccacagcaaagccagggcagggcagacugccuuggauccucagaugaaagacacuuauuuuuuuucccccucuguuucuuuuuguuuaacaaucaagggagcucaaagaugcuuaucgugaguauucagugucucugauguuacuauuuuauaaucuucuuaauaaaagaauaauuugaaaucugacuggaagauuuaacuauuucagaugaaggguuggcccaugggaauaggggcccugcaagagagccggcaaauccaggccaucaggccaaagggcccggcuggucucccugaggcccucuaaacacuggacagggcaguuucuagagaguuagauaccucuaggccuccuguaggcuaccaaucagcauaggggugccuugggaagcuagggcucagacccuucccuccucucauaacuaggaaaccuguaagauggccauuuccugagccagggggcuuccugugggaggacagugccuucucagcacacagacagccagcagacuuuggggccagcuguucugacucuacacgggccccaauaagccauagagagggccagccuugcauucucgggaggggcagcuggccggaggcucggugccggcauguaagcugcucaaagcacccuuuguucagguccugccuguggccagcugcucccagccgccagccuaugcugagagcccaugggcccccccagugacaugugcugggcacagcuggaacccuuaggccaugcucacugcccacccuggggauugucagcucccauaggccaccagcuagucccaggugacacaaagccuucagagacucuaaggaggcacagagucagggccuaauggcaguagacagaaccaggacccuguagagacaugauccuuucuauaacaguccacucuucuccaaauguccuaggagucauggguaccuacuacuggugggguucugggggcacacagcacaacacagccaggaagcagggcauuuccaccagccaccaugaaaguuagugagcuauaagauagagcuagaggcagaagccccaguccugggagugggcagcagagucccacacacgccuucuucaauagccaguuccuaauggcacugggcacagaucagcagcugcuauguccacacuuauuaggguagacccaauuugggggcaacuuuaggagaugcaggguugcuuuccccugagaacccaucccaacugccagcuguccaggcagccauucuccacagugggcagaagaggcgaugaggcuugcucagucaccauggggacaagcuuucccauccaccggguagccaggcucugaaagugggcaacaacugucaccugguccucuaaucauagacccuacuucagcagguggcaugaggcccaguguccacugcugaaguuuacaggggaccaaaagcagagggagugccuugaagacuaauuguuucuccugaucauguucuaaauccauacugccccauguaagacuccuaaagggugcuaaggcccaugucucccuuuccuauaugaucuagaggccaccuucaggccaaagcucagccacauaggguucccugguaucaucccugacccucacauuaucauguuacagguauagaggcuaccacaacaggauguuggacaucccgacagacugucucugagagcuuccuaacaagcugggauguccaacaaucuuaggaaacaauaaaaguauaaucggguugcccaggagguaccucuugagcacacugugcccccaggucaaggcucaagaccuucugccccaaccaaauucccaaagcccuacuaaucacuuacugacacuaggucuaaacaggaggcagauggggcagagugaggauaaagcaaggaggcuuggcccacacuagugggcuagcccauucuugggcccauuaucauuaggaaaaauccuccucagauuggaggcuucuaggccucaaccuuggaauaaaggcuacccacccacagugggaggagagcaggcccuguggucacuuuaauuuacauguuucgcuggugcagggcugugugguacugacuagaguuacaugcgguuccggugguuuaaugagcugccuccagcucugagacccagcuugcugcaagcuggcaaggugggggucuucauacccugcccacucccuuccucccugccuggguguucuagaggucaggaggugaacauggggguucaguggccucccaaugccugguagggggcugggcagauggcgccaggauaugcacauagaccagcccaggaaaucccugcccagaauugccucaucagcagauucaaaccaagcaaauucaugcuaucccuuagacgccuccaguugugagccagugccugacagagagaaggcagccugggugcucuguaagugugugccugcauaggacagggggcuaugauuuuuuauuucaugaauuucaaacuagguggaggucacaaacaccagccagcaacugagaagcauggugacaggcagggguggaaaugaaguaucugcaacacuggggaaagggggcagucagagccucacugggggcaggacggauagugucuuuucauuaacagaagucagcucuacauagcuguucacagcugcccugucuucccucacccuguugaguuuccccagcuauuuaggagaguaccucucuauuccugcuaagacuucuuuuucccucucaauauuuuaaccauuuguuuccauguuucgaguuuuauucauucuuuucuccccuuuuuaaaauuaauuaauuuauuuauuuuuguuauuguuguuguugcuauugcuggggcagagucucauggagccugggcugaccucaaacucuauguagccaaggauaaccuugaccuuccagugcuccucucucucuucaucucccagcacuaggaucacagguguguacacugugcacaguuuauacagacuggagauugaacccagggauucauguaugccaggcaaacacuagcagcccuugcaguaaguucggaucagagaacacccacaucugucucaauaguguaaggcaugcauguccuuucuuuuaauaggagcuccaugggugaucggcuucagaagucuuccauggguccucuaaagagacagagaauacccacuaucaggcuccaaaaucacaaugauagcuugaaaaccugcuccccauacaccuugccacuccuguccuggaaucugggcuuuaagauuaagagagucagucucagucucucucucucucucucucucucucucucucucucucucucucucucuuucucucucucucuaacccagccccccuacauacacuacacaauugcuccaccccugaucuuguggacauuuuuuucccuuucuggaauguucauuucuaaaguagagcaacccaacaggcauaacagcccuagaggaggguuuccccacacuguugccccugugcuaaguagagaggugccagucccagagcugugcagccuacaggcuuagaagcugugcucuggguuuguagguggguuuuuguugggguagcauggcuagggauaauagcaacagucguuucaagguccuguuacagauucugaaccacuuaccugccuauguucucugacccugcaucuaacucaaagacuauucugaaagaauugccuaauggcaucugugaugcuuaggguugucagccugacaaaaucuagaaucaccuuagagucugggcucagaguauaccugugggggccucucuugauuauguuuguugauguggagagaccuagguugucuaggugggaacagcgagcaggacaauagcaaguacuucuucauuguuugcuucuucugaugugacauagugugaucggauguuucaggcuccugcugccuugacuugccuaccucaauggaccugugaggcaagauaaacccuuucuccuuugucaggguguuuaaucauaacaacaggaaaagcuaaucccucauagucaccaugguuaacccucuuuuccacauaccaugugauuuuucacaaguguuaugauguaugcugucuucauauuaauaacuaggcuucguccacacaaacucaaccugcuguggccugcaagucuuguucucuauuuuugcgugcaauuucuuugcauaguuuuggcuauccuuuuuuuuuuucaacuguccauuaugucuucuuuacuaaauguacuggacacaccugcuuuuuguuaaaaaaaaaaaucauaguggggccauagggucaccaguaauaugcuuaucuggcaugcacaaggccuugaguuauaucccuacuaccacaaaauuaauucuuuuuaaaagaauaaaacccuauauauuaguccucuacuuuuugugagauuuugcauaucuucuuuuggaagaugaauuuaggacauuaauauuuaauauaaaauugaauacaccugacuacauuuccauccucacuugucauaugguuucuuuccuugacccccuuuccugggagcugcuacguuggucagcaccacccucccuccuuaucucauggaagaggacauuuuacuguucucuuccauucuaccagacccuuaaauacaucucuuaucuaaaaaaacuuuccauagcacugauuucuugagauuuucucuggcaagccagcaaucuguguauggcucuauuucuuuugaccuccaucaucaagggcucuguggagaaaggcacaguuuaaaacaucuugucaaaaaaggauggaccaucuagagacugccauauccagagauccaucccauaauaugccuccaaacgaugacaccauugcauauacuagcaagauuuugcugaaaggacccugauauagaugucucuugugagacuaggccggggccuagcaaacacauaaguagaugcucacagucagcuacuggauggagcacaggaggagcuagagaaaguauccaaggagcuaaagagaucugcaacccuguaggugcaacaacauuaugaacuaaccaguaccccagagcucuuaacucuagcugcauauguaucaaaagauggccuagucggccaucacuggaaagagaggcccauuggacaggcaaacuuuauaugccccaguacaggggaaugccagggccaaaaaaugggaauggguggguagggaagugugugugggggggaggguaugggggacuuuugggauagcauucuaaauguaauugaggaaaauauguaauaauaaaaaauauuuaaaaaaaaaaaaaagaacgucuugacaaaggccaggcaauugaugccuaaggcucuguggcucucauggccuccacccugaaguggaagcgacaagagacaguacauccacaagaauuuaugcuauguacucauaaaaccugauuuguauagacauacaggcagagagggccaaguucacagacuucccgguuccucaucuucuggugggugagcguuaucagguaaaugccaucaacacaaauuccugucaauaucccacccucaggaugucaguaugugaccguauuuagaaacagggucuuuugcagauguaauuuaugaugaagcaacaauagcaugcagugugcuccucacccaacaugacugacagcuuuacagcaaagggacaguaaaauccaaaaacaaugggagaagggaaaccaagugcguaugagggcagauguguuuuuuacaauguuuuuguaacagaacaucaaggauugccaucuuccagagaccaguccgggaauggaauggguucuucucacggcuggaaggaaccuacccuuaucuuugacuugcaugcuagaaagaguggccccuaaucagauguaagcugucacucagaccaucucagaagcuguaucucuagagaugucucuuccaucaggccagaaaugacaccaaaucaucuuucuccuuguaggcauauuggcccacugcuuccucacaccacagugaaaugugggcuuugaagaacaaacccaaggcacugaaggcuagcaaggccccagguguacugcucuguccagacagaaggggagcucuuaaccccuauccagucccacucugcauagaccccugagaaugccuuugcauauaggaucaaccccaguuguccacccugaaaucugugcuaauuugcgggcaguggcccaauauugcucauaccugaacuccuagucaucuucacaugaauuuaaagcaggucucuaccucugccaggaaaguuaugcccaucucuaacccaguuacgugggguuuuacucuuagauccugacuucacuaccaauggcugccaacccccauggagagacauccaaagaugcgugccuuaacugagucuuggaugcauuuucauguguagggagcccacacuucuaaaacuaccucgaucaagaauuuccacaggacuaggaguuuagugaagcugagacccucagggugagcacccuucaccauagcugugggccuaggcaagccaguugagccacugccugaauucuaucuuugugggugucuagggacugaaccuauucaggcaggccugagacccacagggcauggggaugaguggaccaccugaccacagguuguucuuuggcuuuuugagcaugugguggggacacagugcuuguaccuggcuuauucauuguccguugauuugcacauagucauugugcaaauuuagacaucuuaaugaggggagaauuuaaacaguacuucuucuuccugucaugaauguuuuaagggacugaggaaauugugcacgaauuugcuguuuuaggagaugguaagucaacaacuucgggggaaguauacuacuucagggcauauguuuacacaguuccugggagauguaaaagugaccuaccaaggauucugagugcucaucuuuucauccuugaguuucauuccuuggagaaggggcgacuuccuggagaguccagcaaagguccacucucugcccuuucccccguguccugccaaacagggugccugcaagacucuuggaugguagacagcagagagcauggggauaggaaaggagcaacucugaugccauaguuaagccugaguccucucagagcucugugggugggacucugaagaggaugucauguacacacacacacacacacacacacacacaccaaaguuaagcuuagaaacacccccaagauggacuuuuuguguuuuuaagaugggguauuguuauauauagcccuggcuggccucucagucgguauaaagcccagcuuggccuagaacccauggcugucuuccugacucagucuccuaagaacuaugugcuaccacacccagcuucaagauggccuugucuuuaaacucaggaugaaguuccuuugcucuuuggggauucgaugcauuccaggaugagaguggccaaaauuuggccaaggagaaauucaaaauucauggguccaauguuuacuaauuuaugucaaaaaaaaaacaaaaaaaaaaaaaaacaaaaagcaaaaccuuuccugcuaggaaaaaaaugcagaugaaauuaauucgugggucugucuaauguggaaaagagaaauagaagacauuuuauacaaaccugagugaaggagcaggggguaccucccucaccgacucacccucggguaccaaagcagagcacacggcaggacaauuaggacugcuccaacgugagcauagacguaaauacuugacuuagaaucucggugauguauguuuauaggcauugugauggacauggcuuugugugacaaaugcgagggguuguuuuguucuuuacagaucaaugagcacaacucauagucuuagagaggaaaagguucaacuaucucaacaggaaaggcauuggguaccgcccaacaguaacugauacaguccccaggcccuggagacuaguaaaaaacaaagaacacacccugauuaccaucaccagcaaccucacacccgucaguuuuugugcuaucagacaccagcccuaaggaccacuuggccccucucugccaaacugaaugucuggugcaagguccccaacuggugccaugaggcaaaaccaagaaauaaaagagauguggaccaaaaaggaaaagugucaaugguuuuauuuagguugaccagacaucuccauagagaacccuaaagaaccuacagcgagcaaacaaagcaaguguguaguagcuuccccucuccuagucauaaguaaggugaacacaagaaacaaccgcuauccuauagccgaacaacaacccccaaaauacauugaggacagcaguguccuguaaggagcuuaaaaccacaaaggauaaagaagcagccuaaugggguggggcccuggagauugcauggcacucacaaccugcacugaagauucuucaccagguagagagagaaagcacagugcaguucagauggacaugaaacccaugcaucuuuaccccucccucccacaaugccagucaaaaugccaagagggcuggguauugguuuugauuugggauuguuguuaaaaacugacagccagauucucugauuuuuccugagauugugaagggcccagcagagcaucacacuuugaaaaugaaccaaauuggaggauuaacaaggccugacuucaaggcuuagaguagaagucacagcaaucaaggcugugcuggcacaacagcuuacaaaguccagaaauuggagccagugcauggccaacugauuuucaucaaaggcgccaaagucaucucaugaaaaaaaaaaaaaagucacagggacaugaggguaaccacaugcaaaagagacuuagucccgauucguaccugucuccaggcauaagauuaaacuuggaaggaauuacaaaucuaaacaagaaacaugaaacgauaaaguuucuacagaaaacaggagaaaggcuuuguaagcucacauuaggcaaauauuucuuagacaggacacaaaacacaugaaucuuacaggaaaagggggcauggaaaacacccugaugaaaugaguucaucaaaauuaaaaacugcuuucugaacgaucuugcuaagaagaaucaaagacgagaccaggggaggaaagaccugagcaacacagauccccgugaaagacagagucauggacaccaucuccucaauuagcacagaagagacauagaaucauuaaaacaaacaaaccaacagaaaagcuacgguccucugcaagagcauccagugcucuuaaccacugagccaucuguccagcacccaaagcagacaauucucagugcuagugagaacccacaguuaccaugcuggcaccuaggauggugauagcagucaggagcagccaucuugccaaagggcuuggcagcuucugagcaugcaguacucccacucagggacaggcagggaauaaccagcgagcaauagaggcaaguaacaacuccagagccugugugcagugcuuguggcagcuuuaaucauaauaaccaagcccuagagacggcucagauguccaucagccuguggacggguaaacaagcugcaguacacuuuauccuuuccaaaugagagaagaaucaaccagaacacagaccagaagcagacgggccucaagugagucugcaaagugaugagagccagaccccgggcuucaugcugcagaacugcguucucagggggacaggacaguucccaggugcaggugcagggaugggcugugguacagggcguacagagcgugugaaggaacucaacuuggccuaggaauuugccagaacucacugaaccggacaucucacaugagagagaguuuugcugcacauaacuuaaacccuacaaagcuaaaaccuaagacaagaaaacagaaaauaaauaagagaagccuaggagaugggugcaucacugguuacuuuuaaaauguugaaagaggagcuggcaagauggcucgguggguaaagacauuugucgcacaggccugggaccccgaguuggauccuugaauuccauuaaaagguagaaggagaaaaccaauucuacaaagucuuccucuaaucucuguggguacaacauggcacgcaugcccauauguaugcauagacaggcacacacaauaauaguaaguaaaauucuuuaaaaugccuagaguuuaagugcuuaaaaagagaaacaagcuaacauacuggagacuuuaaaaggaaccccaccaccaccaccacauuagguuggcuguagacacucaucugucacagcucgugagcacugucagugcuguccccagcauggccacuaaccuuccuccagcccccucccucagccucugcgaauccagcccagcugugacuccuucagccauuuuccuuggaggagacagccaaaugacauuuuauguugggcuaacuuuacuggucucugcacuugucacaaacucucaagugcagcugggccacagucaugucucugggccugguacccaagacaugggugccgcagacuaaagggggugaauaucacccuguaucuguauuuugguccccagcugaguaugcacuaugcacuaugcaagcuguacagcagccaaaagagcucaauaaggaucacaaagaguuccgacacucugguaucugcugcuuuggccucuccuaggcccuucuaguuaauccuccagugacacugaaauggagaccaggaggugauagcaagaguggagaacccacaaaaugcaaaaacuacaaccuguguugugguuccucccuuguugaagucaagcugggccaggaagucuguccuccuguaggacagggcugcuuggaggccaaaauccagagccaaccaggguacaggguaaagcuagcuucacugccagcugugucccagccugauaccucugaaccuugauagcuuacauaggguggccccuacucuaacauugcugaggguaucaggaaccaugacuccuccucacuucuaaggucugucccacccaggcaugcccacugccuucccuaauaucugugggcucaauaccucccagugacuauccuagggcucugcuugggaacaccagagucccugugacucugcagagcauacacugggugucaggccaccagcccacaugguuccacauucuacaugguaggaugcacagggucacauggguauauggcaccauaugcagcuacuuacauccaugccccauaagacaccccaaggccuaucaggccccaggcagcuggaaugcagcagugcacacagggccucuuuuuucuccccaaguacugagauggaggcccacccuccuggcagucacauuggcaugguuacuggaaguaucccaagaccuccggacuuagacugguaggcacuuugccuccauccugucucugugagccccaagggucauagaucaccucaaauuuucagguggaaaaccaggacuccaaagugcucccaaaggcaggcaagaguagaaaaaagauggcagacugaaaaacagauccagccaacaagagauccagguggccaaccaccagguguccaggcuacggacaccuaucguggagacaacaucucaacacgaaagcaaucugccucccugugaucugacaccacaggcucacgguacccaacaagaugccagggcucgauaauggucacuacaauguggaagaccaagggguucaaaaugaauauggcugcuggaaucagcccuuccuugggagaggagcucugacaccuagccuggagacagcccugcgauuaggacaccuaguucuuucuggguacccaguaccugucacggaacauccuccaaagugcugguguuugagccauaacagcucacaggaguugggguaugggcaaggaacagagccccuuuguucccuccaaauauguccucacuuuaccccaaguugagaguggcacuuccacaucaggugggccagcucucucucccucuccccucccuccccaucccugucucucuguauguguucacauguguguacaucccaaguucauuagccuauguccagagcccagagcucuuaugugugugcaagcaaucucuucuccucucucucucucucucucucucacacacacacacacacacacacacacacacacacacacacacacacacacagagucaaagagugauggaaugagacacucccccuucaaggggaucauuguauccaggcuccuccuucauauaccugcaaacucugauuaagaaaaaauuuccccaagguauuggcgaacucugaagaugucuuccagcgccuggccauuggcaaauguguccccuugggguaccccaacuacaucuacaagucuuaaaaagaaugagaauccaagcaguuccagagacauuuugguuacuuaggaauuuucuuuguuugaccugugauggucugaguaaguauaagaaugcagucgguuacaugacagauuuauguaugcaugugucccacuccaucucugauuuccuccacacagccaaauuugguucugauggcgaauguaaaccugucagaaucagugcaagccuucucuggaucccuugaguccagccugguccaggugugugccugcaugaugcauguaggcagugaccuucgggacagugauguucauaaaauaaacaaacaaucaaaaaaaaaaaaaaaaccugugccaugccacuuaaauucuacuuacaacuuucucauggagaguaguugggugcagauggcaucaggauaaagcucacuaaauacaagaaaauuauccuaugacaaccacacacaagguagggcaugugcaugaacacacacuaaagaaauaaaucuaaauuuuuaguaaauaaagaaauuaaagaucaagauguguucauguauuaccaagaugcuaauuucccccaagcugaccuccagauuuguauccccaauaaaacucacucugcucuuucauaaaaaugagcaagcuauuccuaaaaguuauaugaacaggcaaaagacccagaaauagccaaaacacuuaaagaauaaaacugaacgucacgaaugacuguuuuugcagcccugucucaaugcuaguaagcacagaguuuggcauuucaggaugacaggucagugacucagaacagucuggcagauucauucuuguggcacacuggacuuuaaaagggauggcaggagacucaggaaguaaagaauauucguuccagaaaaugcuacucaaccaauucagcuucuacauaaagacacauagacugccagccacauuuaguacaaggacauggaaaggacucuggaguucuagugccuaugcaagcaugaggggcuaaguucaaguucagguccccagcucccaggcauggcuacaugugaacucugaccccaggacuaacagacugguggauccaguggcccucuagguggacuguuuagcuccacgugcaaugagagacagaacauagagaacaaugggggaggguucuaacaucugucuaccucuggcuccacaaacaccagaaugggugaguaccccaucacguguacacacacacacacacacacacacacacacacacacacacacacaagcacacacucacaugcacacacacacucacgucacaucacaaaucuaaaacuauagaacgacaauaagaaaauauuuaugucacacuuuauauauauaugauuacuaaguaugaauuaaaagguaauuaaaacaacagaagauauaaauuugaccucacaaaauugaaaauuucuuuuugggggugauaggaaugaaaucugaggccuugugcacaguaggcaagugcucuagaacugggucacacuccaagacccaaacauuguuuuuuuguuuguuguuuguuuuuaaaccacacuguuaaauaaaugagaaggcaagccacaguauggaagaagguggaaauuucuaaggucaggccuggcuucagcuccaggcucugggaacaaccgcuacguccagggaacugucuguugucaauaugaagcaaugagcagggaucaagccucauccgugagcaggaagagacacagccaugguaaagaacgcaauguaguucaguugauagugugucugccuagcuuguaggaggcccuggguuuaaucuccaacagcacauaaacuggauguggcaaaguagggcuguaaucccagcacugaugagcugagggcagggggaucaacucaagaucauuuucagccucagagggagcuagggaauagaaccacguuaagaaaugaaagagaggggaagagaugaagugaggaaggaaggaaggaaggaaggaaggaaggaaggauggaaggauggauggaaggaaggaaggaaggaaggaaggaaggaaggaaggaaggaaggauggauggaaggaaggauggauggauggauggauggauggauggauggauggauggaaggauggauggauggaaggaaggauggauggauggauggaaggauggauggauggaaggauggauggauggauggauggauggauggauggauggauggaaggauggauggcuaccuuuaaugugaaagaaccccccaggccuccagagagcuccacagcacucagacacugaccagcucccacucugcagaauuaggcuccuaauccacgugugacaguucucauccaggcuccucgugcugauaguuccugaauucaaugugcaaauggaacgggccccaagggcaggggugucccacucccggcaggcucggauccaagcacagcauucaaacugcauaagugcgugacuccaaaguaugugcagauaagagaagugcacacaggucaugcacaugugugccuucucacacaucugugcauguauguguggauguguaugccccacccccuaccccccugaacgugcauaucacaacucagcgucccagcugugcucggcugccuuuucuuccaaccugcuauuuaacacuccugagcaaguguggaagccauuguuacuacucacaguucccagccucuuuugcagaccacaagugcuggguccaccugcacucagcccccagagccacaucucccgagaagagucuguguuauaaauacccacgagaacacaaagcuuugacaccagaggccagggcuugcuuucucaagcaucgcccacauaggggaggagagcacggccccugguugccacgacccugaagguacuugaggacauacuccauuucucaagcccagcaguccagacacacugagauggccucugggucagagcaccucccacagcuauugaagaggcugccauagcccagccccagccccagccccagcccuuggcccccaacccccaguccaaaaacaccacuugcuccacccagagaccccagucgccaugcagccuugucaccaggagacagacagucuacaggaagcugcugcuggagccuucccucaccggucagcucaaaaaagcaaggggccaaggggccugggugcucaagugugccucucgacccugagaggcugcccccagcccccucccucccucccaccugcgaagucacacaaugacaugcuucaauagcacacagcccgggccucugguuuucguucugagugacccugggaggccaagaacgugaugggagacccgucugagugugaugcccugggggacacucaggcccccagcccucgccacuuaggcagcccgcuccuccaggcagacagcuggcggacuccaccgagcugugccccucagccaugaggcccugcggcucauccucuuacccccaacgcagcccccaagcagcccccaggugccccacugcagagggggugccagggcagccuacucagcccaccccacuauauuaugucagcuguuagccugcacuuaaagcgaagugcuccagcuggccagggucagauguaaaaacaagggccuaacaaaacccggccacccccccccccagcuacucugaacuggagacccccaccgcaugcagcacucacugaggagacucuguccagccuugggcagagcauaaaggaaacaccugucccuggccggcacacucuaaucccacuaaacccgaguggagaaccacccccagcaggcagcucccaccccaggucugacuuuugugcugggccuaaaggaaggaugguggagaaggaaacccucugaucucaggaauggaagccuccuugggccccagccagauccaggucacugaaagcacagugccugaugacaguaccccccuuacccucaccccaacacacaccccuaguuccuggagucugaauaggaaccagccugccuugggguccuuggcuccugaacgguuguccuccuuuagaaggacaggaggcuccugccacagaaagaccuuuccuaccgacacgggagccccauguaacccugccauaagccaggacccucaaauaaccccugggagccccacacuuggccacccaggcugauuuaucacuacuuaccaaccuggagcugagucagcacaauuguuagaaaagggcagggggaguagggggugaagagaggggaguauaagaccacccagauaccuggaggcccugggagggggccaggaaacuauguacacacuacacaugagucacgcgcgcgcgcgugugugugugugugugugugugugugugugugugcucgcgcacagagagagagagagagagagagagagagagagagagagagagcauuauccugaugcugucucagucuccccuugcagaucuccuaacugaaugguacagggaaugguaagcucccaggaagguagaucuuggggcuaaaacagaacuguagauuuggggugggguggaggcggcggggggggggggugagagggucgcucccauugauucuguccccaugacaagauguaguacaggaguggaaacugaccacacgcccacaagggaacagugagagcuagugccaaggggucuucuugaggccaugagacccugcugccaagcacaugcuucucuuccccuuugggcucagagucaccaggaaaggguguggagaagagccuggagggagagaaacaggaagcaggcccugcaaacccagguaggccauggcuuugcaccuacagagccaaccacaggcaggcccugccugcauucgcgccacccugccuggaagccuccaacuaauccccacaugccagguagcgaggaauggguggcauccuucuagaagguucccaccaugucuuacuguccucuccuucugccccaggcuccucaggauuuuauccgguucugaacaaaugugcuacgugacgauucuugccacugcacacggcucgcucugguuucacagaggaugcagacaccagagcuauguccugcaagacccuccacgcuaaggccuaggaggcucaggaaaucugguggcagcugaggaugcuggcuuuccugcucuuacagugugcaggccuuguaaaaggaagccgcugccuccagggcagggugauggccaguuuaaaccccauaaaccugaggaccuaggauccauggcuccuaaacuguguccacugugauagagaaggccugaccugccauuuccacccucccagauaugucccaugcauccuacuuucaaaaauaaaagcaauaaaaggaaaggaagagaaaagcuguauuucaguuuacaauuccaaguuacaguccauuguugcggggaaguccaagugggaacuucagucagagucgagagcagagugcaaagaaugcauacuugcuugcuugcuugcuugugcucagcuucaguucuccccuaccagucagaccaagagguccuaccauccacagugggcuucccacaucaauuaacuuaguuaagacaauuaccccacaaacacacccacagaucagcccaaugcagaccaucccccacugggagucuuuccaagcaauccuagguuuguugaguugaccauuaaagccaacuauuacaguaacgagggagagcgccuucuucuaggagcauacacugacuuucuaaagauaagggacagggacauagucccagcaucuuuggaaagccccacaagauguauuuaaagagagagaaaagugacacagauggaguagagaaaaccaccuaguggccccaggcagagucaucugaaguggcaugaacuaagaacaagugucgugugugucaacauggaaauacagaagaaagacacugugaaaccaaaguauccacaagccauccugagccgcaaagaccagugugggacagugcagcacacccaugugguccagacacauuugcaacuuaagugccauuuuaguguccauggaucauuagaaaccaagagggucaggaguucaaggccauucaaaguugccagaugugguggcacaugccuccaaucucagcacuagggaggcaggggcagguagagcucuuugaguuuggagccacucugaacuacacaagguguugucucagaacgacaacaacaacaauaaaauaaagcauaccagcaaccaccauucugcacauucuccuucugaacagaaugaggauuggacaacuuucucgaaggccauaaaacacgugcuguagguuuuaagggccacacagucucuauccugguuuggaaaacaaccaaccaaaccacagaggaguccacaagccugcuggcuaugugcuaccaugcccuucuuagccccuagcaggcaggguuucagcacuccagccaaccccuacauucucuagcagcugaaauggagaagauauugggauccgcccaccguuccugccccagcucaugggcaccauaacagcaugugaaagaugcugggcagguaggaggcaaaaggcuuugcugcgccccaacauagcaggcauuucuagcaauccagcaggacauauaagcucugugcccaaccagugggacuuuuuuugcacagcuuggagaucuugagguccuuagaagcagcccagccccauccauucacccaugucacccacccauccccagacuaggugugacauccucccaccuagacuaagccacagagcagcugucuuccuggagagaggcaccaacaguucgggagaguacccccaagucccccaagccucuggaugcccugggggcuacaagcagagcugagcccaugucuguuccauuauccccaacagcccuccagggacuacacgcagauggcauguggcuuccaugucuacaggaccccaaggugugaguucuggguaggaacuugaagcccuugucccauuagcacacagccugaaacacaguuggagcuucacagcuacucucuuccucaaugaauguaggagaaaacaacucaaucaaaaaaggugggcaucucguggggaauaucuuuuaaaguggcaaaaugacagcuggggcaauaggaaccuugugugcugaggacguagaaaguucugguccagcugggcagugauggagcacaccuuuaaucccagcacuugggaggcagaggcaggcgaauuucugaguuugaggccagccuggucuacaaagugaguuccaggacagccggggcuauacagagaaacccugucucgaaaaacaaaaaacaaaaaacaaaaaacaaaaaaaaaaaaaaaaaagaaagaaagaaaguaaguucuaguccugagagggacacaauguuuccucagaggacccaggagcccaggagagagcuggcaacacuacuggguacacgguuagcuggacagcaucucuaaagagcccugagaacuagaucucuccaagcagggggcuggggccccacaggaagucagaucuugggcuuggugguggaaaacucaagcucccugcuggucuccugaccuugugcugcugcagcagugacucaaccugcagaagucuucuucccucggcugcaaacuagucuucagggacagggauagaguaagcauacugacucucacgagugcagcuaacaggugugauauuaaugcccccauaagagaucucagacagaacaacagaccaggcagugggacacauggccaaauacagugcaagcagcaacgguacacuagguacaacccaaggcgugucucagccaaaaaaacagaacacccgcugugacuccaagcaacagaagauggagagcuaagagcaagcucuacaacagauagaccgugaaaacaaacuaaaccaaagcaaaaccuagacacagcaccaagacaugaagcuaggcgcugaauuuaacgccaauaaagucuccacuggcaggaaagggugugaaaacgaaugcaagaacaugugaggcccugcugagugugaacgagggucugggaccuggggagcugacccuguuccacuugaaaguaggacccagcaagggcuguuuuaagggcucagagagcccaccggaucucauuuugccccugggaaacugaggccugccaagagaguuacagaaagcaagggcgggccaggaaggguccagcugcagggaggugggucgccccugcggggccagggagccucacaguaagggaggaaacuggagagaugaccucaucccccaggccuccggccgcgcggcucacggguuuuaaccgcaggcauggcgggacaguucccugguaugcgggcuguggggcucacggagcuggagugugugcuaggacuuuuucaaugcagcugucuuugugugggauuugaaaacaagcugggguuugagagacaaaaaacagcccugcaccugggccuggccagggucuccuauugcaaggagggguggguggguuuggcggcgugcaugcacauucagcagacuugcacguacacggcgugcacacacaugugcgccacgucuacagauguacauacagcuugcucuagauucagaggccggauugggggcugggcggcgggaggggggguguccuccuuggggccacaaacaaguuucaaggccaagcacaccuauaacaccccugaucaaaguucuagccagacccuggccuggcagggcccaguuuucuccaagaacagcuuuucagacccacagaauaugccuggcucagcagaaugcuuaaucccucggaggccgccuggcuuccuuggcccuggcugagauaacagggcucuggcaccacgaaagccaggcgcugaggcaggaguaccggcgcugggguuggggaacacagccucgcgugacuucuucuccaccauuuacccaaugugcucccagaaucccucacagagcucccuugcccugggcccccguggggcaccgcgggcugugguuugggcucccgcgcucggcacucugggcucggcccaagggcugcuggaauguguguuacaagagcgccaccuggugucuccacagcucgucagaggcugcccuguccuuagcucaaaggcugaaauaaacaucuuuguuuuucacccaacucccguccacagcauguagcagcugcauucuacacuaugucccccagccugaggcuccaacagccauucucacccuagaggccuggaauccacaaccaugauaucugcgugggccuaggacacaugcaccuuucggaggccaugagccaucugcaacagcacacaacuccuccuuaccuaacccuuugaccaaucaucaugucuucuaggaaaauaucaccacccuauauacaagguccuuugagccauacacuucuucacugguccauauguccaggcuggacacacgccagccucacaucugcuuccccaacaccauggucaugacucugaaguaagccacuagacacagccagcucaaauccuggaagguauggccucuaaaggcuagcaugugaggauacagcuuacgaacauggcaaaguuggggacagacaauggcucagcaguuaagaucccuugcuacgcuggcagagguucuaaguuugguuggguacgcauguugggcuguucacaaucgucuguuacuccaucucuaggggaucugccacauuaucuucuggauucugugggcauuucgagcacacacacacacaggaggcggcagggagagagaggcuuuaaaauaauguggcaaagccaaauggggagguuaagacuaaagccaacuauacuuucaucccuauacuuuacaguuggagacacugagguucagggguaucauuguauccuuagggggcaugccugggaacaagacuuaaaaagaaggggguucuguauccuacuccauauauacacucugagcagccgggguguugagccucccucugcauaguagaaaagugugaaagagaugugagccuacucaaagaagcccaucaucacauccagguugcccagaaaagagcagaggggaguuccagaagggagugugcagcguugaccggaggucaguccuaauaguaggaaagcaacccugcuggauauauauaguguuugugcaaagguccugaggcaguugggagggagagauggggagggaagggagguuuggagauggggggggguguaugcuuaaaugugugacacucugaagaccaugagggagaaauuggaaauuaucccaaaccacccagggagcgucugggacacucagguuuuuguccuauaaaaucucuucuuagcuguuguggggcagggaggguccagggaacgagaaggggacaaaagagguaaugaggucacugcccucacagugguggacaaagagccacuucugggaagcagaacagacuggggaggggcugccuugggaguggggacccgcucacacugagggaauggaggaggggugggucccacccacgccugccuuugcuuuaggguuguuggaucuguguucacaauuccaaaaguagccacaagauggcaagcaggccccagaaagagccuggccugagggaggcagcagaagccaccaggaaagggagccuaagccaaaaauuacugggguaaccaccccaagucuggagcuaccagaugagaaauggaguaggugcauucacaggcccacacacaugugaacauguguugacacaugaacauacaguaccaucuacacguaggcaugaacauagcuacacaugaagauacacaauacaaugcauucauucacaagugcacaagaauacacaaaaccaagcacaaggccuaauauggauauuacacauguaaauguccacuuacacucucacacaugcucagacaaaacacacacuuaccugaagacacagcuauauauaggaauguguccauuugaauacaugggucugugcauaugugaauacauucacguaagugcauauauagacuuguacuugggaggccucccaggggaauguucugacacacaggcccuucucagcauaggagccauuuuggcccaggcucuccagaccaagucccaaacuaagaacuacagaaaccuaguucucuggaaaagaaccugggccauuccccucagcaguaaccaggagcuauguccucucauaacauauccagagacuugaccucauccguguagcagccaccucuguacugggcaagggaacaauucugacaggaaccuguggggauagcaucacacauaaaacuaaggaacccagggcccucuuccccaccuugguucuauaagggaauacaagggccaugugaaauuccccaaccauaucuaagagcuccaucagacaggucuugaaagauuauacucugggacuaaggggugucauccaggaaacugaggcuaaucagcuaacacaucacagagagaugccagcuaagauuugguggcaucuuuccagccacauggaaccaacuagggaauaggcagacuggcuggauguugcuucuggaaaaacuugaggcccugaccccgacuugaagcccaggaaccauagguacaggaauuggcaccucuguuaaguguggggacaucauaggcuaaggcccacauugaaaagucccagaaaacuucagaagagaagucgcccucuagugaccacaacuuccaaucacagcuuguuacugucuguuagcagcugccuaaaccacaugugccuaaaccacagugacaucccaaccccagagguaggcacacugcuggcuggcaccacagccaucauaguuaauacuugguaccaggugugcccuggauugaaugcauugacuuuugggaugggaguaaggaacaagaaauuugccaggugccccugaauuuugcuacagagcucacuguaggguaugaacccuccaguggccuguagagaacuagguacuaccaggcaagccucauguuugauuuggucuacagugaaaacacguguccuauggaguuuugggaaagggggccguugggaugagcagcagggauggaacagagcagugccugccucaugcuucccuggagacuccuaaaagccauugacaguaucacacgugaauacucaaacuugaggaagaaggcacccaccacacucaggccaggaccagagagcucuauaauccaggaaaaggaucuuuccuguggcucagucucuagaagccauaaaggaaagauaaaguggacacaagauaaaaggguguggcugagcagccaccacugugcuucaagacuuagcaggacaagcugcccagcugacagaggcuguauauagauaacacugagaaacaccuaagacccccugugcagaaggugaagggcagcuaaauguggcccuuguucccuguaaggguagggaacaucccaucacagaaagcaaacacaagugcacccaagcagaaagacacuaggcugcaccauucugggcuuuaccaccuguugcuaucuuguccccauagucccagccaugcuggccuccacccaucuucccagaagcaucauagauccaucagcauugcuucuaaaggccacaucuggcccagcagagaauggugauacauggggugucuacccucauggcucuugauugcccucacagaacagggucugccucaguugcuucaguggauccuagcccuguuucagggacucauaucuaccagaucaacaguaccucagccccucaaagcauuugaguucacacacaacagggcacccugaagacacaguuggcucuucacagaguucagggucacaugagacaguccucaugcccuucacagaguguggaauccuaaaagacaucuaagccucucacaguacaugggucccacaagacaguccccaagcuccucggaguguagcuggaaccugguauuuggaaauuccauuccucaaauugcucuauacugggacagggcacacacucaugucuggccugcagagagcuauguacaaagguaguugugguacccacuaggacugccacgauggccuugccagaaaugauacaugaaaguccccugagcugaaaggcccaccccagugacugaguuagaauugggcuaggacaccagcagggcccaugagucagucagcaauggcacacacaagaaccaccccaccccucagugccacuguacccauguccuccuguccucucucugggccuaggucagaaauuccccauacaaagggacccuuucuauucuuccugcaucuucaacacacggcccaggggccugauaggcauggaugcaggggaauugcccugucugauagcccaguagcagggugguagagaccaggagugggugguucuacccuucccagcccuccuccaccucuuccaguugcagugaugacauuuacugauggccccgggugccuacauaccauccagaagagggucccgguggccagagcggcauacugcucaauaguggacaggacacugaagaugaggcagaccagaacaaugaggaagcugugagacaggggacauacggucaaugccugauccagcuucccugccaccucccucucacccaacaccccacaugcaagaucuuuagugcuggcauuuccagguauuccuuagcuaaugcacucaaacaugggauccaugggaugggaaccauuuaccauguuaggacugaccccagauuggugucucaauacacacugaccuugaacaugccacacugugccaucucaaaagcagccaauacucagggacgguacacagccugguggccauggccuuagggacaaugggucaguauauccaauuauucaguauaacccccaguauauccaagaaccuugguguacaauugaaguucagaaguacuauuuuuacaaaacaggagccuucauccccaggagugcagggggauagagucccuuagccaagggggagacacaagaaaggaaggccaagcacagccugaaccugugcccugaggacacccagaagucauagcuuuuacacugagggcacaguugcugccugcucugauuccaagggcacugggaagauaagucucccuuccacuaagcucuccaucccugggugucaucauccaagguggcccucaaaguugcuuccacuuuggggagggugcagauuauuagagagggggaugcuuuggggagcuucagagacucuacguacccuccuggcauguucuuggggaucagaauagaaguggggagcugaugcauugucccagggcuacaagaggggcagacagagaagguauacacaaagucaucagggccccagcacagaccccuguccucaacaaaggaacccacacacuccaucaauccuauaucagguuuucccaguauguaaggcccagaccaccagccucaggcucagccucccagagggcacacagcagcaguagccugacucagccaccauuuccugggagaggcacaacucagaucucccacaccucuuaagauugauuucauccauuccuggccucugcagccaccguuagaggcucagaagaccaacaggcaaagccccccccauugcccccucuuaccugcugugccaggucaaagccugaagucauagcuuacuaugccucccccaagacagacacucuuugucaugcccauuugcucugcgaugcacagcacguuccagccuccuccucuuguuccuccucaccccggcccaggugccaacucuaccaccuccagaucccccacaucaugcccagugugguacuccagugguacccugucccccucuuacugguauugaggaccugauguuacugcccugucuaaaggcagagacucagguuccuacaguguggucccauaucaucugcagaaguugcuccaguacccacccugcccccaugacaccuuaaacacaacacuuauggccaaacagcucugccaaguccuagugccuacagccacgaccaggcagugagcauccucagaacaggugacuaauauagagcuugguauacagaggucuugguaccccaccacauacauaccuccauuuaaucccaaacucuuaccccacucaccacaccuauaguaaccucacaucacaguaggcaacgucuccauuuggcacugaucccuggccaacacccacaccaggauucucacauagagcacacaucugauuuggccccagcagagccuccaggugggcuucaguccuugccacuccccaucucuaccaccaugaauuccucauaggccuagagcucugacagcagccagccucuaacccuggcacccaaugcacuacacaguauuguuuccucauguccacucuccacauggacuuaaggacucccccagaacagcacgacaggacaugcagguccuccuuggucccccaguaguguuccuccugaccagugguaaccauacugacuguuggcccacaucuaucuccuggcgcugaucauauggaagccccuuguaagcugaacaagccacaucagauccucaggaagccauggcucuuauguggacacagcaaacacuagguuagguuggagccccucugcuguccauccacagauuagauguccauccaugccugcuagagaagucuaacuuuagccauguauccucaacuucuuucagagaccguuguggccuuuugagacucaguuccucgcugacuaggcucugcucucuccucagacugacucuucacagaguggggccucacuaauccaggguguguguuguuuugauuuccagcaggcagggaaguaggguugggcucaucucuaggcaaucgagaguagaugccccaccccagaccauggguuacacauggagccagagagcgacuagcaugaagaaacgcagccuuuucuggcugccccuccacagugacauagucaggcagccccuacuucagauucccaauuggaacauuagcagcuuaggucuacccccucuuggaacuguggguuguggcacagugcacagcccucagugucucagcaccuagaagugagggagugacuuaccccaaggucuuugagaagcccccaagcuccuggcaucagcacacaugcaaagauauggugaaaacuuccugcugcuucccugggugcccuaaagcuuacacacacacacacacacacacacacaccccagggcacaauguagccagguccggucaccuggccacaguuugacagaauagcacuagucccucaagaaucugacaggucacagugucaccgugcuaaaacccagcuccuauuucagagggggacauugagguuccuggagcucuugaggucacucagguggaaucacaguggugccaaugauagcucuuaauggacuuucaauucuuuacugcuagggugacaacuuggucuuucaagcccuccagagccucggcuccaauauggaauauaauagcaccagcaccugaggaccagagagcuuauguguagcaagguaacagagaucuucaaauaggccacagggagaggaauggcugucauaggccacccugcccaugucugcagggggaucagggccccagcagggcagcagcugcagccuucggguggaaaauuccaacugcuuggaaggaagguaucaaaacaaggaggcuguguagaagcccccgccucuccaguaacucccacacggcaguagggaaggccauggaugcacagaccaauccugggguagagguacagagcagauaaguccccagugcagacaggaaaccaccuaguucuccacaaggcuggcaggggcuaggcaacacaaccaccaaagacagcccaugcuaaccugcccaggaaccuugaaguuggggacaaugguggcaaucugcccccaugugcuggcugccuuuuagccucgaguauuccgaaagcuaaacaguucuucaaauauuugaacucauugggcuguccgagaaaggguuauauagcauaguuuauuuuuuaucuacuccugauaaaaugaguuuuaucuuauuugcuacuuuaucuguuccugcccuggauagggcugagagccucagagaggccgaaccaagggucccugccuuuggggagcucgugggccagaugcccaggucacccacuccugccucuuuaggacaguugccaucccuccaccguaccuccauaacccagagccgcaaggucaggcuaucauaaggugcucuccauaucccccacccccagcagcagcagaggaaacugaggcccggggaaaugccagugucccugguuacagacuacauguuccuaagaggguucacugugcaggguaugaaacagaagguucucgggaacaauacccugcuuguuccgcucucaccaaaucaaacucaucggccgugaccgcagcccagcccugagggacguccaaaugccuuaucggacaucacuucaauaucucugugcccaggugcccugggaacccagaagaagauggcauccagccaaccccguauggcugcccagcagaagguaugggagcacaaggaacagugucgggaguacggacaggccagcuauggcaaacuuggagaucucuuccauacauguuaggcccuugaccaguaacugaucuuuaaaaagccagagcugguucuagacccaugggcaaccagaccugcucaggcacaggccugauggugauacugucccaucccacagccauugaggagggcaguacucuaugcaugcaaauagcaaagggucuccccagauaaaggggucagccuagccaccaucaaauuuccagcacucaaaacauggcagugaaacaucucaagaggucucaaaccauuguaucugcauauacaaucauagugugaaguucccuaaaacuguuguuaggcuggggcuggagguacugugcacaaaaggguagaacuugaggauacuugggaagauaagccagggaugagaugacacauauuucaggaucagagaccccugggguuaccaggucugcagagacagaaggcaggauggggugccagggauugggaacaguuucagucuaaaaugacagaaaguucuggagguggaggugagaauggcuagcuacacauucugugggugagcuucacacuacuggcauaagcacacagacacagccaggccuugugucucaccacaacuaaaauagauuuaagaaagaaaaccaggggcugggggcaugacuccauggccaaaagugcuugcuucucucccagauggucaaagguucaguucccaaugccucuguuggguggccuccagcuccagaggcucugaugcccuuguuuggcaucaaccaguuugguucacucauacaugcaugcacauguguacaaacaaauuaaaaaagaaagaaaaccaagcaaauggauuugauaauagaauugaguuggcuaaguacacuggccaugggcuauaauugaagcuaucaacauccaaaggccccuugggggcagcucuccacaggccaagaaacagucaacuaaaaaaaucuaagguaccaugagccuuuguaugcacgacacccauggacuaaauccuuaugugugagcccugagccauguguuugcuauuguauguguaacgcugacuuugcuauuguuccacagagagugacuuggaaagauuccacacuaacccucacauacgcuaccuggaaagggaagccuagagggggacccuacuaacucacugccaucacccacccucauggccaccuggacucccagcugccuggcuucagguuagauauagacaugucccaggauacuggacuuuuagaggggacaauaggcuuagggauaucccaggaaggaugguaccaauagcaacugucagaugaauagaguuggcaggguuagaagacuucaagguagccacuugcucacaacacaaccucuccaaugugcugcacaagguagagccuaggccaggguuaccuccuaaagggacacaccucagugcaugcugaaaacccaaggugugccagagacugaucaguuucccuuaacuaagccuuggguggaagaaguccaggggagacacaggggagugaugguuggucucagguucaauccacuuaugcauauuuagaaguuccuggauuagggacaacaagauauagccacuuguggggcgaauaagguccaacauuguauagagcacacacagggccacguaaacagugagcucaggcuggcuauacagaccacaaugcucagaauaggagagccaccucauucuacaugcuauucuaggcuaccucaccuccucuaucugaauggccaccuccuguucacucagaucucauugggcaccuucugaagggacaguugaccuuggguugggguauaccagauagcccagguuuucacauccuuaguggcaagagcuuugucuacaugaggccacaccacaggcuucaagaauaucuuugaggccuuugaguucaucauguaaccuacgucaaaccacccaucaacagugauucucagaggaucacgaauucuuaaacaucaagaucaguugguccaaagcacauacugcugucacaagcuuacgggugcucaaccuuuugacuccauggcagcauauugucaucuauaaaguccacacagaacugugggacuaacaagcaaaaagaaaucuuaaaaucuuaaguaaguuuaugauuugugggagggccacauucauagcuguguugggccacacaaagccugcaaguugugggugggaggugcuacauaaguuaggggagacccaaaccaguuuugccucccacacaccuuaggccuauacaaggucagcccuugccugccucccugaggggccuggccucaggcuggugccuuugccuauggcuagagcuucuaggccugagauucuccugggccagccacugccuacucccugagacuacacuggcucuaaacccuuuuaggccuggcucuggccauaguucauuucauuaaaauguucugguaggaaacaccagcaguggugacuuuaucaccgaggaagugagcguacuaauccauugucuugggagcccuuaaaugugcugaucuggaaaugcaaaccuaucaggagauuagccucagcccugcacugagaggccugccucaccucauagcaccagcugacacuguucccaugaucuggccuagaaaccccagaaaagcaggacauucaccuggcucugcagagccccccaaccucugugccuaugcaccccccccaaggcuacagggcagaaacccagugcaucuugugcccuuauucuagggcagcauccucagucaucacagaguccuaagaaaugaguggcccuaccuucccagguaucuaugucugguguccuccagcccacugauugcuugaaaaccucuguucuagcagagaagcucuuggcccaguagggggacccauuggcuggcacacaucugaaagccaagcaguaggccaaaaacacugugugugugugugugugugugugugugugugugugugugugugugugugugugugucuaguauuugcugaccgagugagcaauuguuaagcugagaggaagucucugguccucuucuacggaacccauuugugcaccugcucugaaucucuagcucaggcaagcucuucacagccucugaacugggucagugcaggauacaggacaaaacccagaccugaugcuggccaagucauuagcacuggucaugagcagaugaauguccuugguggcugucuccagauuaacagguuuaaggguggcaguacauccuaugucauacacaugaccaagccagguccuucuaaaggcugcagagguugaggccaccaggucacugagucaauggaacuccauagccacucuccauucagcuagacugcuaguaacaauuagaacacaugauuuccauuuuggaguaccuuccaagaacucaguguccuugucccuuaacacucagagcagcaccuagcauuagacaucccauccuaguagcaccaccaugugugacccagagaagcuugaccccucccaagccacuugucaggcaaggcaacauccccaagccugggucucaccuuaaucacacauguccacagcuuggcucguaauuuaucccagcucucagaauccaaacuuuacuucagcagaguccccaagaauaggcaauggugucacuguuacccccucucagggagcgucuuagucuuccucuccuagguuagcauucagauaggugaagaccauccuuggcaagggguucaagccaucugcacuaucauuugaaaccuuuuuuggaggcuggggagagcagcaagguacuugguccauagcaugaugacccgagucugacccucaaaaccuuuguuugaaaaaacaaggcauggugaugugugcuuauaauuccagcucuggagagacagagaggcaagcagauuccugggacucgguagccagcugguuuagccuaauuagcaagccuugggccaacaaaaagaccccaucucaaaaaccaagacugacaacccuugaagagggauucuuuugguuuaccucuggugcaccacacacacacacacacacacacacacacacacacacacacacacacacacaccuucacaccuuuuuggaacacuagagggauaggacagauuuggggggaagauaugcucagauaaugugcucagagcagggaggcaggaacauuagccagagucagagggaagagcugggagcacagcugcgcuucguggcuagugguuguaucugcagcucggagagccugugguggucaguguguugaccucuaucccagagcaacucagguugagaguuugugucugaagaucugcagccuaauaggaucugccuguagggccagacauacaugacucccacaaggaacagaaacugcagcaccugcccuggagcagcuggcaccugcccuggaacugcuaguuuucagacauguaagagccccuggggcuaccccagcuggauggcaccacauagggccagacucaagaauucaguuagcuagcgcucucuuauuccugcuucucucccuugccucuugcccucuugcucccccuccaucccccaccccacuucacguggucauggccagccucuacuucucuacucucucccucucucucugccuuucucugccucugcuacucucuuaacuccccuccccaugcccuaaauaaacucuauucuauacuaaaaaaaagaaaaaaagaauucaguuagcaaacagaucugaguccucuuacgaggucacaauggcaccccccccacccccagaauaugaaccagaagccucagguaugggaaaaaggaaaugaaccagcuaggaaccaaugucuuccugucaauuuaggagguacguagagauggccugucuuuuauuuacaggauugaaaagagaagcucagagaggguuuaugcccuucccaaagucccacagcaaucaguaguuagugagaucagggcacacaggauagaucuccucccaaauaucucaaaaccucuaggaaagccauaccccagaaggggagccaggcaucucccaaacaccuggcccuucaaggaaaggcucuggaagaaagguaguuaguaggccugguggaaggcccgugaucucucccacaccccagggcucagagcugucacugcuggguggcugaguacuccaaagacaaccaacagccuaugaguaaggaagcaugccauucuucuagggaccugaggaggccagggccagucaguacucuagaguguugugucccuuggccgucggccacacccagccuugcucccccaggcuccaugauaagaugccauagugacuauauuuagaaugugugguggggacaggcuuguaugacacaugcuugggaccugucagugaaggcauucaugguucuccagcgugaugugggggccacaugcuccccauacauauuccccacuugggacauggccucuguaucuuggagaugucucuacccaggacaguguuggcccagcagccucaucuggcucagaaaguggguauugacuacuuaggcaacucacugggcugauacaucccugcagccagccauauaccuguauaugucuacguucucacaguucaguccuauugggaaauucccucguuacaucaagcucaagucucucuugcugucuucugggccccauuccagagguuuuaaggaaucucuguccaccaagccauugcacaaccucugagccuccguuucccccacggaggaacuggaacacaucagacuguucagcagcugucuguguucaguaaaggcgggacaguuccacggugcccaaucccaaccauaucauugauauucuaauaaugguaucaacacccugggaucugacacaacagagguuucaagggcacauggccagcaucccuggcagaaaccugcucagguuccacugucuucuuugguacaaaccuucaauaaggugacuccaacaguguggccauaacaaaggggagcuggcuuuuggcuaugagggugacccaaguucagagaauugacaagguagccagggguaaccuaccacccgcuccaggaauaggcacccacaguugucucuguaggguuugggcacugccaugcucugaucagcuguauggugacugagauaaugugggguaaccccuaauauccccuccacauggguggaucauagggcuggaacaggcaaugcuuccaguuaggcagguucaguccccaucucucacacucucuuguaaggcauggugguggcagaaggcuucuaagauguggagacugaugaagaggacauggggucuuuuaggacagggugggugaguggaucuccugaccugugcccugaccuccuuccagcugaauggaauuccuaagugacauucagccaugcugacagcagagggcaccagugagagcaaauaaugacaccaaacagugacagccugcaaauagagacagccacaaagacccaaaucacccagggagcaauugagcuacagauuaucgggguccccaaagcuacuuuguauagauguccccuuaggguagggguacaacacaguaguaguaguggccccacagaagcccuugagcagcagacaguauacuuagugugacuaugcagagcccagggucuagucuuugcccuaccuagagaaacugaacucugagaaggauaggaucuacccuacauguugucaugacaacaaagacauggucucugauucuugacucaaaaccucagccugggucacuaggguagagcuguacuguuggagauggauaggcuggcuuccugacaagaaggagccucagguucagggagaagagcugccaguccagaguaugaaaugaccacagucacaucucagcagcuucugcccuuccugguaagggccucugugaggaucaaguacaugugcugggcacagguggcuuacuuccccuggcaucauucauugagagaccuacaugucaccuguccacuugacagacccugaccuugauguugugugagugaucuuggugcccuggucagaagugaccuggagucacauacuggaacaaagaaggaauauccugggucccugcagccaugguucauggcucaggagaucugauggcccaaaacccacucaacucugugguucucuucuugaggaccccucccucucacuaagagccagucaggcuggagaccccagagcagccacaggucucuuccugaaucaggaaccucagccuccugagauccugccucagugccaggcacccuccggaguucuacugcuguugcccaagugacuuggaccaagaaaagccucugaugacaaaacaagauggucacauucacuucagugcagccucagcaacacacagccucaggcagugcccaucaaugggacuguucuucugggucacaggcaagucucgaucucuugacagaugucugcaccaccgaccauaagacagaggaccucaggaucaugugggacaguguccuugucaguuuuacggugugaccacgcacauggauggggcuuccuuagaagaguacaagagaguacaguaagcaaggcacaggaugagggacaugcauauauggcuacagggauggggggagggagggagagagagagagagaggugugugaagggcaaggauggggagggacaggauguagagggucacacaugucaaaggagauguaccagacacacaguuucccugaccacccaucgcagaaacacuacccaugugccacuauccuucaaguccaaccccaagccacacucugcagagccaccgauaccuuagggagccaaccaggccacacccacagcucuacugccccuccacucacaggccagacccagugaaaucuauuagucacuagggauugcugggcucccuagcuaucagccacuguccugugccagacccccaccccguggcugcugccucaucccaggccuucugcucucaccagccacccaccccagccauagcucauccacuagggcccuggcaggguugcuucugggggaccaagaacucacuggacugaggaaguaagguccuucccacccuuaaucucagcuuacucucaagggcugaacauggcagcugguaugguggcacuaaagcagacagaaggaaccuggcagagcccucaggaggaggaauaggagcagcaaugggcaugccuaggccacuugcuagaagucaguggccaaaugccuaggcuccaaaugacacccucagacacaaacuccuagggacuagaggaaggccaagaguagcugaaggcccuuuugucaccccagcaggcucaagauauaugcaguacuuggggucacugccuuggggcagaaccauaaacuucaaaggcccugaagcccacaugccuauguauggaaaggcugauagcacugagugucauggcccuggaaggacccuggcccagcuggcacaugacagacacugaacccuggguuuucugucaucacaguggggcaagacccagagcggucucaggaagccaucccacuucccccgccucugccuggccaggacacacuucauuuccugagccucuuccucggcuaccacacucagcucugaccugugcccuccccugggaaagccaaguauccuuugggagcucuuuccuggcguugagcugaggcugaggccacgcuacacaucagugccuccucccugacucugaggcucuggggacuuccaaaagcuugccagcccuacccucuauagggccacuaccccuagccaccaagccuucaaagugaggaauguacuagguguggagagaaugacuguucucccagggcaggagugaggcagugacaauaauaauuaccaugggcagaguuccuucaggcugaguguccucauccuacaugggggcucuggccacagggccccauagccaguggacuaaaugauacucacccaguacucagacuucuguggaauucccuggaccuaacuaaacacugcccugcacacagaggacagcugcaccuggcuaggcuacacuagcucugggaagcuuuuggagacagguggcaauugguaucauguuuucacuucacagugccuucugguaaugcugcggcuuuagaaggaaaggcauuagccuaaagcuacuugccagaccuggcuccaccccuuuucaagggcccauaaggaacucagccuuugguacaccucggcugucauccuaaauggcuccacccagaaaguaccaacuguguguguaccaugcaggcucuacagaugcaacaaccgacaacauagacaccgaauacugugggggaagggguguacuaacaaauaacacaaugggaaaaacacaagaugaggucacagugacuaguggcucaggaagggcuaggucaccacgaaugauaggccagagacaacaagggaggucaugugaguggugggccaggaagccucauggggcagcaauguugaagcugugucauuagagcuggagacaggugauccagguagaauuaacugcaugugccaaggcccuggacaucuagagaccagaguagcaacaagugugaugggugaggacacccuuucauaacagagucagaaggaaggagauucucacaggcuaauaaaauacagagaaguuuggugggcacugcagauggcugcuguccaaugaaguaccaucagccacuaugugugcgggguguugggauacauuggagagcauguugcaguggcugucuuuuagaacccccaaggccugcccuaugccacauuccucagaccccuccagcaccccugccuacaccuguuaccuugggcucagccaauggccaccaagcuccuuuccuucagggagcccccucauuuuuuuuucuuccugucucuugaauacccagagccagaaguugacagaacaagaauggggcaugcgcugaagcaaaggaaaggguccagacaugaagaugaggcaggaaugccagcauguccaccacaugugggagcucuccauaauacccccuuguauauaagugggaacugcuauuuugcugccuuuggucugggauagccuucugcacaagaccuggcuuuccuugggcugaggauugagucuccucuccagaccacugauccccaggcucaaggacccagccuuccuguugcagaccaguuuuggccagaggacaguguuugccaggcagcagagacucugacccugaccauggaacagaggaaggcauacaacugggauaggaaccuugggcucucaucaaccccauucuccaagccaaguuaaugaacauaugcuguuaaaauaaaaaccuuugagguuaagaccauggcucaggauauaaagcacuugcuacacaaggaugaggaccuaaguucaaacccugaggacccauguaaaaauucagguauggcuaugcaugccuauaacccuagaacuggggaggcauagacaggugggauccuggagcccccugguccgcugaucaagaugaauggacgagcuuucaguucuuaagacauccugucucaaaaaaauaagguguggagugauagaggaacacacugauuucaaccucuggucuccacgcacacacauguguacagcccuauguacacgcacauacgcugcaaacaaaauaaaaauaaaaaccuuuggugguuucucuguccuucaagccaugcuuccuauaguacagugguaucugcucauugggaaccuccaaguccccauuuagaagcuucccagaccauugcucaaaccuguuuggggacaugacucacagucaugaugcgugugucuuccuccaugacccucucuccccacugcagguaugucuccuugguugaugacuuuaaguguuuacuggacauauauugggguagaaacugaacaaguaaccauccucagcccuucacagaucucguggggaacuaggaauaugauggucuuucuccuuaaaaacacccugcccaccuguacaauagucucuauacuggaagccaggaggagggucauccucuagggccuguaaggcuaucuauaugagacucgagucacagucuguggagucugcuuacuaaccuccccugcaaucuucauucucugucuaacauaaaggaugcuuauuccaggacccauugcuguuccuguguggaacacucaauuccaaucugccgcagauccccaguguagucuucaaggauauccuggagagcccaggcucccagaugugugccuguaaggcuauauuuuguaacaagguugccacuguacugauacauaccuacacaguugugguuuguaacccuguccaaauacuccagauaaugagauuauacuucgcaacuuuaccuucucuuuuuuuuuuuuaagauuuauuucuuuuauguaugugaguacacuguagcuguacagaugguugugagccuucaugugguuguugggaauugaauuuugggaccucugcuugcuccgaucgaccccguucacucugguuaacucugcucagucccugcuugcucugucccaaagauuuauuucuuauuguacauaaguacacuguagcugacuuuagacgcaccagaagagggcaucagaucucauuagggugguugugagccaccaugugguugcugggauuugaagucaggaccuuuggaagagcagucagugcucuuaccggcugagcaucucgccagcccgcaacuuuaucuucuaaggcagcuacuagaaaaaucuaauugcccacacagaggugaauaugcaugcccuacaccacuaggcgaccugaaaauaauaugguagaucucaacuaaccaaugcaagccaucuacuaaccaagaagagcagaaagcaaagccuauguauggcuccuugacagguggugccggacaaacugggacucugcaugcaaaagaagaacaccagacucuuacacuucauacccauaaccaaaggccugcauguaaagucuaaaacuaccaaacccuuagaagaaagccugggacaaaugcuucaugauauuaaauuuagcaaugauuuauuuuauaugacaccaaaggccugggccacuacagggaaaacagauucauuacacuucaugaaaauguaaauguuguguggcaaaaggcaaugucgacaaaaugggagauuuuucggaucuucuaucuaauaagagcuuaguauccggaauaaacaaagaguaacuaaggcaggcgaaauagaauucugagcaccuucaacauuagugucucacuuccuuuacucacauccuuaaaucagcaagcccugaacccacucaggauggggcaccaggaugaaucaccagccucaugccaaugcagcacccaauagggucacaccaagugugugugggggggggaggggacaggaagcccaaccugagcagagccacuguagccagcagggauccaggguacacugaggcuaauggcagaaggcuguacacacacagacauugggugcccacccuccuggaugcucaaagagaaguggcaaccuggaacuaucacguguguguguguguugggacccaacaagcaagucuucaugccaggagccauucacacagugggaagcagcugcuacaguuugucuugacagccuggaauugagcuagcaguacgagggcauacauguauucaugcauccaggaaagggacacagagcagagaaggcaggcacacugcaguguucccaccaauaacacaaggcagggguaggggguugcaagcucggcuuuaggggacuggauuccaauacgaggaaccuagcucuacugggagaagagcuggauuuuggacugggacagggaaaaucccagaggagucugcagccuuaggaauaagagacaggauccaaguuaaaacaaaacaaacaaaaacagaaauaauagaaacaaacagaaacccuaaaacagggccaccaugugacuuaaaggguuaccuaagagaccuggaugccaaagccacaguauuugaacaacagaaauaaagaguacagagcugggcauggugguacaccccgucaucccaggacucugagauggaggagggagaggagggcaacacaaauuauucugaggccuacuugggauaccugagacacucucuuaugucucaaaacaaaacaagacccacagggcuggagagaugaauucaugagcaggagugcuugcuguggaaacauaaggaccugacuucagaucccagugccuacccaaaacccacaugagugugacacccagugcuaugggggaauaaagggagcaggaggaucagaggaccuugcuacccaccagccuagcuccaggguaggugagagauucugucuuaaaggaauaagcuggagagugauagaggacgcacucaccccaugcccucuuugggaccuuacacguguauacauauaccacacauaauuauaacacacacacacacacacacacacacacacacacacacacacgcagcacaccacaaccaaauaacaaaacccaaauugaaacaaaacaaaugaacaaacauuaaauagcaguugaaguguuugccauaaaguaaauauccuuagguugcacugaucugaaucuauccagggaaaguagcuggagggcuuuuagggagacccucaauucugagacacaggaggaaacugggaaacagaugcccugcucagcaaacauuccagaaagaacaucacagauaaggcccacacacgggacaggagaaauagcucaguaguuaaagcacaacugucuuguagaccuggauucaauaccgaacacucacacggcagcucacaacuguaacuccaguucuaggagguccaauguccuuuuauaguuucuauaggcaccagacacacaggugguacauagacaugcaugcaggcaaaacauccauacacauaaaacaaaucuaaaauauaggagaucuacagaaguccugugucagucugacuuguaugucugaaggugucugccccaggaugguuucugaggauaaauaguuggcacaacagcccccacaggguagccaaagucaaugugacacaugaggggacagcacaguccagcagcccugcucagcuauacuccugggacccaaacugcagcuccugggcugaccuuccugcaaguucacaauuucuaucugaucacagaguccaucagauuggaggcaugggacgccaacagcuggcauuccucaaaaugccaaggucaugagagacaaagauggagcuuucaugagugguaggaaacaaggcagauguaaaaccugucugugguagagaucgcaaaagagaaaaauauauuuuuggugggauggcauaagucacuuacuggugacagucuccuggcuuuagucacauggccaaaugauagaauuugcugagacuaugggagcagcuggagaacucuacacuacccuggaacauucucaagccaagauuuaucuugaaauaaaaagcaagaaacagcugggcggugguggcacacgccuuuaucccagcacuugggaggcagaggcagguggauuucugaguuugaggcuagccuggucuacagagugaguuccaggacagccagagcuauacagagaaauccugucucaaaaaaccaaaacaaacaacaacaacaaaaaaccaaccaaccaaccaaccaaacaaacaaacacaaaaacaaaaaaaaacaaaaacaagaaaccuguacggaugcugagaaaccaaaucuuagcaccuguuacuugacccuucacuuauuuccugguggucugagccacagccaguggcccaucucuacugcccaccuuucucuccuaacccuaccucccucagcccaucuacuccagcccugucccccugcugcucccacaggugucaagcuuacauccacagggccuuugcacaccugaugagcuuuuccagaaaaagaauggcucaccuccucuauugaccccgguugaggugguggcuccccuggcuaccuuccagaaggaugcuugguuuccucccacucugcccuguaugugguuucuugggggucuugccucuuccugcauaucuguuugcaucugugucuacuccuuggaguaucacuuucuugucucauuaccucagcuuucccacaauuccaagggcccaaugggagggcagugggaugguaaugaauaggacaugaaacagaagcauaucgacaaugugccuucacugaauguuuguugagaaaaaaacuugcacuauguagccuggcuggccuggaacuugcuauguagaccagucuggccucagacucacaaagaacuugccucugccacuauauucagugagauucuauauuuuaaaauugugcacaugugugcauacucaggugugugggguguacugcacaagugugcauggagccagaggacaagcuggagauucauccucaggaaugcugcacacagacuuugagacagggucucuccugggcccagagcucaucuauuguugaggcugauugaccauugagcaccaaacauccuccccugccucugcauccccacuacauccagcauuauauguaaauugaggaucaaacucugguccucagaagcacuuugcugacugagucuuuccuuccaaacccugagguucuaauuuugucuucaucaaauuaaugaaguguuagguggugauccccaguuuuagagguagacgucaaugaugucucacaagguggguggagauaggucagggcauuuccugcaggccagugugacuuuggguuccagagucauaaagccgugggaagucuuugauccuaucagucuccugcagaugaugcccaaggacgcaauccugaguuccuguugaacugugaggauuugcaucagagugcuauuuuuaauagucagugaggaagugguccagguguccacaggagagagucaaacaagcuacaucaagaccacaguggaaaggcaaggaccaugcaggaauguaaacaaaacuuuaaaaagcaggucaaagcaaaggcccagcauugagauuuccucaaaugucugcaugaauguucagacacagauugcuagugugccuagugcugaugagugucuccugcugcucugaugaccugcugucccucaguucacuugccucacccucaaacacaggucauggacucccacaguuccucaggagaaacugagacacaaccaggaagaugaugcuaaagagcugcaguuuuuggaaaauugccuccugguucaacaucauucccguuucucuaaggcugugauaaaacacuuugacugggagcaucuuagaggaggaaaggguuuauuugacuuauuuuuccaggucacaauucaucauugaggguagucagggcaggaacccaaggcagaggccugaagguaggaacuaaggaggagugcaccuugcuggcucucucacaggcucacacucacuagcuuucuuauauaggcugccagggaaugguguuauucagacccccaggaccaccugccuaaggaaugggcuggauccuccuacaucaauaauaaagacaaucccccacagacaugccuacaugccaaacuggucugagcaaucccucuauuagauauccuccccaggugauucuaggcuguaucauguugauaauuaaagcaaagaaaggaaaucagagugugcccuguguauacacaagaccucaaguaugugcauacacacacaaaaagaagagaaaaaaauugugcaaccacuuacauuaacaagucacauagaaaaaaucaccaaaggaccuccaguuagccucgauagcuuuucuuacaacgaauuaauguuaaugucuuccuugaaauuccccaauguucucugcugagcauuucuggauuuuuuuuuuuuuuuuuuuugaucagaagaacuaacagaaaaccaugagugcccauuuggcagggagauguucagauacaucagggguggcaucaccacugggcucugacuagggcagugacacaauuguuaucuguuccuuggcucagaaaaggaacugcagggguuauaugaccuuucucuagcuuaucaaucaaauguguggaaaccaccaagucgcaaaccuuuuaaguuuguuacaauaugacuuaccaaaucaaacuuggaacuuuuucuacaucuguagcuaaaugccugauuuuuuuuuuuuuuuuuuuuuuuuuuuaggaauaagacuggaauuaugaugugugcauuaguuaacucccucauccaaucaauaccuuccaagaagcaacuuauggaggaggaguuuauuuuaacucaagguuugagaugugcagucauccuggcagagaaggcuguggcagggggaaugcuucucagcucuaaguugucaugugacacacacacacacuguagcaugcaugcauacaagcccauuagacaaauaaauaaauaaauaaauaaauaaauaaauaaauaaauaaauguaaagaccugcacacacauguccacagcucugugacucucaacagccuagaaaacgucccaaggaccuguaagaugagaaaccagaaaaugaaacaggaagccacacaauagcuuugaguuuuuguuuuguuuugcuuuguuuuugcaaacaagaguauuaaauuuauuuacaaaguacaccacaaaauuugauucauccuaaacaggaauaucgggggacuggugagauggcucaguggguaaaaaugcucaccauguaaaccugacaaccugaguuugauccccagaucccacauuaagauagaagaagagaacugauugcccagugagccagcaauccucugaccacacacacacacacacacacacacacacacacacacacaaauaaaaagugaauuucuuuuuccaaugggaaagaugggcucagugguuaaaguacugccacacaagcccaaagaccugaguucagaucugaacccuguaaaaagccaggcauggcuugugucuauaaucccagcacuggggagguagagauggguggaccccuggaacuuguuggucagagagucuagccuaauggguaaacucuaggaucagugagggauuucuguuucaaaaucuauggaggauaggguugaagaagacagcugauauuggcuucuuccauacacacacacacaaucuucaaugcuaaacaacuaaguuuccaccaguuuuggcuaauacuagcugagcacacaugccucaguuuccucaucugugaaagggaggcuguggugacauucccaugagcaacacugcaugaagcaugugauucagugcucaucauacuuccaagagcuggaaucaucuagacaagucauaucuaccuucuugguaccuacccaggucccagaaacuacaguaagcugccccaugaaggcaagauacucagucaauacaccuaccugcauccucaaugcccacuguccucagagcuccucuggaucccuccaccagcuaauaugugagucgggauauucugacucaaugcucuauuguuuggguggggaaagcaccuagagagcuaacacagcaaaacagaaauguuucaaaggcugagagccaucugucuguccuccuuggaccaccucucaagcucuuacaccuucaauuggaaccuuguguaaugacugagcaucuguguagccccaccuucccuaccuccugagguugucccuauacaauugcaccuuggugucccaaauccagcacuauugugauaggacuaggcuggacacccauguccacugcuugugcauaccugggcaccucagccccagguagagcuuucugaaggcucugcggcagcucugugaggaggagccuuggauuucacuggggaggggaucucaggguaugugagaacuugugccucucugccuggaaggugcccaucuuggaaggccaggauuaggggaugaugauggaaaggccuuugggaagacuccaguccauggcucagcaucacgagucacugucugcuugugucaucccugugugaagguauugaggucccugagugucaggauggcagcccugaagcugagauagagguaggagccauagagucauccaugcucagugcacacgaugcuccugaaagcagaaugccaccacgcugaguucaaaacaaggacaaucacuacucaggcaaguggagguacagggcagguaugguccccguacacucugaaugaugaagggccccagcaaaggacagcagccuaguuagguugacacaagcagggagccugagucacacagcagcaucccaucccauaguccccacccaacgcucacagugcuuguugagccagaaacucucaacacagcccucuauccuccaaaucaggaucuaaugaggagagaggucaggaaccagcucagcuuacaaagcagcugagcuguggccuuugcccaagugcagguagcugaucccaauauacacagaccuuucugggggcucugcaccccacaggucuguaccugaaagugaggaugugcgcacgugugcacacacacacacacacacacacagagagagagagagagagagagagagagagagagagagagagagaaacacaauauggaugaggaagcaggcugacuagcauguaugaaguugaauggauccuguccuguaaucagauccuuaguggggacugcuaaucccagcucugcuguccacagggcuagccuaugcuuccaaccgugugguucucucuuucucccuuacgugggucccagggaucaaacucagucaucaggcuugugcagcaagugcuucuaacugccauggaucuuggcuccuguauucacuuuuaaaucuucccaugagugccccauggacaggggcuccagaagcaacuucacccaguagugcuggagucucaucuaccacguuuuauggucacaguggggagggcuguuauugguuucuaccagggaugggugcauaacuccacacuggacucucaucacaauagacaaugucaccauuuggcagugaagaagcugccucuaugaacuagaccaucaugaagccagaucccauuaauagcugaguuccacagaggcuaaguaacugcuaggcacagagcccagccccucugcuaccuggccugaaaugauacuggccagcauucucacaacccagcgggcugcuggccccaugcucaccgaaggagcucuagauccauagggguaguuucuccugggggaaggugacccagcccagauauucccaggccagguagaagggccagcugccaccuguucacacuccaggaccagcuagggaugacagcagaaagccugccgcugucuccaugguaacccuagccaggcccucacucuuacccugauuucaggcccaucaccacauucugcuucugagcccccagacuuuccugccgagaggagaccucucuggccuaggcaggggaaucaaccaccuccacauggacacaauacccacgaaagcagaacccucgacaaagagucaccucuucuuugaaggcuucuacucuggaccucagucuugacagcuauaaaaugggacaucugggccugagcuugucuguguggccuccagcaaccacggccggccgccacgcugugaauugacaugccuuaagcaagaggcuccagaaagauucgagucccccugggccagcuauaagugggcagguuccaucaggcuuucuuccguucagccucugcacuuccccaagagggucugacuuuccaaagagguggcccaacccaguagcugcagagcuccaggggaggggguggaucagguuacagccagcaggucacgaucuggagccaucugguagagcccagcucccugcaggcucucaggaaugcugccagcccuauuuucaggggugugaccagccauggcguggucccagccuacccagccagcaucaggaugcaaagcagaccagugagaggcucuaggcuacccugcauucaccugaagcucugggaaacacagggcugcccuguccuggaagagaggcuaguagaauccacucccucauccucacacaggccuggccaguuuccccaguguagggaaaugccucuggcuugagcccggcucugcugaggucacccacagaggaugaggcucccuggguugugaagaaaaccugcuuuagucuuagcuggacaagccaccggggcagcagucugcccaaaacaggugcuugugcaauguacucuccugagcagugaguggggacaggguggggcugcacaaagcuacccaagcuguaucagacaaagggccacccaguaggcccuaaggccacagcuucugccacugcccugggucccucacuaagacaagccauagaggcaaggggcccuggugggggccaaagucccuuauggcucauacccucagauggccugcuacaugcugggcagagagcagcauuuggcugcacagggaaccucaggccuucuauccagaugagggacuugugacccuggcuggccacucaggagagggccacacaacagcacaagucuaguauuuagguucagaacacuuucuuuccuuugaagccucuggauaaagcgauccuaucacugccugggagggugcacugcucuuucugucccuugugacaaagagaagguaagagguggggucccaaacccuguaucucugggcaagccuuuagaaugguaccugcccuuuaguuucaagccuacuugugagcuaccugccccacccugccuaggcuguuccucaacugcccccaggcuuccagauccccagagaucacuugguccuccugguaugaagcauguacuaguuagucccaaagaaaagcuggcuuucuucagaccacagcucugcccacgcacaucaugcuaaccccagacuucccuaaggauaggaccuaggacucaggcccagagcccaaagagagacagugcuuuggggccaggagccuaugggaccccuccuucaagcaucuaucuaucccuaccccaacaccucucaaggaucaaagcucauucagucaagaguuuuccaccuaaaauaucaggaaacacuccccaccaccauggggguggggcaggugucuuauuagcuuuuuuuuuuuuuuuuaauggugagcuguuaauuauccaaaauacagaaauaccucuguuuguuuuuguuuuggguuuuguuuuuguuuuguuuuguuuuuuuuguuuuuuuuuuuuuuuuuguaacacaacagggauucuuuaaugucccuuucuggcucuuuccauguuagaugaccauguauccugaccccaggguaagcauccugucacuuaccaaagugagggacacuuuuccaugagugucaaacccagcccuaacuguuucuuucacaugcccugaccugacccugagucccuugucugagcacaguauucacagugcccugcagacagaaccugcggcuuuggguuaaucuugcagccaguucacuuugucaggagccccaggugcugcucauacacugaaaaguugcuuagcuaggaguauaugcugaccaaggaugaaguugauaccuccacaggccccugcaguggcuaguuccugccccagccuccagcugaggcccuccaggagacacagugagagcacacuuaggugccugugugagccugguaccccugaacuucugugagccugucuguguccuguucaauaggugccuggcacuuaagcauaccccacacaugacagccauuuguccccaacccuggaagaggcuggcuugcccaaggacacccgcccagggcgguaugacuuugaggccacaggcagccagccagggaagccuugauaagcacaguagagguggggccguccugggaaccaaagcugggaagccgcagagcccccagucuccccccuaacuccccaccccagcccuugugccaaggacagccagaacauucucacuagccuggggaggugccacaccucaaaaaugcuaacccagggaccuuggucugggacagagagggcaaguuuacacuuagcgggaaaccaucauuacugcacagguuggcagggacuucucaaaggcccuuuguauaccugucuuguguuuuaccuccuggccaagugagguggggaucaggugucccaggaacaaagcggggugucaccaggucacccaagaucaugggaugggccugggacagagugccagccccacuguucugucaaaaugcacaccugggccccuggaaccccaccaccacucccgugcuuucucuguggcgguugagacauuuccuggagguucccuguggcccuugcauugguucugcugcccuuagcucucuggugcacagcugucacaccggcagugacaccggcagugcuacagauuuaaagucgguugcaacccucaccaacuaagacacuucauagcugcucagcuaacuaggaaggauucugggugucgggucuggcccaacugcaaggacagaguuucugcccucucuuuacagcacccgucacccaugccauugguggagagucuccuuuguguuccugugaaccacuggccaguucuucccuucauuuuaccucucagcuugcuguuacuauugcacuacccuggucuuuggccugcuaggcucucaccugccaggccacccacgcccagaguucucuugugagacugguccacuggugcccuagaaacucauauuucucucucauggaaaggguuuucugaggacauggugggauacaacagcugccugcagaucacagugagagccugagaggcugcucacugcuuuuggucaccaggaacagccuuucuagaaacccagagcucucccccaggcacucacucccaggcaaguguaaaugucaggggagggguacaagaaagauaguaacccugacaugacaccccugccccugacauacacacccauacccuuguccaucuuuuccucuucacaggaacaccacauccaaucaaccaacacacccacugauccagacaugcauccacccaugcauccugugauagucuaacacuccaacuuccugagcccuagaagccggacuugggagcaggggccacauagaaauagccauuuaguauuuguggacugccacacugcccacccaacacacaugugcacacauggaaauauggacucccaucugggccucuccuacucagugagugucauggaagcuaucuggacagaguuagaggcaagcgugucucagcccuacuccagaucagcuuauaugguugccauagcuuaucuccucuaagcucuggagaacugccucucuacagaccuuauuuccagaauauucucaacauuuacaaggagaugacuaguucauauguccacuuagaaauaacucccuccaaugccagagacacagagguguugggcagugagaggguagccuugggggccuuuaaauggucauacauagcaagaugaggagcccaaacgcaugaucacaugaccuguuagcaucccugagauagaggcccagacccuauccacauguggggaaacagccccaaagcaaggugaccucccaggccacacaaccccaguacgaagucucugggauggugccacacccaucucaacugccgccugccacuacuacuugcucaggagaggacauucugcaauccagcaaaggcgagaggccagcucuguguacaugaagacuuccuguucuccagugucaccugagagaccaaguuccacagcuguaccacugauucccuuccacagaguccccccagaaagauggccauuguaucugucugcucagagaaacacaggcaaaccauguugccuuugcugccugggccugucuuuugucuaucgucuucccagggacuaggucacuugagggucacucgccauuuccugcuuucuacuuggcugggaggaucuggguuuuaugguuucucuggaaaccuccacuguguacugcauacagaacccuagaaggugaacccacaacuugucugggugcucagugaaucccagccuuccugggaucagagagcuuugugagaguaccaggcagggcuccugaacuaugaagcuagugcugccagucauugguagccagguguucaaucuggucugacucaaagacaccaaauuuccugugugguuuuguacacaucccuggccuucagguucucacaaagaauaaccacgcccaucuggcuaaagcaauucuaggacccagaugugguguguagacuacagcucccccgcugagccauggaaggaaggcaagccauauuggauucugucagcccugaaucaccuagccaggguacagaacaagaacacaggcuuuccugagacucucgccugcauagagggaacugucugaaagcaggcagucucacugcucaaggaggggcagaaccaugugggugacaacagguagcaauccacuccaggcuguccucuagaggaccuguggaguaaacagcaaacucacugugccugggccaagcaccaugauauuauagcccguccccagagagggagagagggacucuguaggagugacccuacagaacaaaaaccaccucaaagacuuuuaugcaugccucauuacuuggaaacugggaagggccuggccaguuaccaagugaaaaacuucaggcaggggggaggaggagagaagagggaggaggaggaaguagggaagguaaagggaggugggggaaggguuagggagggggagggaaguaggaaaggaaggaagaggagaggagggggaugggaaggggagaaggaggaaauggaaggugggaggagaaggggagaaauagaggaaguaaaagcaugacaggagaggaggaguugaagggguggggaauccuugcccacuuuccagacaacgaucgcuggacuucaggucagcacugaaggcagcugcaagccuuggcugucuacagauaggaccacagacuugcuguauggaaaguugaaaaacacuaggcauuucuucccuuucaagaaguauaagauagagccaggggugguggcacacgcgccuuuaaucccagcacucgggaggcagaggcaggcggauuucugaguucgaggccacccuggucuacaaagugaguuccaggacagccagagcuauacagagaaacccugucucaaaaaagcaagaagugcaagauagacaccagaccauaggagauauguaaguggcuucagccaaagucagguggcuucucugacuuagaaaugugaucuccacccccacccccacauuccugggggccuccagcagggccagggcagcuguaaguaagcuguaagcuuguacaucuuccaagguucaccaacagcccucugguuuuccuccccugacucuugcccuaacauuucuacaucccuccugucuccucacaacucucugagccaggugggcaugcuacugcuccugagcacugguuagcuccccaauguuaguccuccagaguuccaggucacaugaacagggccaauuccaggcagcacucagcuccuaugcucaucgccacauaacaacuuuguaagcacagauacgaugggccauucugguuaggucccuucaaguauucccagaagccuggccuucccaucucccugccaauauuacagggcuggcaugaaggagcacuagagcacugggcauaagccucagucuaucugcuccaucccugcauuuuccuggcauccuguccucagggagcaagggaacugaccacagaaggaucauagccaccucacccucucucacugggcagagccaguucacacagcagacauagacccaacaggugacacccacugcagaauggagcauacccucgagcaagguaaucucaaacuggguuuugcaauuuguuuaaucaggacccaagagagggcacaugcuacacacucucccaguccuucuacccaucucuccuccccugcauauuucgguccuuaggccuacagguccccuccaucuuaacuugcacaccucaauuccaccaugagcaccaaagcaugcuccucuugccacaguauuucccaaaagcuugaucaggaggcuguacucagcucauuuacuccuccaguagugaugccaauguagguccugguugaacaauucuacccaauaccugcugucccacccaucuagauuuuggacaaguugguaacugagacccucaaggccgaaucugugauuucaccaggacccaugaugguguagaucagcccugaggggcuuuugacauuagcaggauuuggcaaggaaccuccccccaaccccccacccaaagcugggaccucuucagugcuuugguuuccccguuacuguuacagugggaagcaagacagguguaugcugggugaguugugggcuaucaccuauucaucucugaaagagauggaagguccugucccuuagucacuaggacaacuggggaucugaguuucugcaaugcauucggacccacuccaacaagacacaccuucaagucuucuccaguccugugcugugcccuggcauccacuggccauuuccucaccuccugcuccaggaaugacuugggcaccugcuguggcuguaggcucagccauucccuaggaguuagaucucuagaguuaagggaauuuggggauagguaggcucacagcuucugaggagaccuuguuuacugccauuccagaaaacagaaaaguccaaucauagugaacgaauacugauaacugucauucauaugccagccgauucgggaucaaugcccucuaacuguugucaugauaacuaugcacuagcccucacccacaacucacaaacaguaaauagccucagagcaacgagagaaacaaugccaccccauggcauggacucugggagccuugcauuuguccugaagaagugacuguguagaugugagaguccacauuugccucuugguacacuugcuuuguuuggauccaaaggggcuguucuuuuuuauuuucuaguugagaaucauucucaguaugguaguacaucuuuaauccaagcacucaggaaacagaggcagcugacucucucugacuuugaggccagccuggucuuaccuaucuagagccaggcaagccagaggaagucuuugucucaaaaaacaagcaagcaaaacaaacagcccccauacacaucaacaccacaacaaauuugcagcuuuuagcaggucuuuuuuccuuucuuacaauauguuauauuuagacaauccccaguagagggagcaaacaaggauuugaucauuucuccucuccugggucuuuuaggcaauuuuuauuuguuuugcuuuguuugagacaaugucuugauauguagccagggcuggccucaacuuguggaaagccuccugccucagccucccacgcauugggauugcagauguguuccuacaagccuggcgccaugaugauguuuucacuaaagacucacccuaaaccuggguguggucccuuguggcacguguccauguggcacuccccacauaacuguuucuccggcccacuaggaagugaucucagcaugcugcgugaccagugagccccaucugacuauuuugugcuuuagccaucugaugauggggacaucugguuugagaugcugcauuuccuaauauggauuuuuaaggcucaguugccuuggcuaccaagcucuaagcacaucacuucuugggagugcuuaggcacaaauggacuuccucugggccccagguucuccccugucagguggauggggaaucuuggugaaggaaacaugggaauaagggucucucuuucuugggaagcugcaaccaacauggaaaaaauuguacucuggcccaagauaaaguggggggucccugggcugcuggaggggguucucuauaaagguaaaaccugaagaaaguuggagguggcuugggccucuaggcagcugaggaaaucugacuguggcuuucuuuuuuguuuguuuguuuuauuuuauuuucaagacaggauuuuucuguauagcccuggcuauccuggaacucacucuguagaccaggcugggcuugaacucagaaauccuccugccucugccucccaagugcuaggauuaaaggcaugcaccaccgcuugcccagcaaaaugauacuucagacagcuauaagucaucaaacgguuacugggauuugaaccagaguccauaggauccacagucagugcucuuaaugacugagccacugcuccagcacugacuguggcuuucuaauugcaaguuccaugaggaggugucuggagaguuacucugagugguuuuucgauuugcccaagaacauaguuuaaagaggguacagagaaaggcauccaccagcaagaagcauagaggacaaaccuaaaggucucuccuuauagaugagguggccagauauaagguagcaccuaguauugggaaaggaacagccaucagcagugcuuccuuggggcuuauggauagaggccaggcagagagagggugccugugggaacaugguacaccugagguugagagcagagcaucuccuugcuggagaacacuacaucguaaaguccucugggcaaaucgaaggagcccaaaggaacuaguaauucucuagcaguacaucccaaagaagagaaaaaagauagccugccugacaaagaauucaaacuaguguuuuuuaaaagaaacuuaauaugauaaaacagauuauagcaagauaauauaaagaaauuaggaaauuuuuguuuugugauaugaaugagaaauuuagcagaaggccagauugggguaggggaucuggacugaaagagcaagauauaugaaguaaaguauacaauuaggagucuugaugcagaacagaucagacagaagaguuucugagccugaauacaagucuaacaaaaaggaaagucagaccaaagauaugcaaaaggaaaggaaaacuucaagaccuauaggagagcagaaagugaguaaacagauacauuguggauguuucaggauaaggagagacaggaagaagcagaaauaaaauuguuuacaaaguaauuacugaaaaaccucacaauuuuugggugaaauacagacauuuaagccagugaaggaagcucuaaggaccccuauagauacaaccaaaagcacuacagggauggacagacuguuuagugguugaaagcacugccugcucuucuagagagccuggguuugauuuccaguauccacaucagaaugugcaucaguucuauggaucuagcacccucuucuggacucugcaggcacugcacacauguuauacacaaacacacaugcuggcaaaauauauccauacacauaaaguaaaaaaaaauuaaagauacuuuacaaggaacauuaucaucaaacuaccaaaaauacaaggcaaagaauuccaaacauaguaagagagaagugccaaguuacauaaaagggaaucuucaguauacuaacagugagaagccuuuuaagccaggaaagaauaggaugauaccaccagaguuuuaaaaggaaaugaaugaaugaaugaauacccaucaaccaggaauaugauacccagcaaaacuauccuacagaaaaaaaaaagucuuucuaaagcaagcaaaacuaaaagaacucaucaauagauuaguccuauaagaaaggcuucaaguagugcucagaaaaaacaaauauugucucuggucuuuuccuagcucaaacuguaagccaaaauaaauucuuucuuaaauugcuucugucagggauuauaucauugcagugauaaaaauaacuaacacggagacugaaaguucagggaugggaaacacaacucaggcaaaugaaagcaaaagcaagcaguaggcacacuuacaucaggaaagucaacugucagucaaagacuaaauagagacagggaagccuggccaagggauggagucaacaggugaauuccugcacccauuagaucucaaaggagaaacauuaucuaacagaaugacaguuaaggacaaacuguaucaauggacaaguaguccaggaaaaugucagugcaaaaaugcuggaguuaaaauacacuauagacuaaaaggaucuacaaguuguucacaaaauaccuucucaccagcacagggaauggccuacaguauagaccacaugggagaccacaaagucucacacacacacacacacacacacacacacacacacacacacacacagagagagagagagagagagagagagagagagaguuagaacuggucauugaaguuaacaaagauguacgaacaaaaugcauguuuaaaacuucauagagcuccauaucugaccacuaacuugcuaggacuaaaaucaugauagagccugcucauauuagauacaaaaggacagauauggguaacuaaaaaggcagauaucucuacagugaacauuacaaugacaagaaauugaagagugugcagaagauggucauagcauguuuguggcuccaaaggaaaauguuuaaauguccaucacggcacaaagcaauguacagauucaaugcagcuacuaacagaauaucaguggcauuuucacaggacuaaaaauaaguccgaagauugguauggggccacagaagaacccaaauggaucaggaaauugcauucccaaagagcaaugcugaagauagcauaauagacaacuugaaaauauccucaggcuggggacguggcucagcugacagaaugcuugccuagcaugcacaagauucuggguucaaucugaggcagaaaggagaggcuaggguuuaaaacagaugggauaguaucuauuacaggguguuuagugcacaucuguaaucccagcaguugggauguagugaagggagaaucaagagucuaaggucauccuuggcuacauagucugagucugaggucagcuuacauuacauuagacccuguuuuaaaaacaaacaaugcuucauagcuugaacaaccaaaacagcaugaaccuagcauagaaauagacacaauaugaggcugaagagaugacccaguaguuaaauccaccuguuguucuugguuaggacuaggguucaguucucaacacccucaugguaacucaacugccuguaacuccaguucccagagaucugaaacccucuuauuacuucuaagguaauuggagugagcauacucaggugcacgcgugcauacacacacacaacacacacacacacacucauucacucacuccugcuacagacggauggggugggcaauuuuacaaauggucucuuuuccaggacacaaugccuuugccuggaucuuucuggaaccacauccagguguguucugcucaguucccacaaccagaccuggggacuuuccaagaaguagccagaaagugggcaagcaccaugugagugcuucuaccucagaucugccugugcucagucagggcaguagcuaagacagaagcccuggcuuuauuagaacauuaauggguaggaaccucaggacuauccccaggccacugaaaagcccucuggcagccuuugcaucuacccaccacuuucucaagcucaggaaugccacuggauaaaaauacugcaggcagaugucaucagucuggccugucguggggcuuagaguuuuccaggcagcaguugccacagcccaggcugugagggugggguaaaguaaaaggugaagaaagccuuugaaaggagccagacagcucuagguggcccugccuguauggccucuuagcacucaggaacaucaagauacuugcuaacaccacacacacacacacacacacacacacacacagagagagagagagagagagagagagagagagacagacagacagacagacagacagacagacagacagacaguuuuaccaauggauucuuuaugugcuugaaggcaaggcaaggcaaggggacaaagacagaggcacugagcacauaugugccugggaaggcuuccuggaggaagcagcuucugaacauuugacagaguguguauugcgucugacauuugucaugucagacuccaacucauucccacaggacaagauccuuccauucagagacucuacucccagaagaauagcaauccacuccuuacuugguuugaucagcgugugguuuaugaggagggagcuccuggauucuugggcauagccaacugugugaccuuaggcagauaagcuacugucuccaaguuccaggguucccagaugcacacagcaaguagccauauuugacaggcccuugacagagccacugcuacaguccccuccaccucucaagaggccucugggcagggccagggaacggggcugggccacacagcagaagauaacguguucacagaggcaguccuuucacgggcucugaagccucaugaaaagucaggucuugugauggccacagucacccugcugauagagcaaccacuggcuccucucugaggcuugcagaaaucuggggcucugcaugcuccaagggguuaugaaaagggauucccaugaggaagagcaaggaggauacaucccugagugccucagguaggaugagcagagcuuagauggcauaaucuauuaaguagcaccacuuacucuuuggcccuaaggcccugcagggccacagccuaccuccugcucuaccuauuacuucuuaugcuuccccacagugucaaaagggccugcaccuucccucugcaacuauuccuuaguuucagcauccaaguggccccuguggccagcacuuaauuuccuucauucucccuaccagaggcauaagagcuucuagaagcuucucuacaaccuuucauugggacagaccacccauccccauaccaccuggacuccuuuugguccuggaacaugcccuggugucugccccagccugucaaucucaugaagagggaaaugaaucacagcaagguacauaggaggcaacagcuggacuggaaugucagagccaggagggaccauggggcuaaucaggguccacuuccuagauaagggugcagaagagagagggugggaggagcaggggcccuuacacuggccaugaccagaacugugcaucuuauuacucaggagccacuugauagagacagcugcagcucuccucacugcuaggcagaccugcuguggaugccacccugcacugugcuuuguuaaguaagcacuguuugcaaaggggacaccacacccaggaagcaugagcucuggacacuaccuuugccaccagagggcucuaaacaccaaacucccugagaaacagaggccauagcagcuggccugacaaugcccuguccuugugacaccaugggcuucuucccugccucagcagcucccaguacuaccuuagccuggcauagguccccaugcccucauguccaggguagggaggcucuuccucaggucggaguuccaugggauugucucuuccuacuacccagcugggagccuugccacaagggauguuuauggccacccaacucagaacaaaccaagaugaagugcuccacacacaggcacacaguguacacagaaaugccaggcugggucugaggacagguugagggguuauguguaccuggaaagucaagaugccaagagaguuagcugaugacaccaagggaccaggccccagaggagauggcauguggagaagcuucaaauuuuaucuaggguugaagaauagguagagguguuuauaguaaccagaaggaaagacuuggucaucuacacagcccucacugcucuguccccaucauccugacagccaucuuccuaggucugcuaacuaauugcccacuggccacuccaugagagucauaaccaauacacugcagccccugcaaucaaaaaggccagcccauuugacuaccaggaguagcuguaagcuccacucacgaucaacucccugagguacuagcaaaagccaccaaaaaguucucagggaacugagcaagccagaacugugagaggauagagacaggaugaucaaguucagguucaaaagugagggagguggguaguaucucuuaaaccccucuguuggucacaaccagggucuccaagcagcuugacagucagaguagauaguuuggaacaucugcccccaacccuggccaaggcccaacagcaaggcagcuggaccccugugaccuuggcuaggaagggggcugcucucuaugggaacucaaagagccacaagauaggauuagggugaggggguggggugggaacccaagcagcagagggcagugccuggggaccaguguccugacccugucaagcaggggaggucagcacagacacaggaagagccgcucuacuugggccaaggcaggggucccccaaggaggggccaggauguccgggucuguuuccccauacgcaugugggaaagcauaccccagagacugcaggacacuggcucucaccccuccacccccuccacccccacacauucaugcccugcuuuucaaaagcaggcuuguccuuugggccacagaaccaucccuguauguuuuaaggguccaucuuaccaagugcggagcucacaguuugccagccacauuugcuucuuagaacaucaccagggacaaccagcaugaccacacauuuuauaaagauguuaggcucccaacugcuggccaugacucuuuucuggaaacugccugacccagaggguccugcccaccuccugaaggugauggagaugagaucccucccccuagugucugagcaaaccacaugcuguacccagcaggguccucccagcuuacuuaccccucccucuuuguaacuaaacuccaugggcagccagggcugggcaagauucaccgaccaccacucaggagcuagcaucucucucccucuccuugacaaagaagaucuuagaccaccaaucuagaagccaccagggcucaguggcuccuggcuccuggcuccuggcuccuggcuccugaggaggcugggcaaaggcaagcucugcugagcaaacuucccgagggcugaacaauccaauucaggaagaaagcacaguguaagcacagacuuccucuggggcaggacaagcccucuuccuccaccagguccaggccaccagagucaggaacuuaacaacgcucauucuaaugaccugcauccccaggaggauuccaugcaagugucugaaggcugcccaccuuggcaaauggggcuccugcacaaaaagguaacagaguagcggcuucuccagcaccuuucaucucagggaucuuaggauccagcaggcaaguuauagaaagcagcaagccauguuugcuagacauuccuacagugguuaagguuaaggcccuuuggggucuuuaugcccugagaaaagcccacuccugcugcaaacacaugcagugccuccauccucgaaagaccagcaaugaagccucagggguccuggcacuuugggagguaaggcaggggguuggguggccuuaaggacauaccaagaaugccaguggggacaggguguccagagacuugcccuggauacccugggcaaucgucucccuuugcaaggcaaacagccauccgaauucacuuuugugagccugguucuugcugugccucagaggcauaaacagaccucuggacaaccaguggagguccuccccugcccagguggcaagacuagccacaaggaggucaccuaguggaacaucuaaagcaauuagcugcggggucgguugaguagaauccugagccagaggcuggcagggcaccaagaaacuaggcagccaggaagugcugccucgagguggccaggggaggcagcaaggagggcagccagcccauuccuggagaugacuuucugugacccugcccuugaaaaaugaagugcccugccccucucaggcagccugugagaauaagagccaccugguagcagugagggccaggugcagcucagcucccucuccuguucccuaaagcaggugcuguucucggacaaugucuacugggcucgcucagggcaucaagccugcuuucaucagccuggguuauugaagcugugggcacucccuguggacaucuugggcaacaccagugcaccugcuaaucuauccuguugcucugagugccuaagacacagacaccagccaaggccuggaugggcuugcacacagacaccagucacuccuggaggcuccugagucucucuugucacaacugacccacaccaaaaggucggcuuccagcuugcuuacuccuccuguagagacuaacaucuaagcgcugucccucuaucccaagugaaugcccugggggaucuccuagguugguguacugcaagugucccccuccacaagccacagcagagucccugaguuuaagggaccgacucucagucugguuucugcuuucugugauuagcccuuccuugccuccccuagggucauaguggcaccagcccuaagagucgugcgugcagggagguuacucacacggugaagugguacacgaaacacuuccaacccguggggcgcucgaggaaguuguagacucggcccuggaugugggugcgcgccagcagcgggcggcgcgcacuguagauggagacccgcgggucaaggcucacccgcggacgugggccgaggucugcaggggccggggcgggcgacacuggggucgacauggggggcgcgagcccgggggcuccgguuggcgcgaugggcgcauagaccgugcugcccucagggccaccuucggccagcuccagugagaagggacacuucuugaccaccgcgcugccccgccgggcgccuagcaggcggcuccaacccgcgcgcuuccuuucagcacugggcggggacgaggccguguccauggccagacaggaccccugaccccgcugcuccucggagcugaggugaaggcagcgcagagcgcagggcgcagcgcggguagccacugcugccagcccagccacggggggccgcugucugcuccgccugggggcgggggcgggguugguccccggggauggcaugucccgcccccaggacgccccgccccugggcgccaccgcgcgccuaccugcggccuugcucagccagcggguuaccugcuccgccaagccaagucaggcuaucuccgcguuccgggcugggcgcaccugcugggcgcacgugcuuccccgcaccccgaggaccgcccgccugcuuggcucuaggguccuccaaccugggaccagcagauaccaccaccacgaaucacaagcacccuuuuucucgcuaucugaaccuacccuagagagggagcgggaggcagaaaagggcaucccaggccacgcauggacacuuuccggcacagaaugaggaaguguuagcccagcggacacugagcacccuuggguguccagaagccucuguuggcggcggagaaugcgaaaaucucuucccaguaguuaaucgcagcccauaagacagcgggauggaggagaugggaacagaccaagaguggugcucacuaagaguggggucaaaggcaagugcuagauugcggguuuuacagguagacaccgcccgcggggcugccugagcguuuacauguuuacacucccuuuaaguuuguaccucuccagagugacacagaaggagcuuuaugucccgugguggugugaggauagucagaagguuugugcagcuggcucuugcuacacuggccuuugugugggauggaagggcaccugcaucccaggacaauuccaaaaucccauucuccugugauccgccacacccaccucucacaccacucacaagaauaacuuucagauaccguccuguuagcuucaguugucaacuugacacagccuagggucaucugagaagggaaucaguaggaggacugccuaaauuggauuagacugugggugugucugaggaagauugucuugauugucuuaguugaugugggaagacacagcccacugugggccgugucuguuuccugggcaggugggccuaagcuauauaagaaagguagcugggcaugagccugagaacaaacaaacaagcaagcagcgcuccucuggguuuucugcucaacuuccuugguugugaaugaguucuuugaugggaguuggugcuauguagaauauugagcaggccugccuccagguuccugguugagguccuucucuggccccccuuugaagaugggcuguaauugguaagcugaaauaaacccuuuccucacccaagcugcucuugguccugguguuuaucgcagugauggaaggauacgagaacagguggaucaaaggcuuuggugaaagcugugcagaaagaacaaaggugaggggccauugcuauaaccagagguagagugugugccugguguaugcaaggaccuaggucugaugaggaugugggggaagagcaccugccucaagaaacugucacuaaggaaaacauuuccaacugugcugugaaauccggaagcggcagauaaagcagaaaguugccgcaggggaaguaggagauaggagacaaggccguuuucaccaccacaggcaaaggauuaauaauaaucauucauacauaaggaccaucuaaagccugggcagacugccgcagccagugcugugggagagugggcugaaaacaggauccgaacacagggaaagaggcaugcagccuuggugccucagggggaaaacauucucagccucacucauaauaagaaaaugcaaauuaaaaguacacucugauaccagcggcccacuaucugauuggcaaaacuccagauguuugacggcacaaucuuugggagaggccaggguggcaggugcuuuccuaaucacccgugggaagggcaucuuggcagccuuagcaagagcguaugugccuuuugaccuggaaaucccaccacuaauagccaacccaaagacaaacgagaaaaacagaagaugaaggugggcaugguggagcacaccuguaaucugaguacuugagagguaggaguuuacaagaguauuaggaauucaaggccauccucaccgacauaguaaguucaaggccaaccugggcuauguaaggagagagagagagagagagagagagagagagagagagagaauacauaagcauauaaaccugugugcuuacugcaacguggcuuauauuagcaaaagauaagcagcugaaaugauggcucagugguuaagagaacuugccucucaagcaugaagacuaguguuaagaauccaucacucauauaaaugccaagugugacccucugcaugcuuguguguggggcggggggcaaagacucugggacuucuggcuccagccuaacugaaaaacucaaacucuaagguugaacaagggacccugccaaggcaaagagugauauaauaggacaccagagacccucugcugccuucugcaaaugcucacaagcgcauguucacacaccugugaguccaucacacacacacacacacacacacacacacacaaagacaaacacauugcgguucuguugguugacuuauacucuaacagagccacacaauaaagguucaugacagucauuaucacuaauauccaaaggaaaaaaauaauugaaccauagguaauaauauugguagguuccuacuccagaugacccccaggcuaaaauucucagugcucaagucuuucacguaaaguaggggagucuguguuuagaaacuaugugcauccuccaguguagcucaacccaucucuagauuccucaaaauaccgagcacaaugggaauguuagguggaguagucuacauuauauuguuggggaaagaauaagagcugugcuaguccaauccagaaguaauuuguuuuucaaauaucuuccaucugguguggguugcagaaccuggagauuugcagcaccagcugucugaacaaaucaaacauauauguuuacauaucaaauaagcaauccuuuugagucucuuaggaaccaagauauaaaagauacagauguaaaaucaaagaaguaaaaacaaaucuuuaaugugaguuuaaaauauuaccauaaucuccucuguuguuuccuuucaagauuacuuuacagcuauauccgacuaaaaacuuuggaaagaucagggugaggauggccugguuggugaauugcuugcuuggacaagcaugaagacugaguucagucccagaacccacauaaaaaugugggacauauaccaggcauaguagcccgugccuuuaaucccagcacuugggagacagaggcagguggaucucugugagugcaaggucagccucuucuacacagugaguuccaggacagucagagauguagagagaccuugucucaaaaaucaagauggacugccaccgaggaacaacaccaaaaauuugucuucugguuuucacacacauguacacacagacacacacccuugugcaccacacauacuccaccacauacaaauauauacccaugcuuguguaaacuccaccccccaaacacacacacuuggaaaagucugagcaagagcagaauucaagcagcacagcugcacagagagacucgaaucuguaaucccugaauccaagacgcugaggcaggaggauugccaugaguucaagguuuacagagugagcuccuaucuccaaaaacaaacaaauauaucaauugaagcaugccuaauauccuaaaacccaguuuguucauaauaagacuugcaaaguccucguugcccuuggacuguugcuuggcucuuuguucugaaaaugagaggggguaggguaagauguggccugccuugccuucucugcaccagcuucagggugugaggaggccaugccugccaaagguuacacacagaagaacguguggauagaagucugauguuuugaaaccaucaacaggaagaggaugggagucaggugcagauuaaaccauacugccucugaauuaggaauuguuggaacuauagugaaugcacgaauuauacugagcuauuuacuuucauguguguuuccauuuuuuuuaaauauacucauaacuguccaggucuguccugggggaagauaagaagaagaaugcucuccuaggaccuuugagauguggcucaaugggugaaguugcuugccaccaagucugacaguccagguuguauucccugggauucguauggaaggagagaacagacaacccuaacuuguccucugaccuccacacacaugccaugguacaagcauuuacauacaacaaauaaagggguuuuuguuguugugugguuugguuugguuugguuugguugguuuagggcucuuggggaugccugcccuacccuggacaaggaaucuguucugaaggacacugaggcagagaggaggcugggcaaggggcugcuaugagguccuugcccucuccaaaaagcuggacagagaaugucucuguguguguguguguguguguguguguguguguguguguguguguguguguguuggggggaacagaacagggugggaaccaaagagagggacucuagguauucuagguauacuguugagcacggaacuaagaggggcugggcucagggugggacugaaguugaagcugaggaaauaaaaucuaguggcuccgaagcaggaaacacaaaaaguccugcauauggguggguaucaugaagagaccaaacccaugacgacuguggaaguggguaaggauccuugaggggcacaucagccaagaagagaaaacucucuugugguagagucugaguagauugcuuaggccauggaggucuguuacucuggguaugggacucuggggugccaccugcucucugccggacuccugcuuuaucaaggaagcaccucccacuuccacagucauugagugggugcacacaucccaucaggcugccuccuggaagaucacccucucacuaccugucuccaagccuuggaauguucuagaaaucuggugccugcccuuuuacaugcugacucucuaaggacucuuugccaauucaucugcacccccuugcccacuuacuccucguucaucuggugaagucagaggguaacaauggggggggugcguuugagacuaucaugacgguaaaacuagggcugaugucuucuauaaggaccagagucuaccagccaagaggccuguuggagcagucugacucccaaagguuucccagaugucaucuuuuuuucugauuaauuucccauaauuaauuaguucauucaauccuaaaaucuuguaugcacugccauggagccauuagguagaguugagcaaaaauagugagcagacuggaggugcccacuauccuagacaauguuaaccaucaacauggcacaaccuagaauuaccugagauacaaaacaccaauugaugaauugccuagaccagacuggccuuuuagcaugucuauuagggauugucuugauuguuaauagauuuggaaagaacuagcucaggguaguggcaccauccccugggcagaugguccuggacuguguaagaaagccuguuaaucaugagucugagugaaccagcaagcucuguuccucugugauuucugcuucaaaugcccugaguuaccucaaugauggaccuggaaggugaaauaaaccuuuuuccucccuuaaguugcuucuggucaguguuaaaucacagaaacauaaaucaaacuagaacacucaauuaagggcucaaagugucuccacagagucgcuucaguuagcccugauguggaaacuucuagucuuuggaaaguuaguuaugucaaaugauguuuugcuggggcacacaggugaaaggauguuuuugauauagcaaacacaugaaaggaccuuuggugaaggaguauguauuuggccccacagacaguggaggagaagcucugcaucacucuucuucucuaaugacacacaugcauugguuugccuuauauagcauuauugaacucaacuugugauaacgcugccauugagagaaacucgcccaagagcugcucaugggguucuugccacagcuugcugccuucauggccucuccuugggcugguuggugagccuugcaguuccuucaggauugcacuauagcugcuaguucgugccugaugucugccugccgaaaggacuggacugaagcuaauggguuugugugugguaucuuccugccuagaggacuugucugcagcugcugagucauauuugguguuggcuacaggacagaacggcugccaaagaagaucaggcucacccccagagaacuguugcugagcagcuccacuucccccacauccuaauaacuuuucucuuccacuaccucuucugggugguagacuagaggagacguugaacucuuauuaaaaguagguugcaaagaaucuaugccuacauagccugggggagaauuugcuggcaaagcucucuucaugcaguagucacucaaucuuaaacagcugggugguggaggaggcaggagggaggggguaugaggaauggagcuucccacugugaaccacugauaucucucuguagccccucccccccacuggugacuauugucuauccuuguggauggaacaggcagcaguaaggcuguacuuccaucucuccugcaucuuacaggcagaugcugggguguccucuccucaucugggcacauaaagaucuguccucucaaucagcuugcucuccagccugggaaggggcaucuagugccuucucuaugcaaacacuggggugguguugcuauucccucccaugaagggaccccagagucgguaggacaaaaacaauugggcuuguccagcauccuuuggcccugauaucuuauccucccucccacgcacacuguaucugaagucaucucacuaggugcaccaagaacccacugugcucugcucugugggagaaggcuggacagucauuugugaagaaaguuuccuucugagccaguccauaugcagaauagaaggagcuaggcaugcugucauuccgccacuccuuacccauaggccacacccacccacacucuccucuuccaagaugccaagcugguaaccggcugagaauacugaggguugugugcaagugugugcagugugcauguaugucagacacauucaaacagccuuuugugagcucccuuuugugacugcuccaaggacagucucuuaagaacacagugggaaggauguguucagaggggagaccagcagcccaauaaggcaccaggaaccaccccauggggccacaguuauacacaauuuaacaaaguugugugaggguuaacuggugaccaggcugucucugcaaaugauacccugucauucccucaccagcaccaagccagugcuagugagguaucagaacuuacuuuagucuuacauagugcuuacuuuagucugaaguugagaccugugguaaagcugccuaagaucuugcucaggucucuagaaagccacacauaccccugaggccccaucuaagcaugaaaagcacuucuaggcaggagggcuguuggcacuuggcuuaugcugauagauucaguucuagcaaauacugaagggcccccuuccagggagcuaccaccaucugccacagaauucacuccucuccuaccaagugguauccuaggagcagccccgggaccucaaaggucucagaccuccaccagagcaugagguaauagccugcucaaaagcacagcccacuacacucaggaucccuuagcugguagcaucccugacaccucuagcccaacaguacuccaucuuagacauuugcuaagccacgaagccuccacuugguggauagaaauguauuggguauuucuagccaaauccaaugccauggugagcagucccagucagaauuuuuguccguauccaugauaucaaaugggcaacacagcuggagggcucaccaugccaaaccaccaugaccccacacaaggcugaagcccagaacaggggcagggcaacugaggaacagaagagaaggcaggaacgacucaguugcuggcagaauuuucuaggcacccacugcuucuaguuacacuguggggaaggcuggaacaauagacagaaaggccccaauucaggagauacagaucacaucugugagauguacagauggagggaggaagcacaugaaaaccucacaugccacucaugugcucugaccagccccagcccuuaugugacccagagccugagaagcagcugccgacauucccaugugugggcaucguguaacagggaguugauucaccucuaugagucuaggcacagaggcuccugacuaugagugaauaacuggagagaaaugaguggguggcuuuauagguggguggguugcuuggauggugaugggaaguggguaguaggugggaacuuguauagaugaaugaguggaugaauggauggguagucagcugauuggauggauggagggauggaugaauggaugguguuaucuggguagauagauguauaaauggguaaauggaugaauagcuaguggacaggaggaugaauggauagauggaugguaauaaugagauagaggcaugaguugguagacauaaggauagauggauaauuagauggaugauggauggugacaaguaguagaguugauacguagauagaaugaaaauagccccuauaggcucauagaaauuagcacuauuaggagguauggucuuguuggaggaaguaugucacugaggguggguuuugauguuucagaaguucaagccaagcccagugucucugucacuuccugaugcugaugccugcugacccaaauauccuucuccagcauuauggcugccugcaugccaccaugcauucuaucaugacaauaaugaacuaaaccuuugaaucuguaaggaagccccaauuaaacguuuuccuuuauaagaguuuccauggucauagugucucuucacagcaauagaaacccuaacuaagucagauguauagcaagauagauggaugguagaugaauggguaaaucgguggauggaucaguagguggacggacggauggauggaucgauuaauugaucagugagugaauggccugauuagucuugauugucaacuugacaagauuuagaaucgcuuuaggagaacugucucugggcaugucugagaggauuaagauuggggaggauccacaccagaaaguaauccuggucuaaagaggucccaaggaaagagcaauggccacuuucccuugcuucuuccuccugagcaaguguguccaucacugcuguugcuguccucuguugacuucagacuccagcuacuuugguuuuccaacaugaacugaacagcagugauucuccagggaucuucuaagacugauuggaaccagacugggcuuacugagguggcugacugacuuccugggcucugcagacacugggucuuaguucugcagcauguagauggucauuguuagacuacuugguaccuaucauguaagcaacccuauaaaucucauuaauauguauauauucuaugaguucugcuccucuggagaaggcugcugaacucuuagauggauggaugaugauacacagauuaaugugucuggaggcuuggcuggguagggacauaggcagaaagaagguggugggugucaguuagaugccuucauaggaacagggacaguggcucagugauaaaacauuugcuacacaagcauacagacaaguucagaguccuggaacccagauaaaacuauacauaguguguaucugugaucuuaauacuccuacaauaaguugggaggugaaggcaagagaaucccaggaagcacaaguuccagaaagucuaguguaugugauggcaaagaagagacccugucucaaacagggcaaggcaagggaugacauauggcaugcaugcaucugcacgcauacacacacacacacacacac

SEQ ID NO: 31 - RNA, 22657 nt, Mus musculus
gacagauugcaggagucaguucucuccuuuuaccauguggggccccaggguagucagguggucaggcuuggcaacaagugccuauauucacagaacucucauccccccccuccuucuccuccucccccccucccccucccccuccccuuccuccuccuccuccuccuccuccuccugucuucugucuuuugaugcuggagacagagcccagggacucacauguuaaguaaguguucuaccacugagcucugucucagcuucucuucucuucccccacccugcacucuucucuucacccccuccucccuccucaucuaugagcugggcucuggguugaagcagagcaccaucaaaaucauugugaacaucuaagggcagauccugaacugugugauguaacccaagaauguaaaaaaggcaaagcccaaauucccugacccuugagggcaccaugaacaaagaaaagaaagguucagcugugaacaggaagacggaggauacagaccucucaccagggaccaagaacuggacacugccuguuguugggcaucucaucccuaggaacuaugacuguuuucuuuguaggugauaaugggguuugaaccuagggccuugcacaugcgaggugaaugcucuaccauuaagcuauuucuucagcuacccugugaacuaugacaaaacacuugacacugugaugcauaugaaagcugaaaguauuucugacauucaaauagcuugcacauccaggacaaggcaccuguagguuagcaacugucaugggcugcuuucuacuuccaagaugguagcuagugcaagggaaaugaaggugucugagacuucaugauggaauccacucucccaagccuuaaugcucaauaagacuaucacacaggccuccuggacacaggccccucccagcccagccccgaguaucagacaucuucacccuguccucucaggucugcauucacuacaucuuuaaggcuaaguaaggaauugucauccaaaccuuggacuuugguucaagacugaagguuaaauguuaaggccaaaggauaaaccuccaugauaccaucaacaugaaauccacccccacccccacccccacccccacccccacccccagagauuaaggaacagggcugggacucccuuuuacaugcaaagaccaugaaaugucuccuaggccucacaccagacaugggugggaauggaauuaucauuaugggagccuugggcucuuuacagauagaagcaucuagucuacuaugugaagaccagagaaaguuuaauauacccugaggacacugacaccguacucugcauccuaugcuccucaucaaaaaggggaaacaggcccacagagggaagcaaacucgucugccuuuuucaugaccgagaagccagacccauagggaagcaagaggagucagacuguggcaaggagaggaaacacagaacaggaagagcccaguguagcuacagccuccugcugcccagagccaggcuggacccaccacagucaaugugaguuggacagcuacaaucccuguuuacauggauacugaccaaggagcuuagcuuucucugagcaugcagcuaugagccaaccaucucaauccaagccccagcccaugaucccuaggacugcaaaugugccccugggguagcccccugggaaaauaaguaggugguuucaaggcaaagaauaaaaacuuauauuuuuccaaauuuuacauacauauauuuguuuguuuguuuguuuguuuguuuguuuauguugaggcugggucuuauguagcucagccuggcuuugaacucacuauguacuagagaaugaccuugaauuucugauccuccuuccuccaccucuuggccuauuccaccaugcuuagguaagaaaagauaaguucuaacugcauacaaaccauuaugguccuaaaggguagcucaugguagcugaggaacccagucugucucucaguugaugagacccucagcuugcuaggcuccuucaaccauuagcauccccaugagcuacuucccuucuuaguuccuauugaucaccaaagauggaucaaugacuccaaagcucaguagcaacauaggaaaagucagggccccaaggcaagcauacaugggaugccuuccuccagcauggagcuacccaacaaggaaguaagagaguggauacacaguaguauugaguacaaaauuacccagcaucuccuaagacuugguaagggccuuacagaaaacagugugagaugggcgccacugaugaaggcucuuggauugggaaaugcugaugaaggccccugaaagcagagaagaagacuugcuugcuggacaaagccagugaugcauaaaugcagugcgcaugugcaggaagcagggaucugcucaccucacuauagaaaaaaaaaaaaaaaaaagaaagaaagaaagaaagaaaaaagaaaaaaaucggaaacagaaguuuaagaugaguaaaauguaaccauccuugaaaggcggaggggagcuugcuguuauuuuguguuagaguacgaaucauugacccuguuuucaaacuccucuaagaagcuuucaggaaguguaagcaauacuauuacaaggugcugagaaaauuccagaucagauacaaaguuaccgaaaaagaaacauuaaggcccagauggugcugaugccaaacuucacaauuucccugaguucuaucccugggacccacaccaaggaaggagagaacugacuccccaaguugcccucugaucuccagacaucauacacacaauacacaugcucacacacacacacacacacacacacacacacacacacacacacacacacaugucuacucauaaauguagggcccaagagagucaaaguucacuggauaaagacuucaugucacugaguaugaagaccugaauucaauuuuccagacccacaugguggagagauagagccaacucucacaaguuguucucugacuuccacaugugugagcacauacaaacauacauacaaaaaauuaaauguaauaaaauaaauaaauguaaaagcagaauuuaaagcagaaaauagaugugugugcaaauacauacaagcauugugugauaagguacaugcauaugcucauguguaucauguacacacacauacacacaacacagaaacaaagucagaagguugccagugagugccuuggcuaaguauuuuaguggcucugucucacuggcuccugaauucaguguccuugccaaccugugccggcaguuaauugguuccugccuacgugcacauuuuccugauguggcaaacagaaagccauuugggaauuuuaaacaauuuuuuuucuuuuuuggacacaggguuuuguauagccaggcugcccuucaacuugcuguguaacaaagaugacuuucaacuucugguuguccugucuccaccucugagagcuggggucccaggcaugcaucaucacacuggauugaugugaugcuggggauggaauccaggacuuccuguaugccaggcaagugcucaacggacugaguggcaucuccagacccaagaauuuauuuuaaucuuuuuuuaaauuucuuuaugaauccugguuacaguccauuaaaagcugugcguauuuaacauauuacaugaguucucuacucauuggugacucuuacggcuuuggccuuuuuuuuuuucauuuucauguauagaguucauauauguguaugcacauguauaugcauuaauugcacauauguauaauauacaugaguguccacuuguauauuguucaaauguguggauguacaugugugugcauguaugcucaauggaccugggguugacacugagucuucaguuucucaccaucuuauucacugaagcagagaggcagagucucuuaguugaacccagagcucaaugauguggcuggacuccagagaucaccugucucugucgucuaaguucuggaacuacuggcaggccaccauacucaccugguauuuaccuggguucugaggaucugaaguccuacuaucuguguuuauaugacaaacacauuaaccaugaaaccaucccugaccuuaauuuguuuugaaauuuuaugcuuguguguguguguguauguguccaccucccauuaccucuacuguccuccuuccuagaagugcacugaacucauuaagaaguuuuuuauuuuuuuucuuuuacugcugaguauuuugcucaaaggggaaaaaaaugcuuguguuugaaaaucagaugacagcuaccuuaugcccugaagucaacuccacacuaagagcugcucugccaggauggcuguagauucuuugucccucucgccccugagaagcaaacucugccuccuguuucuuuuuguuuguuuguuugguuugguuugguuugguuugguuugguuugguuugguuugguuugguuugguuugguuugguuugguuuuugagacaggguuucucuguauagcccuggcuguccuggaacucacuuuguagaccaggcuggccucgaauucagaaauccaccugccucugccucccgagugcugggauuaaaggccugugccaccaccgccugucuuuugccuccuguuucuugagucuggaagucucugugcugagaaucacaugcaacaaagguaaugagauaccacuuucagggccggguuaagagguugcucugcuucugccugggacacggagacacacacacacacacacacacacacacacacacacacacacacacaaacuacuagcucauggccucuggcauccacaggcccaaggacaagaccaagugcagggguggggguggggaaugcugcuggcaguuucuuccuggaugaggcaggggaugagcuguguuggagguugaucucaauucugguacucucuacacuccugccccaugaagcacagccacacuauuuccccagcuuuccccagcucuccccagacucccaacucauaaccacagacacugucucaaccacacagcauagaccaguucuugacuugacaaaagacuugggacaguugcuagcugugaaagagaagacaccaguugugauccacaccugacuccaugcugguagugugugaggcagauguagccauggcgagagcuggacagcaugggaacugaaauagugcugaagccauguggacgaaggagaaagaucauuuccagagcuucuaagggcaguaaagaucaaagcauuucuucccaaguccauaaggcuggcugagugaggccacuuccccuuuguaaucccaggcuaaucuacaucgcacaucccaagauagucaguaucuccacagcuggauuugguauugguaggaacugucucugacucucaagagucugugaaucauuucuggacauauuuccacuuguauuaguucauauccuguuacuauaacauaugaaacuggauaccuuaucaaaugaaaagauuugcuuaucucagaguuucauagguuuuaggagacaauacaauaccaggaccugcugguuucuguugagagcuucaugguaggcaccugggagaggaagaaaacacaucacaaggugggaaaccagagaaugaugaaggaucccacuauccuuucccagggucuacuuccaguuuacuaaggaccuccagcuaucuccuccaccucuucggaccaaaauccggggcacagagcuuucaucccaugagcccuugggaugaaaacauucaaacauuguucaaaacauagcaccaaguccccagaaugccaagacagugccaccagguuucuguuguccuucuuguagauggugaucugggaaguguaucuguuaacuugguuuucacugugcugcauaacaagcacaccccauacccucaauggauggcagaaagcaaggagcauuucucacucuaugacagccagacuaguggguuguggauuaacuuucugcucugucuucugggaaggagcagccagucucagauguugacagucccaaggcugagacaaaauggcagaagguuuucaaagcaacauagaacagucauauuuugcuaggcagcaagagucacaugugaaggucugauagagugcaagagaggcagacuguccugcaaggaagggcagcagacauccugguaauacugcaagugaccucaaagccaguuagaggauuaagcacagcucugauucuucauuuuaggccaggucaaagaagccaaugaacagagauaaagucucaguccucgguucuuuuuaauuaugcugucuuggucaugugcaagcuggaagaagguuucuauccuuaaauuuaaaauuauuuuccuuuugagauaggguccccacuagcaacucagacugaccuggaguucuuggggcacuagacaugaaccauacacaucugauucuagguuugacuuuccauuuucuuuuuguacuauagacuaauucaaggggcguuuuuaacuggagguuuuuguuuuagaacaucuuguuuggccuaggacaaucucuaaagcucucagguugcuaaaucacauccccaguacagauuuucuuucuuuucuuauuuuuauuacuguguguguguguguguguguguguauguaugugugugugucuguguguguauacacauggaguacacauaguacaacuugugggaacugguuuucacuuuucaccaccuggguaucagggaucaaacccaggccaucagccuuggcaucagguaccuuugcuuguugagucauuuugccagccgguuucuguucucugguucaucugaacuggugguagacaugauacaaagagaagaagcccugaaaacugguccccaauaggaacucccuuguuguugggaucagaacacuguaggcccucugggagguagcauggugcuuugucucaaaacuaaacaggcuccuuccaugggucacaucaacugagcuucuugguauuugaacaauuggauguauacagauguuuacauggacuugacucaaacuugccuaaacuuaaagcagccauguuacccuucagaggaggugggacaaauaguguagagcacccuacagccacaauaauugugugcuaaaaagaaagggaagccacaaaaaaagcaccuugaauggacgaagcuagucuaaaaaagaugcacacagucauucugaaagacaagacuaugggggccaaaaagaucaggguugcuggggguagaggcagagggcagauggauuccacucuuugaucauauggugaacacagggcaucacucauugucuaagccuguagacaggacaacccaccaaaugugagccugaauguaaauugugaacuuucacuaaugacaaugugucaaaaacaaaacagcagaagcccagaucugugguguugacccuggagagcagccagacuaugcaccgguccguucucuccugugccagcagugguacugggcaagcuagcuugccucucuaagccucagucccuacaucuguaacaugggugcucacaccucaccagagggcuguugagauaaugaaccuguucugagguucuugaaggaaaagcagcgugcugaggggccugaauugcaacuuacaucucaaagcaggaagcuuggcccguccccucucugcacucugacaaccugcucccacccccauuccucacaugcacucuagaaacuucaggccuuccagcuaaauacaucucacagcaaucccaaaccccuugccucuacucuagcuccaggaauaccccagagccucagggccucagucaugcauggucccucugccagucccauugaucuuguucagccaggaugugcaaggggccaggaaccccacugcaccccauuuuaagcaaaacuuggguguuccuugccuguguccaacacuggucuuuguguacugugguucacuggguugauauuugcuuccaacacagagggucuugaggagccuggaacucaagccugaacugcagcuuuagucuucuguguucgcuggcauccuuuagcauauuagccaccuagccucuguagcccagcacccuccugcugugccccaccuuccugcugacuuuccugcucucugccugcacuggagcccuuugccuucauucaccacugccuuacacaaaacccugccaaucagacucuagaggucaagggacaaagguagcccagcagucacaucccaaagugcacacucacccucaauagcauaacccauaugaugguagucuaagucccaccaaggccccaggcagccccugagagccugacggccccucauggccucccuuucuccucuuccucugcuccugcauagucacccuucuucccuuuccuccuucaugguccaggcuguucuguugagggauccuggaucacccccaucuagaccuuucccaguaugaccuccuacccaccaucaugugucauuaccacucggaugguuaguuccacaggccuaccaacuaccccccccccugccuugggcacaggacagggcaguaccacccaacauccugcaugucuaaggcaguagccauaggacaccaaauauuucccagcucaaacagagaaacuuguucccaaggucaagcaggccugacuaggaccacacgggcucagacucacaugugugauguuguuuccucgaucagguaucuugaauaucugcugcagacccugccacacccaugaaauggccucuguguucucacacagcccuggaugcuucugaggaacccccaaagcaacacagaauguggggguuacaggugggcccuagguccaaguguuugugagaaucauggcaaagaacagaggccuggccgaccuucacacagaggccucucugcugugugugugccacauggcucacuguaguccuugagacuccacgacuaccugccagguuucuggcccagcaugcuccuaauaguugggaccuaacccauaccucugcuguccagcaccucaaguaccaugcccacccucaagacaucaaagaaagggcugcccuagcacacaccuccaugggcacauacaguaaguagcuuucuuugcuggguucuaauuccugggcaagcugagggcugcugcaggcagcagggccugccuuccuugaaguauacccucucaaugggaugggggcauuucucaaagucugaccacacugggccucuaagguguucagggaagguuagguuaaucauacacccccacacaucuguaacaucuugguccagccuugaacagccugauaauguccauggguucuucucucuuggcccacagaacuuugcaagggcuucaugggccagucugguuuauaucaccuucuccuuugaaagccaucacuuuauaggccagguauaaagaacccuucccuuuuugaacuaaagggggucucuuuggauccaguggacuggcaggagacagggcauggcgauguaggagccacagcuuugaguucucgcacacaaacuagaucaggacccauccccaguccaccccacccuguguucuucccuaguaucuuucaucacccccuccccaucccuacuaaacuaucacgaugccaacuuuugggaaagcucugguguauagaccuaggggcccuggagccuucagugccccacugugaucgcauggagaacuucuguguguacaugggaguuuacauuguucuaaacccugcaagugcccaucagggucuggcuggacaaaaacaugagcgucuguuagggacagacacuuguuucucaaacuccugagaagcaggucaguagguccugugaaaguuguuccccuuccuuguaagcagccaacaacucugucaagugguggcaauauuuggcugacuccuucuuugacacccaccauauucauuugccuuggcgcugagcuacaaaaguguaaaagaacaagaagacuacaaguaugauuuuuguugggccucuuuauuuagaaccuggcggacgaggagcccugggcaguugguaugggcaguacaggaaccauuucgacugucuggucaccaaguuuaagagcaaucuaaugaagugggggacacuguaagcuaacugaagaugaaugugugggggcuuuuacucaacaaccauuccccuagagucuaauauaaaaguagauuuacauuuguggguaaucugaagcuggugauuucuagugccuuugguaauaaucaauaacccagcaguugcguggcagagggauccacgcauggauaaauacaaauauuaaauuagcauaauuuuuuaacuuuuuguacaaauauacaugcuuuuuccuuuuucucaucuuuuuccuucguucuacauuuucuaguuucucuuuuuguuuugcacugagagcgaguagagauuaaacauuuuacauaaaugauuuaaagcuuuacaccuugggaccagcguacuccuugcacaugguacagaguguucucaauacauugcacaguuuucagauuuccacaaaaccgugggcugcucuacgcaaccaucuccgguuccugcuacaugaacgaaaggucccagccgaagcccagaguucuuccaucguccgcugcccagaugcccagcaaguucucucuggccguuagccucuaaacugugggaagagggacucaggugagcaggcauagcgggaaccccccgggggcggccccuccgcgacccccgugggggacgccagacucaccuaacucaucucagacguuugcgcggggucugcuccaccgcgcccaccccaggagccacguuuggagagggacacccuggagggacgucguucgacgccuuguucuccugcgcaguucucuugcgcuuggcgaagaagucugcgggcgacaacgcgcgucggucagggcggggccggcccagagacccgcgaggagacccgcggagugcgcagggcgcggggccggggugggggcgccauccccgcccgcgccgagguccgcggcgggucagcuuuguuuacgucgccgcgcaaugugcuguguaagcauuuccccuugucccgcggccaagccccccggggcugccgccgcacuuaacccccuccaugccgcacacacggcucccuaaggggcucccgcggcccgagccaaagaccgcgauccgagugggucgcggccaggcucgcccucccacugcacgcucgggagccuuagcugcaccccuaccaguaggaaaggggugcgggcgcaaccgcgcccuaagcgccgcgggcccuuuaaugccacgggaggaggcggggaccgggcgaggcccccgagggcgagggagagcccggccggccggacaaagcgaggccgggccggggcggggccgugcggggcucaccggagaugagaggccccgacagcuucuugaucgcaccguucgcauuggccgcagcagucccgggugcaggacguccuggaauccccgagagaggcugguccuucagcuccuggccgcgcugcucuugauucucguccugcuccucgaccggcuccccauucugcuccucgaccggcuccgcacccugcuccucgaccggcuccgcgcccugcuccuccuccggcuccucguccuucuccucgaccggcucugcgcccugcuccucgcccugcucagagaccggcucaguucccagcucaucacccggcucagcacccgacuccucgcccugcucagagaccugcucagggaccuguuccucgccgucccgagucgccacguccggguucgcguccgggaucggguccggagucgggucggaggucgcgaccagggucaccuccggaauugggucugaggucagaucugaagccggggccggggucgcggguggggugggcuccgcgaccacggccgaggcuggggcgcugggcggcugcucaggcgccuccucuaggccgucgggggccucgccagccggcggcccagaacgcgggaugacagccacggccaccggggguggccggggccccagcugcaggcgacagcgccccaccugcaccgucucgcgguagaaggcgggcacagacucgcuguccaccuccauccacugcagacgaccagggccucgaagaggcacauccugcuggaaguugaagucccagcgguucugguccucggcguucagcucggccaggcgcauccgcagcucgcggcccagcuccucguggucuacaggcccgaagaggcugcggcaggcgcugcuacgcgcuaucacugggaagguaucgcuggaggccaagcguuccaucgcuguucugcugcggagguacacgucggacaugcccauggucgaaggcugugcaaacgcgggcagcgagaaagaagggaacgggaggagaaggaagaggggagaggaggagggcggaggcugggcgugggugagaccccuugcacagcccgcguccgccucugccuaaggacgcagcggcuaccuggcugauuggugauggacggcuccugcgucuggaucgcuuguccuguccagcuugggccgcgcccccucggagcuugccugccuguucgcuugcucucagucgggccuagccggcaccccucgagcacagcgcacucggccuguggaacgcccagcccgcugcgccccuuuauacgcgcuggccccacccccgcgcgcgcgggccuccucacgauuagcauaauguaguauuuucaguuucaacaacaccgcggcgauuggagggugcagcccgccccgcccacagaggcccugcccccgcgccacgcucauuggcugcgcgcacacacccccggggccgggcggggcgggugacgggcgggcgcugauuggcggccgcacggcgagcgggcugcgcgggacaaggggcggggcucgaguuaaagagcucugcgggcgguaacgugacaccgcgacgccccucccccucgccccauccccccccccgccccccgcgggcuccuuugucugcaggcgggggcucgcgcagccgcgacgcgcgcgcccccucggaccauggagcugggcacagccccucggcgaugccgacgucggugaaggucccucgguccccgcagcccgcgcuagcccuaggacugcaccaacugauuagggcuuuaaccuacuacuaccagcuggguccugguccuggcaguaccguggcuggauccacccucuacacccaggccuaaguaucugccuucgaggcaucugcacaccugcuggcccuaagacccucuaucacggaguuagagacaggggucacauccauucuuuuccugaggaacaauacuguagagaucuaaaagaucuguagccuggucuauaauaggcccaccuacccgggagaugagacacaaguugggcccauccuagccuguaccuacaucacugauagaugccuaggaccuuagguuugggucaggccauauucgacccccaguucugccuaccuuaguuggcuggaaguaguuaugcuagaaaagagagaaugaccccuccuccacagcagugccucuugguggggcccugaauacucacacaaacacacccgacauggccugacagagccccccccccgccccccgccccugcugccuccgcuaccgccgccaaaaggaguucauuauuuagggcagggagucgagaaggugacucaggcaugugccaggagcuggcccccuccccccgcccuggggaaccaggacuuccggacauacuugaaaggcccugcagagccccaagcucucagcucccagcagagaugccugugagacuuuugagacagaacccuauuuacaggguuagguaaguugggccaacccgggagucaagucaaacccugaagccaggggccagacuguccuggaacaggugagagacgggguuuggaagcugcucugguggagagaccagagccugugaccuguaaggauuucuuuuucucgguacaccauauuacaaaucucucagggcauugguaugucacaguaauuuucuugaguaaaauaaaacuaaugagggcuuucaaggggccucaugaaccccucauucacuaaaagcuaaaauccacuagcccagggcaggaaggaggcagggcuuuguucugucccugugucaaagccacaugggccucuucagagacccuggucacaggaccacacuccacacuuauuugugaccaccuggccuccagggucuccccaacaguccaaauauccaggcugcagcugucgaggcuagagaagguccacccugcccacaaccuaggccaaagcugcugagaggacugacugaacgugcucccugggguguggagcuacugggcccuauuuguugggagaagcagucuagacagccagauagaucaucugugcugcaggcugccucacugggcaucccuaccccaggaugcuugcaucacuugcuuucuccuuucauauucccguuucaucugcuuguuuguccgucuccacacagguuaaagugagcccuccacaagucuguaacggugaaguuccaucaaugcuagcuagcaucaacagaccugguaagcacacugcuuccagaagcaggguuaaguuccccaucuagcccuccaacccaagggaccuguagguaaguaaacauuugucuggcuacaagaaucgucuucuauuuuugacauuaaaaauacauccaaaggaaacaagaacauuuuuuuuaacuguguugcugcggagaguugggggauggagcgcuggucuggugcccuggcucaucagacgcaaguuuccugacuucuuucuuguguggugugaagggguauaagccgugggaccucgaccuuggaccugguuagcaaaugagucucucccgaaaucuucccccauacccuugggcagaauggguacuucaccucuugccucucccagagcucccagaaagaccacacauccaaagaccauuucugccaccaauuguuggcgauauuucugugugcacccaauuacauuacagccauaggagcucuuuuucuaugugcccaccugacuggccgaaugaggaacagaaugagggcuguggcaagacucgggcacagccacgcugccagugauuggacuacgagauaaaauuugaaagcuggaggugacucagugguauggcacuugagauacuucucaaguaugaacgcuggcucuggguuccauccccagggccgaaaacaaacgaaugaaugaauagauagauagauaaauaaauuuuguguccuaaaucgcuaaaauccacggcgcaguuacugacugaagcuaaaacacaacaguaggcaggcggacacuucagcagucuguugcgaggaggaaacgggcugccuauauuaaaaccuugcuguggcuccuaggcgauuaaggccagcuuaaccuacacccuccagcucuucgaaccaacuccgagauuugauuagugaaucguaacacaggaagccuauuggccccagcccuccugccuuuucauucuuagaggagccuggagcagcuaagucaguuuaguuucccagaacguccccggaucgcacucacaacaacccgcauagcuggucagcuacggggacuccaagcacccccaaggaagccggguguucagggucuuccagccccuggccagaacagaguccgagucuaggaggccuguccuuggcuucaugcugcccccugguggccgacuugaacaucaccaguuucuuggcugccucaugccucccuuucuugccugcguggauggcucuccuggucauccccaccccugacccagagccccagguucuggggccuucccggaguaaccaaguguagaguugagacuugucuccccucuggcucuuaaagcugccuucucagauucuaagacccugagcugucauaucagauaaauuaaggccuugaagaauuuuccaugaaacccugagccacaugucacccauccaucaaggaagguggagaaugcagucccagggucaggacuagagggagaaggccgaagggcugggugacacacuuucuugccucuggagacuccuggagggucauggacagagaacaguccucccacagcccuucuggggucucuucauaugggugacagggguccagcugccuuccugauaaugaugcaccuucaagaaauccaaaagugucuccaucuugugccuacugugggcucugaccagcaucugauuugauccugcuuuaaucuaacacccuggagagagagaacagggcaaagacaaaggcucagagagauucagcacccugccugagaucacucagcagucagagucacuggucucuuaacuaacacuuggaccaagcccuggauggaguuugacucuguuugcgauggcgggagccccuggaauguccccccccccguagucccccaagucuccaacuccugcccuguugguuggacuggaggcuccgaggggugugugcgguuacagaagaaccccgccgccccagcaguaagcagcucccugcgcgcacuuggcggggccccaggcgggcgcagggcgaacgcccucccgcaccaguucccgcgcucggcucgccccgcccccaggacgggcuguucuuggggccgcugccagacacguccuccgcaggugccggccucucuccggugacgcggccacaugcggcccaggcuccgauuacagggccugccuuguacucgggguccgggcuggggguccucacuccccaggaaugggugggaggggcagggcaggcccugcagagggagacuacgaacaaggaacagccgcaggcaggagccgcccccagacacgugcggcggccgccucgccgccgccgccgcgguuuggaggcggggagcccgcgcccaguugcaugacuugacugagcccaggacccaguguucuagaaguccaagaccacugggcauccccggauccugauggccgucucgggcaugagggagucuaaagggcuggugcgaaccgaauucaaacacugggccagccccaagcucccagccuucuucccucuuuccacagaccguguucaacgccugcuccccggguccagcggcccacuucgccaaggaaauaaaaacguagaucuuuguacuccugcauucucuucccccauuccccuuucuuguuggugcuagcaggacacacaaucagaaccuccugcccacgaggugcacucacaggaucucuaggucccuccaagccaccuaccuuuggccuagcuuccaauagcuacagugucaggggagcccaggaccugcugaagagacuagaggauaguaagagcucacagaaaggagggucuucacccugcacgcacacgcgcacacacacacacacacacagagagagagagagagagagagagagagagagagagagagagagagaagagagagaagagagcgccucaggaguaaagggaguugccaaaacuuuauuuugagacaggcuucuaguggacggaccaggcuggcuucaaacucaauaugucgccaaggauggccucuuaguucugaucccucugccuccaucuccuauuugcuggguuucagauacacaucaccugccugguuuauguagugcuggggacgacguguaagcuaggcaagcacuguaacaacugagcugugucccuagaccacgagacuucuagaauggcaguugaaccccuuaguccugaaacaucccugcgaaggaagcaaggccagagagguggagugacugcucaggaucccgccauaaauggaguuugaaagaauaugcucaccuggguccugaauggucagggcaaggggcgcuuccucuuucuuccuucacacagcuccuacuacccgcuucaagccagaccucccugcguuguguuuuaaagagagcaguuaccaggcucgaaguuggaacaacagugccuggaacagcuccaucuucacagugucucccccaggaccccgugcugggugggguaagggguccuucccuaucugggcugcucaaggcugaggccagaguggcuaccacaagcuacagcagagaggccgcccgccgcccaagaccaaggcuggagucauucugcccccugguggucagagaccacauuacaguaggagugcgucacccaccagaccccaacccggcuuguagaaagcuggugcugcacacccacacagcuguggcucacaccugaaggcgacuugacaggggucuugcuguucugaggcugcaugcccucaagacgaugcuuuuucccaauggagccaguuagaauuguuaaaagccuugguacuuggggaaccagagcuaugacucacaccuuagccaaacucgccauuagcuggugagccugucuucuccucagaggcugguaaguaguaggacaaaggaaaaaaaggccaguuacagaggcaaagagcugaagguguccugugugguggcacaagccaucaaauucagcacuugggaagcagauagacacauguuuguguguucaaacccagccuggucuauauagugagaccuuggcgggagggagaaagagagagagaaggagagggagaagaagagggagaggaagagggagagagcaaagaaaaugggucugucuaccauuccgagccuuccccaucuccauccuuccuucccauccucaacccuccuuucuagccccaccugcucucucacuacacacacacacacacacacacacacacacacacacacacacaccaaccuagccugccuccagugcuucuggcuuguuucccuccccugaauuugcggcacaaaaccuccagaccuuagagcuggcuaggucugucccccuguccccuggcacucccuucuugggccuaccuaggugaccauguguguggauauaggcaugccuuaagauucuaggcacagcagagaaggguuacagcccucaggacacaggggccccacaaucaauggcucuucauaggaaggaggcugugggcagaaccccaggucugugagcaccaaagccuuuucagcuggcuguggcagagaaugggagaaugagaggguagguucugaagaggccacuagagccaggcagcgaaggccugagguuccaucccugaaggcugucagaaguauccuaccaugcuugaucggggguggggggguggggggacaagcacaggugaaggcuuggguaaagcugcauucauuacuggcugcccuuggguaagcauauggcccucucugugccucugcuuuuuucauuugugaagcuccuguaagggcuugaggaccgagaaagaggcaugugaacugucaaaacaagccuccccuccagggugccucacuaccucuuucccuuggucgccccuaacaacguggagaggaaggcgcagacccuuccaggugacccccucccacugugcugcaaagaaaacuguacauuuccuuugaucccagggguggggguugggguggcgcuaagggagacucagaccacaacaaaagcacuugcaccaauagucacgugggguccccuaauccgcagccuaauuaccagcucugacaacacagccccucccccaacaagucagcagugcaauuccuucagucucugcacacacaugcagacacuuggugcuguauccccuacuggacacugauccauggccuguagaauuucacccuuucugucccaaguguucccaagcuauggucucuaugggccaauaauugcauuuaaucuuugagagaaucgaggaggcagagagcaggguucacccccacauccuagaugggaaaacugaggcuagagaggacaagagcuuuaucuaaacuugaucauagcagucccuaugcugagccccaacuugcucugccaccuccuuguguuaccccagacuuuuauuuugagugggauuuuguuuagacaggaucuccuguaaagcugaggcuggucuccaacuuacaacucuaucuuagcuuccagagugcuaaaauuggagucaacaacacgcccaguucccagcaggccgaugcugagucuuagcugcuccuggaugucaaccuuagugcccagggcacugaagaggacauggaggguuuugagcuugugcccgauugucucaagccaauguucuucccugcauguuaaagcagggcacggaggaggagcaccugcuuuggaguaagcaugccuagaaggggagcccugcggugggggggggggggguccaagcaggugggcagggagagaaggagccccaggaaaggcccagcaagacuggagacagaagggauuucaagguguuacucugugccacacugauaagacuaaagggaucugcaggcagcuggacaaaggauagacccacucagaggugccauauaugacugugacaagcagaauccaggguagaacccaugacuaggcuaugauaggcugcccugguuugaaauguuuguuccagaaccagggggaaaaggaagacuucuguccucggcgaucauucccuagauugaagaguuguaucugaggaccuagaccaggggcagcaggggucucagaaacccacccagcuaaccaagugugauguacaccuuuaaucccagugcuucagaggcaucaagcaggucucugugaguucaaggccagccuggucuacacagugaguuccaggccagccagaaccucacagugggacccaguuucaaaagagagaggaagaggguggaaagggaaugaaacccuggaaacuacucuucauaccaauaaucucagcacucaggaggcagagacaggaggauugccuugacuaggcuacagagugagucccugacucaaaauaaaauaaaauaccagggcuggagagauggcucagugguuaagagcacacacugcucuugcagagguccugaguuugguucccacaucaugcagcucauaccugucuagaacccaacagccaaugacccuggccucuagaggcacucucacacauacaugcacacacaaacauacacacacucacacacacgcaccccugacuuaaaauaauaaaauagauauuuuuuaaauacaaacaaaaaauaaacccugucccucuucacuggggugcaagggcagaucucugcccucuugacucucccaaagauuaaaugaaauuauugccacauggagaccaaagcuugggaacacuugggacggagagggugagaauccagaugcagcgaucagcauccaaaaggggauucagcacugaguaccagagcuccccgacacugcucucuggucugauuaggagcccaacugagauaccacaguggucugugucgcuuccagagauaagagacaggagggcccuccaucccaguaaagccaagugucaccaagacaauuaugagcuuugccagcuccuacccugaugucuggucaucuggucuggcuuggaaaaaugggaccaggcucugcagacugcacuaucacucugcugcucaguagacacuuuuauagacuucuggggaagccagagucagucuccauuaucagugucagccggaccauauaaacuccccaggauuaggccuacaguggggcuuagugggugaugggaacccauacgccuagucuggaucccaugcuuugauuccucaagucaguccccaggcuguuuccuggcgccaacgccaauccuugcagccugagaagcugcagcuuccugagagcaggagacagagagcuguagaccugggcgccgccugcuggccaaggucugaagcuucacccucuuuggcagagaaggaaccuggaacaagccugagcuguuacaacgaccccgauuccugcccccuucucugugcccacucccaaccaaaacccuguuauucccaaagacacagaggugauuccagacuucucaaaugaauugugcaucuuagcauccuggaaaacauuacuuccauuggaaauggggacuguggcagccugacagauuucagaagggaacgauaacuagcaacugagcuagagaugguuccugugauauuuugacuacaagaaugaauuugcuuucuguccuugucuucagagccugccugaggcuagguucaaaaauaaugggcuaauucuauugacagaggagaccucaagauggccuaauauugaugcuauuguuuauuaguaauuacugucaugcagaucuaaaugaaaaaauaacaagcggacagaaagaaaugugaaaggugguuuggaaagggaaggacacuggccagauugacacuacaggcaaggugggugcugaaagaagggcugagguucucaaagacugcagaugaacaccaucaggagaggccucauauacacuggaauaaagcuaagcuuccaaucugaaaaagagaagcauaaggcauuuucuguucccggaaaacaaguguaagcaaagcugcugccaacacauugcacaggaucagggaccuaccacaggcugguagccgagcuuugagguacuggccauguggcucuggcuuuaaagucacagaaaaggaggaaucaugaaaucuuucuccacgguuucagugagccaccaaccc

SEQ ID NO: 32 - RNA, 55512 nt, Mus musculus
ggugcuggggugggauggaggacagaggcgcuacaaggaaacccucagccccaccccuucccccuacccccaccccuucucccaccuccaccccuucccccauccccaccgccaccuccaccccuggcuguuggaaaaccagacaccaugcuucuagguggacuggcucccagugaaaacacagguuccuccauuuaaacaauugagacagccuaaaacuccaguucgguggccuaguguuguucuaaggcagguuuauaccacaauaaggaggcugaggcaggaaggaccaaucuagcucagucuggguuuuacagugagcccgagaguaaccaaagccgcaaagcaaaaaugaaguaaaggggcuggagagguggcucaguuaagagugcuugcuguucuugcagaggaccuaaguuugguuccugcucacaguuggguaacgcacaaccauccaucuguaacuccagcuccagggagcucucuccugcucuccccuccccuccccccagaacacacacacauaggcaaaaauaaaaagaaacuugagacuggaccgauggacuccgggguuaagaguacuuguugauuuuucagaaggccuggguuggguucccaguccucacaggguggcuuacgguuauucauggccggaaaggaaguccucuucugagguccucaggcacacaugcguacauuacaugcagguaaagcacucaaacacacacacacacacaaaauguaaauauaaaaccacgaaaagagagcuggcaagaugguucaauggguaaaggcacauguuuuccacuguaauggauagaguguaauuccugguaucaacaugguggaaagagagacccugagucccucaaauuguucccugaucuuugcgcacaugugaccgugcaaacacacacacacacacacacacacacacacacacacgggggcggggggagcaagaaaaauguuguuuaaaacauuuuaaaugaagaaaugaacaaggacaugcugaaccccccccccccgcgcucucacuguguguuccacaagcaccccccccacccccccacuccuguucccaauacacacagaggccugaccuucagggucccuuaggaaaaaugagccuugcaagcucugcccggggcccugaggguuguguggaagagcagaaguguccaggauaccuguggaagaagggagcaacaauacggagccaggcagccagccagccccgccugccucagacgaugagagcaggccaaagaguggaugggagaguguucuuggagcccuuggguaagauugguaguaacuucacacuggagguaucccaggaaccugaccagaaaaacuccuggagaaggccagcucucccuagugccccuucccaggcugcuuaggcacaucauggccugggcugcccuuucauguguuuccaggaguggaagcccaagccaagaggccacucuacaaagaggagaguuagaaggaauggagacucucuacagcugcccugggcccccauuccucaacacccucuaaccguucuccaugcucuacagcucaguggagcagccugcgugcuggggcggcaggagggaacccccguaauagaugguagcacgagcaugggggcggggggcacggaucuggugcuuauggggaucugggaaggggccccagaagaucauggggaggaagggcgggguuugcuauccaagcaccaggcacugaccuagcuuccaccaccaucccagagauacuccugccuccaccuguauuacaggugugcgggaccauccugguuuuugcaguucagaccaacugcaggccuuggaccgugcuaggcaaaugcucuacuaaucgaguuacaaugcccaauacccucuuaauuuuuuuuacacuauuuauacuugucucuguaugugcacaugugugccuguaccacaggacauggagggaaagggaugaauuucaggagacuguucucuccuccccuuugcauucugggcaccaaaucagaucaucaggcuguuacuugucuuuacugguugagcuguguugcaggucccaccccccaguuccuuuuauauaaagucuuaaaaagcaaacaacaacaacaacaacucuuuuuuuuuuuuuugaaagguuuauuuauuuauuuauuauaugaaaguacacuguagcuguccucagacaccccagaagagggagucagaucucauuacggaugguugugagccaccaugugguugcugggauuugaacuccugaccuucggaagaacagucgggugcucuuacccauugagcuaucucaccagcccccaacaacaacucuuuuaaauuaaaggcuggagagauggguuaagugaacagucugcuuuuguagaggagggggcggggucaguucccaacauccacauggcagcucacagccggcuaacuccaguucuaggagaucuagcacccucuuccggccuccucgggcacugcaugcauguggugcacggacgucuauacaagcaagcauucguaaaaucaaagaaucaaguuuuuuuuuuuuuuuaaaaagcuuuuaaauuuuauuuaauuaauucguuaaucgauuagaugaugcuggacaucaaauccugggccuugagugccaggcaagagcucuaccuacugcugagauauaucuugugaccugcuacucuuuucugaaacggucuccuggagaccagguuggccugggauucaggaagcacaacccucaacggagccuccauccuccuuccacuugccaagggcuaggauuacaggugcacggcacugcuucuguucuuuugcagggcuagggauugaacucaguagcacgcaugcuacacaagcgcucuaccaacugaacuguaccacucagguuccugacagcaaagagcaacccuagugcaaagaccagaccucaguuucuugcgaggauaagccuugcuguggauugggcugugcuccugggagggauguugcaccugggcucuaggucagccaacacccaaggaggguccaguguggccuugcgccaugcucaagcugggguccucuccuuuccauuaugauuacacuacaagguagcgguguggucgcggcagagagcucagagaagcgaaacgacucaacuagugugacacagaagugcauaggauucauaccccaaaagucuaauuaaaggcugaagagauggcucagcuguuaaagcgcuggcugcuauucagagaaccuaggaauuugauugguucacaguaccuacaguagguaggcugcuuacaacugccaguaaugccuggggauuggaugcccucuucuggccuccauaggaacugcauacauguggcauccauucacaugaauguacauaaaugaaaucuuuuauuuuuuccuuuacuuuuauuuuauauguauggaugcuuacucuacauguaugucuguaugccacacacgguacucauagaagcccauagaagccauaagaggaugucagauccccugggauuggacuuuuagacaguuguaaacuaccaugugggugcugguaauagaaucugguuuuuuuuuuuccuuuuuuucuuuuauauauacugucaguguccucagacacaccagaagagggugucagacccuauuacagaugguugugagccaccaugugguuguugggaauugaacucaggaccucuggaagagcagucagugcucuuaaccucugagccauccagcccccucccauuuguuuaauuuugaaauaggcuguccuggaaauugauauaagaccaggcugaccuugaacccagagaucugccugccucugacuccggaugcugagauuuaaggugugugccaccaugucuauaaaaaacaaaucuuuuuagaagggaggagggugcuggugagaugccuaaacaaguugaaguacaugccaucaaaccugacaacaaucugugcaucccuaggacccacaugguacaggagaaaacugauugccacaggcuguccucugaguuccauauguacaaacacacaccccagagcaagagcgcacacccccacacuccccaaacaaauaguaacuuaaaaaaaaaaacccaaaacaaaaaaaccauagcucuguuguaccuagugcccuuaacuugauguggggagggugcuagguuaggaccuacuagaugguuggggaggagugcuaagucucucacgucgguccuggccaagauuacuaauauuuauuggggcaguaucuggauuaacacaucauuagccacccaggcagguggcuacagugggucauguguccccaaacuugcuguccugcccagcugucuggccccuuggcacuggagcugaaacugugugaggcuccggcucagcugggaggaaugaggcaccucuuugaaacucccugaauaaggucaccuccuuccucguggugacgagacagccugauaggcacuugcagggucagccugaugaagcagccagccugugaagaaacugugugucauguugggggggggggugccagggacggaaugccacgcucuuccucugugcuaugaacucacggaagccugggaauagcucuccugcuuuggagauuuucaccuugccucuaggauugcuaggguaucugaggcuucccucucaagugugggugcuugggugcacaguagaagccugaaucaguaccugguaccaccugucuuuggccugcauagccccuaggaccucugaguuaggucagccuuggauucuucuuccucccaagcuacagucuaaacaaagccagaggucuggggcagagguucaucuaccugccccuccugguuucaggucuuagccaucaucccgaccucagccucccagagcugucccugguucccauuuuucuggagucugaagcuacagguacuggcuaacaggugcuaccaauacaggugagugcugccgccuacagucaccuugcucugagcaaguucucagggcccuguucagagaucaucagccuugcacguagaaaugucugccaaaaucagccaaggcacucagaugauucugaagacggguagucaaagcucaucugaguccuuagccaaaagcaugggccaggugugaggcucugcuagagcaagcugcagcucaugcaggguggcacacggagaggggccggcugugguggcacaugccuuuaaucccagcacucgggaggcagaggcaggucaauuucugaguucaaugccagccuggucuacagagugaguuccaggacagcuagggcuauacagagaaacccugucucaaaaacccaaaaaaaaaaaaaaaaaaaaaacaaaaacaaaaaaaaaaccaacaaccaauaagcugagaggggcccaacaggggaucccucucacagugcauaccaucacaauuuaacuguuuaagaguuuccaaacugcggucgggcaugguggugcaugccuuuaaucccagcacuggggaggcagaggcagguggauuuuugaguuugaggccagccuggucuacaaagugagcuccaggacagccaggacuauacagagaaacccugucucaaaaaaccaaaagccaaaaaccaaaaaaaaaaaaaaaaaaaaaaaaaaagaguuuccaaacugguggggcagugguggugcaugccuuuaaucccagcacuugggaggcagaggcaggcagauuucugaguucgaggccaaccuggucuauagagugaguucuaggacagccaggacuaaacagagaaacccugucuugaaaaacaaaacaacaacaacaaaaagaguucccaaauuggggucucugugagcacuucuguuccaaucucaccugauauuuaugggguguucccuggcuaagugguggcccuuauaggcuaaagauguguuucucagguggcuagaaauaccaaaacaucucuauucuccucuaagacacauggagaggaagaguccaggugcagacugggcagauagcagugucagggugacaacccaaggacacagggggcccacagagcugagaguaaacagaaagacccuccaaagucugcaggaacaaagcccugccauaucuguggaacugugcuuuaagcugcacagugaggagucacaugaccagugggucuaagggcagucacaugaccagcgggucuaagggcagucugggugaccacccccagaggcaugcaggugcaauagcuagcaguguuucucagggacacucuucaggacuugagaguuacuguagacauaagucuauagccauuugcacucugggacacaggcaaaggcucacugguguuccucagauguuggugggaggcucugauagaagcucugucagguccaaggccaagcccgagguaggccucacucaaaagcuguguggaaucagugacucaggauauggaggugucugauagcccuggcauccagcucauggcugccucgguccugaagugucagggaagcaagcuggaaggguugucagcauagcaggccccuagguuucguccaaggcaggcugagggccugccucuggacccagggucauucauugccuuaccugaguacauaugcaaagacucuuuuugccaucucuacauaccugggggccagcuugggagcaccuguccuuguguaccuuccuacacagaauggaccugaccaguagaacugggaauggauggccagcagggugaggcuuguuugagucucugcaugaaauagccacagaagucaccugcucucugcuccccagaugaacaggggcucagaugaaguugggaguccugggaacuggaguuguugaggcacccauagggagagugugaucugccucgugcaccacauaucagguugucacggacaacauccggucuccaccugugggagacgagucagcauggacagguaacuguuggcacaaagccuccaaccaggagcauagaagugacuuggacuuggcagguguucuccagccucauucuucagccacuggagaccaagggcucucucuagguuaauggccuaugugcccugggcagcagcuucuugucaggacuucaagguccauguuugaaaaucauuccacauccucuggaaagcaggccaggugcgcccuagggcucuagaacaccugccagugccagcuuguggguggggucagggccagucuggggugaaagaauguguggguuuugccugcagaggaagaccuggaaagucaccacugguuuuggcaagccugggccaaagagacucauucacauuuuguagguagcuggcaugaaaccuggggcaauguuggagacuguuuugauggccuggacccacuaacaggaaacccucugcaggccaagaucuccaguagacuggagcuggcgguggcacucgcugggagcuuagcccugagccaguucucaagagccaaacaucuggggacagaaguaacaggcagacccauguagggaagccagauccuccuccaugcauuaacacccaaccuucaccaccagaggccaggguagaccauggcaagauaacccugucuagcuccacccagggaggagcuggggcuagacauuucaguaggugagaaagaccaacuaggcaacauagcaucucuuagccuggggcuaaaugccaucucacccuuuccauggccuaaggucuaccacauagaugcagccacugccuucccagcuaacagaagaacugucaggguucuggcucuuucccaaucacagaagccugugggguguugaugcugugcaggaggaagcuagaagacacagcuuuuggcugauuagaugccucauuuggaauacuccaguugucagcccagugucugggguauggaggcuuagcuaucccaugucuacugcugggauuagugauaauaaauuuccuugaggucugucaggguuuuuuuuuuuuuuuuugcuaugcauuguaaugcuaaauacuaacucccaaagccuugagagaaccugcagauacacaaaguaaugcuaugugaccuugcuccuugauuuaaaacuauugguugaauaaagaugcugacagccuaauagcugagcagaagagaggcagggaggguuucaauucuggagcucggagucugaggaccacaaggggagagagaagauggagaagacauaaugaaguagaugaauuauaaaacuggccacaugggcuggucagucagaauaaggguccaugucauauuuggaguuauuggcagggaaguagacacaauaacauagaggauauagauaucugcccagcucuggugcuuuaaaaguuuauuauaaauauaaaugugucuuuuaucugggaacugcaagaucaaaggcaggguagaaaccuccaauugagauuaaauauauacuagggggucucugaacaccuaacaguggccagucaaggauuugggcuccaugccaacgagggcccaccuuccccaucuugugacccuagagggcaaguaacagcaugguacgucugaccacagcuacaugucucagucgcaagcagcugggucccugaacacuucacguccagaaaggaaaagaaaccuaccucuguucugggucaccccccaagcugcucuccuccuguguccucucacaucaaagguggcacugucauggcucaucacuaaguagucugccacaacacugggcccaaccgcacuuuucaccuguuggaugucuaccaaaggcacuugccucucuugagugcagaugcccuggugugaaacaccaaacacacugcugguggcccuugcugauucuccuucacuaagaccuauuggccagaagugguaaacuaggagccaaaggcaaggccagcucagaaagugacccuuucauguagcuaugagguuggcugggucgucaggcuaaugugccugaaaauuacccaagcacaucauuuugugcaguuaccuaaugaugugugaaaugcacauuuauaaaugaaucuaauuggcucagauggacuaaguggccauugcucaggugauucccauuacacugggcugggaauaggagcaguaggcaggucuaucaucacagaugaggcagaauuccuuaggggaggacacaggaugaagggugugcacuauuguccaaacaccuaauguaugcccaccuccaagccugacuucuccuacagccuuguccuauguagcacuuaugacacaaggaacagggcagccaugaaggcagggcaggacacugggcuuguaggggaaggcagucacuuuuguagcuaacuuugagccugcaaagcaggcauuccagagaugaggucuucccccacuaaguucagucagaaauggccaccagccugacuucccagcauuugggaggcuagggcaggaggcguguauauagcaacaucaucucggagccauucuuccccgcaccaaacaucccaagcccuuauuuuuuagacgauuguuuuuuguuuuucuaaauguaccucuccuauaucuuaaucuuacaaggcagagucucagauccagagggguuuuccuaauuauuguacgggugugugccagcacacagauuugugcaccacaugcauacaguacccagagaggcuaggggaggguguuagauccccuagaaguuaaccuagaagguuguuugccaucauguggguuugugaacugagcuauugcucaagcccccuaugaucauuugcuaaggccuuucuuacaguagcuaacugcuuccagagcccuaggcugguuccacagucaaacagcuugcuccuaagaauggguuuucacagccucaaaaccaaguguuaaagucugcagacuggaaucuuugguccagccacucaagagcucaguccagcaggguugugggcagucagaaggagcaagugggcuaucagaaaaaccccaaccaaucaaacaacaaaaaaaccaaucucaguuuguguuucacaacuuuaauagaauauccuaacuauucuguacaaauugaaaacaccguauucaguuacaaauguguuauuggguaaggcugagcacacucuacauggcuggucacuguggacauggcuguccuggcuaccagagacaccaccauacucucagaaacaccccuccccccacacacaccaaccaccaacuggucaccaaacccagguguggcccuggugugcacaguacaagcugaagcuguacuccacaggccagagaucccuagugaaggagaacuucuguccccuggcuacagccugccaacuuccagcggcaauaacauguagucugcauggcacagcacagcacagcacagcaguugguggcaggaagcagcagggcuuccuccaugagccucccuccacuuggugucacauccuccugaucaagucagcaacauggucucguaagugggaggacagugaaguccaaagcuccccaagcacaaguaaauaaauaaguacgagggugaacccgauggcucuggccucagaggugugugccacaacccacccaccccuaaaaccaaaacgcaagaaaaaaaaugcucuaaggcgagcacagcuuccucuacagugcuugggcgaugacuagggcacagcagcuggagcagcuucccacgcaguucagcagcuggaaaucauggggccuugccaguagggagggccgggugcacacaaucacaggcucugucaaucccaggcacaaccucgguccaccccaagugaucuucaggcaccaaagcugcaggugcuacaacuaaucuccuauucugaacugcagcagucuccacuguacaaguuuagcaaaguaagaagggaaaggggagaggaaucaugcacuuggaaaugguuagaugucacagcacugucaacaaaauucugcuuuggcagggacugaggccccugccugcggccugcgguccugacagccauccacaaggcggccccacagggucacugcuucucacugcugcuugcacuccgcuggcuggcuggguucuuucugcaagaauacagaauuugaagagaauaaaacaaguaucacucaucaagccuccccuucccauaagaaccaagacccaaugagcucauuccuucuuaccaaaaagauggcucccacaaauggacuuuaagagcugacccagaaauaggucagcuccccagagagucccaggugucugcuuuccuguucuaauaauguaaagucuaacuuagaaugugcuagcagacacuugcuggggccacuacaaggaacuagccacaugagagucuuugcugcagguauagaucacaccggcugugccagcaaccuccucucucuagggcagcccaguccugggcauucacgcagugaaggcaguccuuccgagccggcuggugcucucugcaauacccaaacagauucaacuccagugguucacagugcaggaguaaauggucagaggccaguuccuauagagcaugucuaucagucucacagagcaugaguccagaucacaccugucugaagaacaaggugacuucaaucuaaccuaacacacaaaccuggugucuuuaaaacacauccaagauuugggagcuuuguauguaggacaauaaaagccugaggacagacaaggaccuuacugcugccucagagcuaaaauauguacucaacucgccugauuuccagaaucccugggaacuacaacuucaaaucacagugguuccaggcugaggcagagcaaugcaugcucaaggccagucugacccacacagcaaggcucaugucuccaaguaacaaagacuagaaaugcagccuagcagcguagcacuugucggguaugcccgaggcccugggcuugguccucagcaccacaucaaaaaaucuauuauuuuuagagaaggacuguguaugaaccccuggcugaccuugaacucacaaagaucugcuugcauuggucucucaagugcuggggaaaaaaaauuacucuuuugcuuugagauagggucucacuuauguagucuuggcuguucuggaacuuuguaaaccagaguggccuugaacucacaggaaauugccuguuccugcaucuugaaugcuaagauaaaauguguguuuugccuacauguaugucuacacaccauguauguuccuagugccaucagcagucagaagaggagguggucagacugcuuggaacuaguuacagagagcugaauguaagcugccauguggaugccaagaacuucaacuuuggaagagcagcccgugcucuuaagcuaagccuaucucucuagcccugauaaaauacauuuauuaaaaagcuauucuguguggugugguggcacacaccuuuaaucccagcacucaggagguggaggcaguuggaucucugguguuugaguccagccucuauacaaagcaaguuccaggacagccagggcuguuuacacaaagaaacccugucucaaaaaaccaccaccaccaccacuaccaccaaaaaaaaaaaaaaaaaaaaagauugacuauggcuaugggaguuuguguguguucuaagaaaaaccugcaucacauguauguuaacaccagaaguaccuaugguaugagaccagaauccaccuugaagcaucacacuucaggggcaaaaauacaauguugaggcacacgagagaaucuuggcuugguuagaccucuacuuuuuccaauuuaaguuuauuuauguaugcugugucugugugaggauagguaucagauccccuguaacuggaauuacagaugguuguaagcuauuguguggauauugggaagugaacccaggaccucuagaacaacuagugcucuucaccacugagccaucucuccagccugagaagaacacagggauauaacuaagcccuccagguuaugguucccaccccuguguuucaggggccuuguaagucaacaaggaacccaagcccagagaugcugugcuauucucagcagucaacuucacuguauguggaauuaacucaaacccaagcuguugggcacuccugugggggacuuuuuugaugggauuauuugaaguggaaagaccuaccuuaaaccuaggccacagcuccuagugguaguuuauguaaaggacauggagaaagaaaguuucugcucuuuaccugcuugcccucacugucaggcaaguccauuccuucacuggcguuagagccuauuucuuugggauggugacauauacacaaaaccagcugagacacccaacuuuguggaccaaguaaggaucaaauguuugaacuuuccauugggagacagucaguucuagaauaguugaaucacagacuauaagccacucuaauaaaucccauuuauaauggauucauucuaucaguuguuucucuagagaagcucaauucagaugccaaucaagcaagagcugucaaaagacagccaaggcuagaucuagagguagucaacacaguggucauggucacuaaccuacugaccuagagagcaucagaggcagggugucccaagcgaguacagcagggauaggagagaagaaggcaagcaaugcacacaagggaaggagugggagcucuaggggcugggaugcaacgggggucucccccagcacagaaaaauaaaggcauugcagguaaaaaacaagugggcaaggauuaggugccucccuaccacggccucagaacauaggcauccugaacuuuauccuguuacuuaaaggaagugguauuuugaccacaggaauguaaaauuuuuugucuucaaaaaaaaccaaaacucgaggauguaaaaauccaaaacauaagccauagcaguuuagguaaugaagcuaccgaggagaauaaucuuuauuaggguggcagaagaggccauuggaaagguaagaacagugaggcagcagguuuacacaaggaaaccacagcuccacaccccacccaugccaggcaguaggcagcaguguccacuuaugcuacuacugggauaacaagcccuugaaggggauuuugcaaacgggacacuggcuuuggccugugacacagucagaaacuaaauugccaacugaacuguagcuucugcuacaucacaaaucuuaaugacaaauuggccggccccucaacauuagcacuuaaaaugcauuaagucggucaaaaccucgaucaccacaggccuacaugaggugggguuaucaaaagcauggugggccugagaaagguggagcugaggucacuuauauacuccacuaugucagcugcacuagagggcaaggcccacaccaaagcuaccagcaaguggacaugcaccauaguucugcuacuauggccucgauaaagaggaauguuuuaacacugacagucaacuguaccuaacagcuagagugaagaaggcccagagugagcccaucaaagacaacaggacuaggcucugucagacuccugucacucuggacaauuccuuauaaacuguugccuacaaauaaaaaaaggcaggagccuacacaugagauccuuguggugccucccacucugccuggccuuucuuccuuuucuuacugcauuagauaugugcaaaagcugugagcaccccacagggaagacucugucacugacaagggccuccccucgcugcuaauuacuuauaggugagugugaucuccaaacuaaacagggaaaacaaggugcccuacauuguguccacaacuggcucugucauccuccaaacaaaucuugagauggggcuuuauaguggccaugcuggcagguacaccaggccaccugacaugaucguuuuguucacuuacuggucuacccaaugccugguagacaccuagacaaauccagagcgacuacagucacauagugucuuuaagccuggugcaguguagacaacaggcauuuuucuaucagggcuuuuuguccagggugaccccugaggcucuuguucuguuaccagugacaaugcuccccacagcacagcucauugcgcaguuaucaaaaacaccaggcccugaagguaggagcugagucucacuguucugcugguuuuacaaaugcauuaacuguggagccaguacaagugccacucacaaggcccagaggcagccccagcuccuauacgaugcaauggaucacaucuuucaaugucccagaagucaaaauaaucaacgaaucaauuacagacagcaauuuggaaguuagguaugaacagauuccaccuuaccuagaaacgcaugaaugauuaacacaaaaauuacaccuaaauggggaaaaaaauugaaaaggaacugucagcaugaaagaaaaugaaaugcacaaaauuauacaggaggcaacagccacauucucaagauacaagagcuuccaguagggguaggagcagcuucagcgcaccagagcugcaugccuucccgaggucaaacuuuauucccucuuacaauaaacaacucccagacaacacugugugcaguuuuuuagugaugauucuaguuaccuuccacuuuggagggugcacaugaagccacagaacaaucacaccuugaccuaaggacagaaggaccaccccuuggguugccugcaacaacagcucuacacuguacccccauugccuacuucugaagcuucuuuccaccccuagacaaugcaaaaggucaaguguuugugggguuuucuacuaaucucaugauaaguugggugagaggcucucuucaaaaacggggauaugagaggagacagaaggcaaagggaaaacaacaggaagaagaaauaaaugggagaggggaugcaauggaggcuaugugagacaagcacagcacagaagccaaggugcaccaaguuggaacaugcaugugacaagcugcccuggucccugccaacuguacugugaccauguguccauccucugcucacagagcaugaauagccaacaccccgaggcucaccagguaguauagucuccaugacccaugagugaccuuuagaggggaguggcauucgugugggugguggcagcuuucccauuuuucccucuggaaacuucccagugugugcaugcauucucagcagcacagcagucacaccaccaagucgcugcacugacagcuuuuagcacacacuccacccagggaaaacaaggacaacagacagacacuagccagucagagaugcaaggcacagggacaccaggcagggaugcauuccaacagacuccacacugucaaacacaggaaaguauggcugcacuagagcagcucagggcauccugccaucgggugccaaagcccccuaaugaagagucuccugagaccacagagaaaaccccaagcuuccaggugaaacugguggugcagauugucguuucuuuugccagucuuccuguccugcaacaaucacuaugcauauguauauguacauacgaugcuuuuuugucaaucuccuaagcaaaaauucugauuacaagcuaauuuucuuuacuaucgcacacaauccauaccaggugcucugcugaugcacacgggugcuuccugucacaacaucccucuagggaagagcuggaagcaaugcauguucaagucuacagagaacuaguaacaccugguuggaucugacgccuaauguuccaggcauaugaguugccuuuccucaacuguggauuuucugacauguauauucuuagcaucauugccucaaagugggaacagcuucaaaagucccaccgugcaauacugguaggcucaggacguccccaaauuacuaaccuugggguuaacaucagcaucauccucaucuucuccuucuucaucaccuuccaauuccuguauuagagagacaaaaaaaugaugacuagggugugaccaaagagcaucaccugaaccuguacaaaguaacacacagcuuacucugcacaacacuugcuaauucuuacaaaagaagccagguagggaugcacucuaacagacuccacacugucaaacacaggaaaguauggcugcacuagagcagacacucaaugcuuaagagcacagacagcucuugcagagacaaugaauucaguuccuagcaucuaugucaggcagcucacagacacugcaaacuuuuguuucaggagaucuaucugaugccuucugcacuccacaggaaccagcacauaugcaugcauaccaggacagacaugcauaaucuuaaaaaacaaauuauuucuuuaaaaagaaaaaaaaaguaguugaauaggcugaucuagaagcucagcuuccuguggugucuccuucccacaggcaaaucacagcagaguucugcauuagggccacaggcacuaacaauuacucuauaucuuuuuguuuucacagauaauucugaaacauuucuaaaaaaaaaaaaaaaaaaauucagacauuccuuauuaaauggcuacuaauaugcauuuaaaaaaaauuauuuauuuaacaugccuacacugucacugucuucagacacacagcagaagaagacaucagaucccauuauagaugguugagucaccuugugguugcugggaauugcacucaggaccucuggaagagcagccagugcucuuaacugcuaaaccaucucuccagcucuaauauacaucuuuauacacaauuacaggaucaaaaucuaugggcaccaaaaccaaaugguuucaaaaucgccacugaaaccaagcaagauccuuggacuuccuaacuucaagcagacaagggaaaaccacacaaggcuggaguaacaacacaacacugcaugacucccuuccuuaccuccucuucaccuuccucgccuucuucaaacugcagaggaaacagaaaaacaacuuaaacuucuagaacuuguagccccaaugccaagcugauaagcaaccugcuaggcuaaagguagcaugaaguuuggugcugcuacagaagcagugauggcuccagguacccgugaggcacaugcugcuguugcaggcccagcagaucagucagcacuguccugggacugaaaguugcucaagaguuaaggauggggaggggugaugacuugugacugaacaugcuggaauaguucccuuucuaucuucagacugaaacagaggcaacaggagucauuugggaagagggacucucaacugagaaauugccuccaugagaugugccuauaggcaagccaguaguacauguucuugauuaaugauuacugggguagggcccagcucacuguauguggugucaccccuaggcuggugguccucagugcuacaagaagacaagcugaguaaguuaguaagcaguauuccucuauggucucugcaucaguuucugccucuagguuccuaacuuuauuuuccuggaugauggaagauccagguaagaucaaacaaacccuucaucccgaaguugcuuucagugaugguauuucaucacagcaacagauacccaacuaaaaccaaggcuaaacuaaguuaaucagcugcuuaguugcaugcaaaaacuuuggcauuucacaccucagauaguggagugggauggccuuuauuagguuucuuuuuuauauauuuauuuuauaagcauuuauaaaaucuugguguuuagucaaaacuaaugugaaaccacaaccaaggcucugugucaauuucucugucuaauaguuuuugaucaaacaauuucaaguuccaaacacgagcgguuccuuaagcuggucacucuaguaccagugauuacuagcaugagaaggccccugauuugccacuuagaagaccacucgcauauuccuuugagacaguaugaaagugcaacuucaaaaagccagaacccacuggccuccuggcacuacaaagcagcaaggagggaccgagucacaaaguagugucuuucccccauggcaucuaagccgguuucuaaaagacaggccuuuuguuucuuuuaagaucagggcuucccuauauagcccaaacuagucucaaaacacucaauucuaucucaaguuccugagugccagggugacaguuguacugcaugaauccaagggagaagcuacaucugaacuagcccaguguuauuaucuuaagauucaaguccauuucuuuccucuggagcuugagaaaaaaaucaucuggugggguaaaaaggguccacaccaagugcaccucccacacugacagggucagcugcuucccccacuaacaacccucuggucuugugcccaguaguaauguguuucuuuuuuuuuuccuuuccuuucuuuuauuuuuuuuuuuuaauuugguuuuuugagacaggguuucucuguauagcccuggcuguccuggaacucacuuuguagaccaggcuggccucagacucagaaauccgccugccucugccuccugagugcugggauuaaaggcgugcgccaccaugcccagcaguaauagguuucuuacacuugcuuucagugccuggugaguaaggcugcuguagccagcuccucaguuuggggguagaagagacuauguagacccucaccugcuauccuuaaagcauaagcucacaguaucacacacucucuggcuugaacaagaaaauccacacauauaugcacaugcucacacugcuggcuuaggccuuucagaccccaugucaaguaugaagaccacugaauugggggcaaacuuuccaaugacucuggcuaacuucaacaucaguucuaccauuauagcagcacaugucaguggugcacacaguuagcccuacugccacccaccaucuugagaaugcugccuuagaauuguugugcaacuagauuguccuaaaaccuaugccucugcacugcaggaaacaaccaaugcuaagcaguauccacaaguaucucugccuaaggaacaagcaagacuuuuugaagcuaacacccacaagaacaaucaggagagacagcccuccaugcaucagagacaggccauuagaccggccugaucaccucacuccccaucuaaagcaccaacagacucaugagcucuucaaaugaagguuaacaacuugacaucuauagacugugauaacuuggcaacaacccaagccuuagccacgaugagauccugugccaggucacauuaaaaguauagccuacuaaguaauaccuggaacacaucacaaaggguaggaggcucuggugcugggcacuacuaugacacaugcuaguauauccacuacuaguaacugucugguauggcccaaucuccauaaggaagggcuucuucauacuggaguuugcucaaguucucagguuuuccacagaacaguuugacccucagggucuuaagaaggcaagguuaaaugagucacauucuagcuucccacguuacugaggacugacagccucaugggaaauccccuuugccuacagcuucuaggauucuccuccccuuagucuacugucguaagcacaggagagcuguagggccuugggucuggaugaauacacagcucugggccuuccagguaagagugucuaagcacccacaggucuaagcacccagguaaccaccccucugccccacauacauugucaucauccucuauggccuccccagugaaguagaggacagcccguggcacgaugcgcucacgaaaaaagugcccaauuucaaagucagaggcuaaggugaacucggaaucuucauccugagaggaaaccaauaguuaacucauuucaguggguuaaagacacguucaguacaccccgcccucuucuucacccuugcuucugaaugaucugcacugcugaguaagucaccacauucaaagccacuuacaauggccuuaaagcuaauguucaaauuacacuacaaaauuccaugaaaacaauaaggcagguggguggcagcucugcugcauguccuaugcuucagaguacaggguuggggucucuacugaggacuaaagggcaggcauggaaaaaaacauucucaugagguccaagguauaaugacuucacuuuaacuacagaaacuaaaggagaaaacggaucagaaagagcaagugcuuauucaagaaauacuugacagaaaaucagggcuuuugacaauacaucuuaccagagauucuccaucuccagaggcuagaagaagaaaagaaaacacacuuauauuacaacgacaccaauguuuuaacauccacacugaagggaaaucagcuggcaagcagcucucucagaccccaacaaggcaccgagacaccuugugaacauuucacaagcuccaucuguuacaauuauuucauuuagauaaggcagugggucaaaaaagcugagaguuuaaaggaugagcaggagguaggugaaucagcugcccuacuggaccauacagagacugauccuguaugcccuucaaugcugaaugguacauguuuaucugcuauggggcaaagagaagaauguacauucugcugaugauccugcagauggguuugcagccuuucacccaaagaugaugcauccauaggggucuacaugcaagaccaucaaaguggugcugauauucaccaggucaaaaagaagaugugggcuucuugccacaccuccaugaaaccaaacaaccauuaccugacagauaauuuggaccuugacuagcaauagguuggaguagaucuaaugcucucuguuuaacuguggugucagcauuucucacagggcucaugucaguuguuguuacagccugacagcauucacugguagaaaaccacaguauuggguguaugaacaccaccuacaagaggcuguuaccauguaggcaaggaacagucugagggcuggaccccgucucccaagugacaagcaccacaacacaugccuuccaggccaauucuauaggcugaaggucaauguaguagugucuccauccuaaaaucuguagcccagccccugagcaccauccuccuuccuuuccugguccuagaacucaucacuguuacauguugccugacugaaauuguagccacuuauuuucuccucuucaacuuccugaaagcacuguuuacaguuuuauauucauuucccuuuaaaaugcaggcuggaaacugaauaagcuaauuuuagaguugugccacuauaaaacaucaccccuaaaaaucacaucugcuuauaagugaauuccacuuucacuguugcuuuaggaacacuuuuagggagcuaagcaugguggcacuugccuuuaaucccagcacucaguaggcagaggcaggcagaucucugugagucccagaacagccugguauacagaacaagucccaggacagccagggcuacccagagaaacccuaucucgaaaaaaacaaauaauaauaauaauaaaaaagaguaguuuuagggaacuuccuaagauagggugucacuauguaacucuagcuguucuaaaacuuacuauguagacacccgacugucucugccucccaaaugcuaggauuaaaggcgugugcacuaugcccaucaagaagccaacucuuaaaggcagggauccuccaccugagccccacacagccagccugguccaccauguaugucaguguguacucuaaaggaauuuccucacacaggaaacuugagcacuaagcucuuacuugcuaacagaacauacuuuguguuuuguagguucaaaguuaaaucauagaaaauggccauuacaaugacaucacccaaaugucccaugaggcacacaugguggacaacagcagcaagcucuaagacaaagcaaagccaagugcccagaucuaggacuggaccugccuaagguuccccaaacaacucuacauuggaggauaaucuuggcagcagggaugaauauuuauguccaaagauggucucuucauggaaagcgacaagaaaaugccucauacccauucucuaacacuaaggaaaggucuagccaagcaccuuccccaucauacaauuacugugggacugccaagauaggaguccccaaguggacugcaguuauuacuaggcucaaugucccaucuuuauuauauagcucagaaaacuagcaaaaagcuucaauguuauaauucuguuucuagucuuuaaaaauguuaucacauagaaauuccaaguaaagcccugugcucugucgaacuguacaagacuagggaaaacugaauuuauaagaaaaagaaguugggggcuggugagauggcucaguggguaagagcacccgacugcucuuccgaagguccagaguucaaaucccagcaaccacaugguggcucacaaccaucuguaacaagaucugaugcccucuucuggagugucugaggacagcuacaguguacuuacauauaauaaauaaauaaaucuuuaaaaaaaaaaaaaaaaaaaaaagaaaaagaaguuggacuggugacucagguuuggaacugugacuagcgugagccaggaacgguccugccuaucccuuccauaugccaaaaaaguggucaucuucuccugaggugcacacacuauuucuaagagcuaagcaaguaugagggaauggaacaacuuuacagagaacacagagcgagcugccccugcccaccuuucagggggcugaagaaguugaagaaggacucauugggcacuugcuuggugaugguucguacggugccccggcccuugugcuucugcuuuuucuugaugguuuugacugugacauuuuuuccuuucuuccagucuauuguacaccugcagagacaagguaacuguuauagacauuugccccaagagaaaccccacuacuguccaggaaggaagccagagccauauguaacaucugacaccacucaucugcaaaccagggaaaaggaccccaaaguccaucuguaugacagcuuacaagagcuagccuggucccaucauccuugaauaaccaaugcucaaaagccuuacagcucugaaaugacaacagcauucuuccacaauaguccauaaggauucugaaaugucuucugugcaagacacuguaaguccacagaaugcucaagaacucaucaccacuccuuaugccugagcacaccuaggguuaccacucaugcacuccaauucagaaaucaacuaagugaacaggacagcaggggccacugucucacuucugguggcagcugaaugauaucugcucaggaaaacaugaaaaagcuaagcccucuccuacaugucagacuggcccuggaaaaagaucuccccuaaccuaacccugaguacuccaagccuuuaaaucaaguagaacuugaaugaagcccaaaaucauuucgugacauuaacaacacugagcugguucuggugaguguuuuacuucaacaauuaauuuuccaaacagugagacacaaccacaggagucaacuucaagcugaaucuccacugagugaucuagaaacuuaacaccgucauuuaucagguagcaaauucggugccauauuccaaagcuguaagugaacugugacauggauuaaacuucaucaaucaacaaauacuuuuccucguaagaguuuggggcuuugcugggcacgaugguagcauagcauuuaaucccagcacucuggaggcagaggcagguggaucucuaagugcagccuagucuacagagcaagcuuuaggcaagccagagcaaccuaaugacacccugacuaaaaaaccacuucugcuggagaaauagcucaaaagaccaguuuuugcuucccagcaaccacacaguggcaucacaaccacccucaacuccaacuucagagcaucugaugcccucuuucaaccucugugggcaccacaugcaugugguacagauacaccugcagacgcaacacucauacacauuaaauaaaaauaaaucuuaaaaagaaacuuggggcugaggacacaagccccaaggacacuuggucuucuacguaaagauccuagauuuaauauccagugucacaaaaaaacaaaaacccuucaauuccugguugucuaaagaauucaaagccuggccccauucaaacagcaacugaggauaggcuuccaaguauaucugaaccuuaaggcacgacacaccuuccaguuuuagccauguccacacugcagggucccaacuauaagcuacggcagacaacuucugaagggcuuuuaagugguuccagacuuuaaaauauauuuuuaaaaaaauuauugcuggguagugauagcacacaccuuuaaucccagcacucgagaggcagagacagguggaucucuguguucgaggccaaccugguuuacagagggaauuccaugauggagaaacccugucucaaaaacaaacagaaaaauauuucuguauaguucuaaguacaaacucuguguguguguguguaugugugugugugugugugugcguguguauguuugacucugcauacaugcacaggccagaugcagacagaagaggguaucagcuguucucguccucuccuaacacucucacccaauccuuugaagcagggucuucuugaacccagggcuccuguuuucuugacuaggcugaaagcccacaauucccagcaaucuuucuguccucuguacccucaaagcugggguuacagacauguggcuuguuauauaagugcuggaguuugaucucugauccuuagucaucucuggccccuaagacuuuuuuuuuuuuuuuuuuacaucauucucguuuuugauauuuuucuuuguuuuacagagaucuuccuguauauagccuagccuggccuugaacgcucaugcaccccuacaucugacuauuuuaaaauucaaaaccauuacugcuguuguugcagaaggacauguucuuacccaucacaguccacaauuucaggaccuucaaaagaaaacgggucggccuugucuggcucugauuucaucuuguacguuuucgucaggacaggauuggugaaguagucguuggguucaaagugaaacucuagcacaaaagacugaagcaaaaauccagaguaagaacuaccuaacaucugcacaaagaacuuaaggaacuaacucacaacgcauuacauagcccuucaacaugggcuauuucaccuuguaugaaaucuggaucagauuuuguguuuugcagugagugaaaacaggauccuucaugggagguaaauagagaagacaguguuagcugcucccuugaagcugcacaguaacucacagaguacacagggagucaauauuugcagaaagacagguauaucaaguccaauggcaucaagaaaaaaacuagccaauucacaaauauauaaacaaaaaaauaaaggaaaugggcagugguggugcacacaccuuuaauucuacuacuugggaggcagaggcaggcagaacccugaguucaaggccagccaaggcuacacagagaaaguugguuuaaaaaaaacaaaaacaaaaacauacaaacaaaaacaaaacaagcaagaugauuuucugaggcaaaauguaccaaaacaaaaaccucugugggauuaggcaaugucucucggacauaucaugcaaccaaaauaauuaaauaugucugaccuccauaaucaucaucugugauuuuuuuggaggaggugagggugggggaacaguccacucugauagagagaaugaauaucuuguguguuguauagaugcaucaccugucacuuaaaaagccuauggccuagacaggaaauagagguggaacaucugggagagaaaggauucugggauaaagccagaagggagacuggccaggaagaugugaggacacaugguaccugagcauaggcaaccaggcacguggcagaauguaagcaggaaugaaugggauauuuuaaguuauaucuagucagagaugagccuagcuauaugguaaagauauuuguaaauauauuuugagucuauaucuuacuucugggagcaugggacuggaaggaagaacugggccuaacuucaaugcacucuagccuagcugaucaugcucacaguaaccauugccucagcaggaguacagccccaacuaacaugcagaggaagauaagauuggcugggaauggauggaaucaucagaaaucaaacaagguacuaauaagaaaaaaaaaggagagagagagagagagaaagagagagagagagagagagagagagagagagagagagagagagaaaccugaucuagcugagaguaggugagcuuguacuuuauauucuaagcaccuggaaggcugaggcagagggagagugccaucauuuucaggccugccugagauauagugugaauagucuauuucaaaaacaaacaaaaaaaacccaaccagucaagguagcauacgccuguaauuccagaacaugaggagcagaaacaagagggcuacaacuuugaaaucagcuuagucuauauucuggguuagcccaggcuacacuacaagacccuauuucacaacaaugaaauaauucauaagaagguaaaaguacaauugagacuggaugaacugaaaguaaaaucccaccgagcaucuccaaucugcccauccaggaaagguagagaucagguagcacagccagagcuuugggugggaaagagcuccuguggccacgugaacaagaggcaaucuucagaguagacagccaaauguuaacguuuauaaaaggaaagugggaugggauguauacagcugccccuaaggacugauaaagaaaucccacccacuguccuaucuccaccuguuaaccagggacugggauagaaaugagaaaauuaaaaccucuagcuuccuccgucaagaucccuugccuaucuccuuuuagugugucuccaagaccugaaacugaaagccacuagccagccagucagucaugugucacuggaaauccuguagcacuggaauggaacccaccagccacagcaaggcugacagguuacgaacagugcugaguagaaggugaggcccagcacauccuaguaagcccaucuucccagaggccagaccacgucccauguuugaagccauuuugggguaguuucagucacaucuacauuggucauuuuaaggaaguauuuuucuuagaaucuggauuucugaaccaguguuguccauguuuguuuauguuguuuccauucuuuuaagaagagaccucaagcggggugugguggcacacgccuuuaaucccagcacuccggaggcagaggcaggcggauuucuguccgaggccagccuagucuacaaagugaguucuaggacagccagggcuaugcagagaaacccugccucgaaaaaaaaaaaacaaaaaccaaaaaaccucacugugcugugacucaggcugaucccgacuccuauacucaaguaauccaccucccuucucggauuaugagcccaugucaccauauccugcuacuucccaggugacuccuaggaaaaguaugguaugucaaucuucuccaccaaacaagaaaauccagcaacugaaucagaggaugaccaggugauaaccacagcccagcagucaaggcaaggucagcguggcaccagccuguauucagcuggcuacucagcuuugggacaugauaugguccauguuauuggcuaaaugugcccauuaccaacugcagcaacaagagaagucugaugagcaggcauccucagggcugcccaacucuugaguaacaaaaaucagaucuuuugcaccuuagucaacuaguaaggagcuuggucacuacucaccauagguuguccagggucugaaaacuucacuuuaauauccugcagauguuucaagaucgguucaucauauuccuaacaaagaaagagagaacccugaacaacaguccaccccucauggcagucauagcugcaugugccccagaugcuggguugucucuauuggcauccugucucuguccuguaguaacuucuggaaagcaaugccaauuuguucacuauguaucucugguggcggcaguaacacaccaagaaucagcugccaccugucucuagagugucaucaaugcuggcuacagggaagucccaggcucuccugccaccaucugacccuacaguuggcacagugccaccaaccaagacuucuggccuccaacaucuaaaauagcaaaguaaaaggcuuggcaucaggggagauggcuaaauuagcugcuggucuuccugcacaguauuaacuagggacaauuaauaucccaaaucugcauaugccacuucuguaagaacacagaaaaugucaaagccuaacauauaggagccaacagcucccuuugcucuaugacuuacaaugacuauugcuuagacuuguacaguaaagagccuacaugagaaaaagcuaaaggaaugaagacuuggauaccugaaaugacauacuacuuacagguuagaaugguaauucauucacccuaagguugacauugagucucagaauuuaaaguuccaaaccucuaagaacuaagcccacuaaaggccacgccccaauuuugagguuuguuuguuuuuuguuuuuuuuuaacauuacagaauaaaaacaaaucauaccuauuagcuauuagaaaaacaaaacaaacaaaaaacaaaauaaaaaaccagaccacaccaaaagcagucacaugucugacaccaauaaaggugcaugaaccuacacuaauaugccugccaugcuaugcaucugaucugaauggccaucccagcagccuaucaugcaucuacugccaccccaaaugggaugucugaacaucagacgagaaccaauauggagguaugagaauaaauacaugcacauacacucccauuaaaguaccagcacucucuccaaaagcaaagcaaagcaauguuaccaacaaguccuaaugcccccaucccucacguuuaucagagcugccagaaagcugaccagaccacacauacaacagagugacuccaagagauaagcagccuaguaccuaaaugcuauacuggaagcuauacccucauuacaacugaguuuuacuugguuuauccccaccuagcagugugagcaacaacacccaggagcacaaaagaaaauacaacugucccaccaaccugacucaaccccccccccuuuaugcauacuucccaucccauaaagccaaacaggacuaugagccaccuggggcauacauugaucaugugaggagauucugaaaacaccucuccccagauucccuguguucacaggaggaaccuugugaacaaggcuuuggugugcaguucugggcucuauaggagguauaggagagaaaccucucaagcucuugugugggcagaauuauaagccuugccaaguaaugccaaagaaaauucagccuucuucaacaaaggucuuuagagcaccgagggaucagggcuacugcccaagugccagcccccaaaaggagacuuuucauucaucuuaaaaugaaucccgccgggcggugguagcacacgccuuuaaucccagcacuugggaggcagaggcaggcggauuucugaguucaaggccagcuuggucuacagagugaguuccaggacagccagggcuacacagagaaacccugucucgaaaaaccaaaaaaagaaucccagcagcacccaguuaagcagcgaguaaccaccaccagccaagcucucaacauacaagaaucgggcaucaccccagucucccccaacccaccugcucaccagguagaagcaccucaccugcaccagcucacuaagcauguccacauuucugaagauggugaaccagaacucagggaugccuuugggguucagcucuuccacuguugcugcuucuuucucagcuaugacuacuuuauucuucauaucucccuacaaaucagauuuuaaaagucuuugaaauauggaagggaacacagccccaggaggaagguagguuaaaggaagcugaaccaaauggauucugaaugcuuaucaugaugccugguaagucagaacaacaugcagagaucuuuaaaucaucaaaaugggcuuuucuuggaucauuaggaacaaacuaauguaaaaccacagcuucaaccaaguucugccaaugucuaaaagcagaacacuggcugggugugguagcauaugccaucuaugugaguuuaagaccagccuagucuaacaaugaguuccaugucagcccaaguuacauaaugagacccuguuucaaaaacaaacaaacagcuggcauuacguauauccauaaaaauuaaacauauuuccaaaaagaucacugaaagauaguucuauugaaccaaagcuaucuguuaucuaaacacaaaauuaggcagacagaggcuuugguguaacucggugguagaacacuugucuuuugcaugugugugucuggguuacaucccuaguaccuuaaaaaaaaaaagcaaagcaaaccuccagaauacaaguuaaaaugaaccuuguaccaugcuagaacuuuccaugguauguggaugagacugucacagaaaguggauacaaugucaugaugcuggucaaucaguuaccugauggucuaaagacagagugaggacgagcagccugaggcuccagauggccccucgauacacgugccuuccuccccacugaggaggaagauguauagcucccacccauuguaacccccaccuccucuagccuuggacucucauugauuagcuuuguucuagagacagagucucacuauguagaccaugcuggccuggaacucaagaaucugucugccuaacucucuaaugcugggguaaaaaucauguuccaccaugccuugcacacuacaaccaauuauugccugccugaucuguauuucaacccuaugcugcacagaccacuaagaaagaguaguaacucacuugucauggcaacuaagcacaguugccaugugccucagaugccacagugucaucauaaacucaugcacccaguggagagaagggaacuacuauagucccacucuacaaagcuuuguggacagaaaccaugaagcagagcaagcccuugaggucaucuccuaauaccacaaaaauaacuaggauuaaacaacaguguacagcagaaacuuacagccaacuuguccuccuccucauucucacugugccacgcugacucugcaucugugggcuccacgucaccagugaugaauucucuucucuacauaaaaagccaagaguccaucagcacauuaggcucucugcaaacucaaaagcuaagauguuuacacggaccucugccaagacagucaaauucccugggugguaccgugucucacuccagagucacugcaugaagcaagcacauuaacagcacgcaccuugucaaauagaggcugguacaaggcugcauacuuccucuccaggucaugaacuuccucguagaacuuagcuucuaugugcgcacaccucaccuggagcugcuucagggcauuaauucuucuuuugacagcuuuagguaaacuacaagagaacaggaaauaaaacaccuaguaccagcaaacaacuaaauauacacauacaauaagcacccugauuagaaagagcugcuaaaacccuacuugcaaacaagccaacagaaaagaauggacugcuugcugggcaagguggguacaagccuuuaauuccagcagaggcagguggauucucugugagcacaaguccagcccaucuaccuaacuuaacaaguucuaggacagccagggauauauagaaagaccauaucaaaaaagaaaagaaaaaaaucaaucccauaauauaucaaaagcagaaaugggguaucaguuuacaaaauugcucucuugucccaaccaaacuggugaugaaaaacagagcaaagagcacauuugcaaucccaaucacgugggaggcuacaacaauaagaguugcagaaguugaaugcuauucugggauacacagagaccaaggaggaaaaguguaggucaaagguagcacagcaaccuaauauacagauauuguccaauucccaccacacacaggcacauacacccacaaacaccacacacacgcaccauacacgaaaaacaaaacaaguggggcucugggcaugguguuaugcaccuauaaucuuaacacuugaaaaguggaugaagaaggaucagauguucaaggcuuguuuggcuacauaguaaauucaagcucagacuaggcuaccacgcaagauuuuaucuuucaaaaaaagcaaagacuggggcuggaauggcucaacaguacuugccacucuuacagaagauccgaguucaguuccuaacacucacgcugagugacuuaaaauuacucuagcucuagggaaaucagaugccucuggugucaauguguaucuguacucaagcgugcaugcacacacacauacacucauaauuuaaaacaaaagcccaccaaagagauggcucaguugguaagggcgcuugcuaccaagccuaaugaccugagaaguuagguccgugagaaucacaagguagaacgagaaaaccaacucuuuuaaacuaucuucugaccgcuacauacguacaacgggaugaaauaauaauaaagagcaaaagcagaacucccacacaaggacuagacacaggcuggcugacaaggacucgggcauguaggcccugaugcuagaacugaacaugaagucuauggacaaccucauagaauucucucuccuaaucguaccagcuaagaguuucuuugccuugguuccacaguuucuuuucuuucuuuguaugagcacuccuaaaaucaaaaggaaaacaaacaaacaaacaaaacaaaaccaugcaggggaagugguggcacaugccuuuagccucagcuugcagguggcagagauaggugaaucucuugaguucugaagucagccugguuuacagaguaaguuccaggauaaccagggcuacacagagaagcccugucuugaguaugaaaggaaagaaaaaggaauuuaaccuauaaaauuguuucaauuaaaaccugaaaaauaaugccaccaggugaaaacauguucacaguaaauuugaauacagguccacauaaacagccagugcuggcccaacagauaugugaggccauguucucacaagcuaucaucacccugugccugucucaguaagcaaaaccagaaaaccagacaccauucucaaaccccucacuauauccuaccaccuacuccacaaacaaacaaacaaacaaacaaggaaugccaaacagaacuaaaacgaacuguacccacugaguagaguaaacccagaaagguuucuaaauggacacaaggaaugucuccuccuauuguaacagcuaagccuuacccaacuggacauggagccugagguggcucauuucuuccagaaggcaaacagggaggcccugagaagcaaugucucauuucuaccauacaacagagccaggacacaggacacaggcuuccugacaaggguaaaaguacaagugucccacaguuggccaaauagcacucuagcuucuuagcugagucgucuaccagccacguggugguacugugcacuaccaagcagacaagaggagcugcuccugaguuaugaauaacacaauugcugcuccucuaagacacaaagauauuuguucuguugcuuaacuggcuauggacuuacguuucuauguaacuagaaggagugugagagacguugucaagacguuccugcaaagcugccagcacuuguggguucugcaucaccuggucugugaguuuuucuaugaggaguuggaaaugagaauaauuauuuagcagccuagaaccccaacaccaaccuggaucucaggcuggucaacccagcuacucaaaaggcuaaguaaggaaaugccaugccagaccuuccuuaucucaaaauaaaacacccacaagaagcugggcgugguggcacacgccuuuaaucccagcacucgagaggcagaggcagguggauuucugaguucgaggccagccagaucugcacagugaguuccaggacagccagggcuacacagagaaacccugucucaaaaaaccaaaaaaaccaaccaaacaaaaaaaaaacccacaagagugcuggacuguaacucaauaguauacuacuugccuagcauaugaagcccuggggcuaaauccuuauuaccacaaaugucuguuagaaauaucagcacaggcuguuaucucagcacucagaaagaagaggaggacaaucugaauucugggguuaaacuacauaaugaguuccaggacagccagggaugcccagagaucuacaaagagauaucucaaaaaaaaaaaaaaaaaguaguacacaucaccuagugcuuuuaagccagaauuccguauaagaaaagaggcuuguguuggguccagauaagaagaaacuguagcaucucagaccacacuugcuuuaaaauaaacaaauauaaaaauccccaacacauguuuacuuaucuuugcuccuaaauuucuaaauauaguaaaauacuuguuuagagacuuguaucuuaaaaguaucuuuugggggcuggagagauggcucaacaguuaagagcacugacugcucuuccagagguccugaguucaauucccaguaaccacauguggcucacaaccaucuguaauggggauccgaugcccucuucuagugugucugaagaaaacaacaguguacucacauacacgaaauaaauaaaucuuuuaaaaaaaaaaaaguaucuuugggaugggggaaugggggcagggugggagaggcagguagaucucugaguuugaggccagccuggucuaccugaucuagccaguuccaggacagccaggguuacacaaagaaacccugucucgaaacaaaacaaaaaguaucuuuguuaaucacccuagugggcagguggcgacagaggcuccugccuguagccagccuagguccccaagaucacugacuaccaacuuucaggggcugguaauuaacucugguuacaccuugcuccccagucccauugguguuggaagccagggacaaggacaagauuagcuucuaaagcauucacccacuuaguucaaagagauggcuuuccccagacugcccucuucccuagaaagccguuuccccacccaaaccuaccugcaaaaaguacucugaccuucucacaugccuuuguucugaacuuguaacacugaacuauuauuuagaaccugccccccaccccccauaaaaggagacaccaagagaauaggaacuguccuucacuaggugauggaguugaacaauuccucucuuauacaauccaggcccaccaggaacuuaagauucuccugcuuggacucccaagugcuagaauuauaugauggucuacacagccugcucagagacaguuaagauuuuuuccauuuuaucauuauuaguguguguauauauucaaucaaaugugcacugaacaugacugcaugugaauuuacauacacaaacauacuucuagguuuugcuucagaauaagcaggagaggaaaguugggugcuagucugguuaacauucugacacuuaggucauuuauaguaacaaacugguucuggagaagaaacccucucuaaucacugcuucauccacugcacugaccuguauuacuggcauuuuuagcagcuuccacagaaucugcagggccuccaucugaaagacuaaaacaacaaguuuacaaaguauuaugaacagaaucucagagauagaaccaauuggcauuuucaguguuuauccaauguauuagggucugucuguacagcaagagacuccaggucaggugaagacaacacuagcugggcaugcugcaccaugccuuuuauccuagcacuugagaggcaacagcagguuuaucucugugacuucaaggccagccuuuucuacauaguaaguugcaggacagcuagagcuacacaagaccuugucccccacggacaaacaaacaagacaacauggucacaccuguguuauuuaagggagacuuccucccaucuaaacagaucacacccacccagcucccuuuccucacacccaauacaaaggcugcucuaaucuauaacccuugccucauuuuuaauuucuaaaauuaaaaaaaaauaccuuguaugugccaugcauggugauauacaccuucaaucccaacaccugggaaacagaggcagguggauuucuaggaauuuugagccaugcuuguguacccagggaguucuaggccacccagggcuacuacacauugagacucuguccuaaacacaaaacaaaaacaaaacccaacaacaaaaauuauguuuaugaguaugucauauguggauaugugcaacgccaauggaggccagaagaggacaucagauccuccgaacuggaguuugugagcugccuaaugugggugaugggaacaaaaaguuaagucuuugcaaaagugguacauauucuaaaccauugagccaucucuccagccugcuaauuuuuauucugacagucaaucucuugaugauauaacuggucuauagugcuuaagccacuucacuggaacaacaagcuacccccuggucagcagagcacacaaguggccuuguacagcagaugcaacggucacagugcucugccaaccaugcagcaucacuaaaacaauggcuucacaaacacaagccugacuggcuaccaaagagccauguauaccuuccugaagacaaaguucuacaagcccuuccagugcaucucugggacaugaaagcagagggagcuaugggaaaaugaagggcaauuaugaacaaaauuaaugacauacauguaugaaaauggcacaauaaaauuuauuauuuuauauacgaacuaaaaaaaaaaaaaucaaaacaacacucaaccaacacugaccuugcauaucccacuaacaauccuuucccugaucccuggcagguaugucagauuaaugacaugacuucaccaaggguggggaaacagggauuaaaggcuagggagcacagaaacuucaccugagacagcuggugagaucaauuucuuugccagcaaaagggagaaaaaaggacauuaccacuugaaguuuaaacuaguuaacuuugaauccuagcuucugaaauauagcgggcucuagcucaauuccuaaacuuugaaaucuaguaaacaaaguccauuuuggcuuaccuguuuucugccaucugaacgccuuuguccccuacaaaugagaaaguucacaauuacauucacacacacacacaaauguucuauuacucuucccgcaucaugauggcacuccaccagucauggcaguugagaccuuuuugcaggugaaggaaauggaaaugcccugaugugaccugaaguuauacgagcagguacaugucuaaucucauagacagguacacuuaagaucuagguuucacuagacauggugaugcaugucuuuaaucccaaccacuggguggcagacacaaauggaucacuugagucugaggcauaaagaguucuuggcaaauaaugcuacacagugagaccaugugaaaaaacaaaguuaaaaugaaauggaaauuuuuuugagacaaggucucauguagcccagacuggccuucaauuugcuuuguaguugaugacccugcaugucugacccucagccuccacauccccaguacuaggaugacaaguauaugccagcaugcuaggcuuaugcagggcugguauaaaauccagggcuccaugcaugcuacaaacugagcuagauccaaaacauucuuacugacacuaaagugaccagacuucacaguaagaaaacagaauccuaaucugccuucucuuuacaguaaacccgacagauccacacagcaacuuccucaaacaauucaaaagcacauuguuugaacugucucucacauagacagaauaaugcuaaucuaucuuuuaugccaccuacacuguaaaaacacuacgagacacucaacacgaccacucuguaagaauacuugaucucuagcagccgacuuacuucaagagaguaugaugaaugagaaaaagacaaccauacaaagccccucacucuugccaaguguacauaaugagaccuucugaaagcuauacuccugcuaggaaaacaggagacaggaaaaacaguuccagcaagagugaugggcaacugucucacaguuaacuagcugaauuuucuauuagguuuucauuguuucaaaauaaaauaugugcaggugguucaugccuuuaaucccaggauuugguaggcacaggcaagugucuacauauugagguucaggccagccagggauacacaggaaauccugucucaaaacaaacucaaaaugcacaaaaacaugucacaugucuuagguaggguuucuaucacuacaaugaaacaccaugaccaaaaagcaaggggaggaaaggguuuauucugcuuacauguccacauugcuguuaccaccaaaggaagucagaacagggaacucaagcagggcaggaaccuggaggcagaaacugaugcagaggccaucauggaugcugcuuacuggcuuguuucccuugguuugcucagccugcuuucuuauagaacucaggaccaccagcucacuugugaucccaccuacauuggggugggcccuccccgacugaucacuaauugagaaaaugccuuacagcuggaucucauggaggcauugccucagcuggggcuccuuccucucugauaacucuugugucaaaaugacacacaaaaccagccaguacauaugacuaguuuuuuaaaauuuaaguaauguaugaaagcacaaagaguaagacaacaacaguacugcacaugaccaaacccagagcaacacagcagcuucccacacucagcuucaccuucaacgaaccuuccucacacccuagaucuuugcaguccaaacucacuggccacugauguacauuccuacaucuacccuacaaagugaaccauucucaauuccagaaaacacuugcccagauguccaacaaggcuuuucuaccguauacuuuuguuugaggucuccauugaacgccuuagucaaaugugguuugccaccccuugcuauucuuaacuuagauggcaagauuuucauguaacauuucuggguuacaagaaugagcaauaaacacugagcugguuacacacaagcauuccuuacacuuuggcuccacaguuacaguaccccauuaccuaccuauggcuaacagcagcuucucuggacugcauucccagcccaucacccuuucccauuuguacagcaauccucaguacaucagucucaccaccaaagacugagaagccacgcccacuugaagcacuacagugguacagcaagucagcccaucucugauacauucauauagacuauccugccccgugagucuauccucugcacacugaaaccaaggcaaagugccagcacacgcuccagcaccauccauuacuguguuuaccaaacacugaaagucauaaaagaguuaugcaggugucgagagaaacauccaucuuguuuuuaagguuaaaaugacagguuuaauaccgguuuuaugacucuauagcacaaagccuuauuaggcaaacuacuuuuaaaaggcaucaagagucagacauaaugaugcacgccuguaauuacaggacuuggaagguaugguuaugcugaagcuagaggcuagccugggcuacaaaagaaccugucuuaaaacacaaaacauacaaaaacccuaacgaucaaguuagaucaugacagucaucagugauacuacuagaauacagaacuuuagguucauuuccucuuuuugcuccaaacaacaaaaaaacuuucggaaggaaaacauuaaauuuuuauagcaaauuuuaaacuggccacuucuuaaagauuaaaaaaaccaaaucaaacaaacaaacuuuuuaugcauaugaaugccugacugcauguguagcauauaugugcaauacccaaagaggccagaggagggcacuagauccuccugcaacuggaguuaugggugguuuugagccaccacauaagguaaugagaaccaaacccauguccucugcaagagcagccagugcucuuaaccaugaacaccuaaacugccacucccgaaagacaaagaaaggcauaaacuguggaguggcaucacacuucacaaaacccacacuuuuauauauuaucugucuucauaaaagccaaaggucuucaaagccuuaacacaagauaagcacaugauuacuauaaccuaaacuggccuggagagaugggucagugaauaaaggugcuugccacuaagcccgauaaugugaguuugauuacugagucccauauggaaggaaagaacagacacccauaauuauccucugacuucuacucccagcacauaugcaaguaugugcacggauauaaaggaucuaaaacacaguaacuugguucagucugaaagauggcaggcugacccagcgaagcuggggacguguaaccagguccuacaggaguacugacuuacaacuuaggaucaugucaaagggacaaaggaaugacauguuuuaagaaggaaucaggaaaggccuccccacccccacuccccggggagguuguuuaugcuauacacauggaggucagaagacaauuuucaggagucuguucucuccuuuuaaccaugugaagccagcagcagacaucuuugccagcugagccaucuuguuagccuguaauauuuuuaagcaaucagauauacauuagauuggucacugaaggugcuagguggugcuuuucugcuugcuuuugaaacuucucauuagugaggccaaggaccaaagaagaaaaacuuccaggagggcagagcauguccacugacucaaugcagaguucagggcuuagcaaaggacuuggcaugaaacagguagccagauaucuugucucaguuaaucccugcauguaagaaccacgguacugaacucccuuugaacaucuuggccuauccuaagcaauuuuggaagacacaagaugaggacauuuccuuagucacaucugcuuacaacauguacugaaacaccuccagcagaaaacagcaggucaucucaccagagauuucuagaagccaaaccaccaggcuucaggaagaaaggacaaaaugauuuuuuuuuucuucccucaagcaaaaugcuccucuggcagacgaaguaccucggcagcauuuggaaaaguuaugaaaauaugaacaagcagauauuaggacaauuuucuuaauucagcacuggcuaucucuucuuguugcuaagaggcauuuucuucccccauauuugaaauuacaaacuaccuuccaagacuccagugucucaaaaguauccucccacaucugacucucaccugcucccgcugcaggaagggcaaggccauucacuauuugcuuuacacuggagacccuaggcuggagaucuugcaugaauaauacacguuacucugaagcaacugaaugugacuuaaaucauaaauauaauaauuaucuuuuuguacauaaagcucagagcuaaucuuaccucacuagacugagucuccuggacacaggauggaagcacauuguuacaacagcugacagaacacagaaaaaaggaauuuaaggcuguacagcaagcagcuagaaucaaaagguaaaguucacaaagccagcuucuguaguuuucacacuauaaaaauaccacaugccuccuguuacugucaaauucaauagcagagcaaaguaaagcagaugagcuuccucucaggagacaggagaccugacugcuagaugaaaacaaaucuaugcuaccaucaacugucuucaaaaugccuaaaaauccauuccaagacucugcuauuuacccauuuuuacccaccaaaacaggcuuacugaucuaugauuaauaacaggucccaaguguagucuacgaagccuccauacuaccacuaucagguagucccuagcaaaggcugaggguagaaggaagucccugcuauuucccuaguaccuuccucuacuuuggcaauaggugcagcaagaugaagaugacaucagcuucaauucuaaaugccuaaaugcacuucaucuuucuugcaguagcgcuggcuggccuugagcuuccugcuucuaccuuuuaagagcuggaauacagauacaagccaacacacccacuuacauuuccuuuuaaguaaacaaaaaaaccuuguacucacgggcuagaaguccccaacagcucauuacuacugccucuuuuucaaaacaggucaccuggggcuggaugcaagcagcaaagaacucacugaugugccuauuucacacugagaguugcccuuagaccuucagauuuaaacuacccuuucuuaaauuucuaacuuauuuauguguaugggugguuucccugcuugucugugcacuacuugcagaggccagaagaggcuguuggaacccugggacuuaaguuauagacuauuagaagccaccuuaugaguaugggacucaaaccuagguccucugcaaaagcacacaaugaucuuaaccaccccuaaauuaacucucuugucuaggauuuuuuuucuuccaaaaaccaaaauuuuagguacuggcaguuaaauuuuuauacaaauacaacauaaacuuuuauacacaacauaaagacagcuagcagggacaguauacuuucacuaacaagaggcaaacaggaaaaaaaaagugagauaggaucuugcuguuuuuccaagacagauuuuaaacaguuccagagcaguugggaaucuagguguauacugccauaucuaucuuagcuggggcauuuuaagacucaaguacaaagucagaccaaaguggugaacuaccucauuucuaagaauaccaccccugcaggagauuuauugcccacugguauauucuauauacucaacuacacaaagccaaauggccagcucacaagccaugauuucugagaagaucccaaaauacauacauuuucccccagaacuuugguaauacaauuccagaauuuucaaaaaacgauaaaaucacuauuauuuucaccagcuauucuauauuaacugugaaaaacaguucgggauuuaaagcuaaaacaucaaaauguguuuaaauguuaugacacugugaaccaauauuggucaacuaaggggggggguugagaccgacaacugaguuuuacagcaucuacuuuaguuaaaaugauacagcuguagacuacccgacaggugaacuauacucuaguccuaucaaagcccugcuuucucugaaucuuacuguucaucugaauauuuguuucaauacguuauuuauuuaauaauaaacauuuauuauuaaaacugagccagauuaaaucuauuugaauuuagaugcaagguaccaucacacuuaaccuaucagggacuuaauuugcaauacaggucgaauacuccuauaccaaaaaaaaaaaaaaaaaaagaagaagaagaaaagaaaucagaacgucccaaaacccacuucuuuucgagcacauuuuggauuuccagauuagguacgcucaucugucagaccuacaaauauuccacaaaccgaaccacuucaaaacccaggcguuucuugcuaaugcacagucagccuguugcaccuacaucacguacuauugugaaugaguuaagacacgucaggagcuuaaaggagccccugguguguaguaagcggagauuagucaccgagaggaagcaacuacuaugacaggaaggcggcaguaacuuaaaagcauuuaacuuuuggaccaaaaacuuaaacuugagucuuuuugcuguggaauaugcauaugcucguuaccgcagcgcacgcgccggaagcuaccgcggaaauuccuccaagaggcagcgaagcagaguuggaggaagugcgggccaacuugccccaaggauacccucggaagaagggguacugcugacgacccugaacccguuaggggcgcccgggucugaaggcucagugugugucacuaggcuggcuccgccuccaccgcaggcucagagagugaggucuggcucagagaccggggcacugugcggagagcaugcaaagcccggaagggcgaggcggcggcccaguagaccccuuccuucccaggcgcggucugagacgaggcguacccaggcccaccucgcuggggaggccuuguccucucaaggaaccgccugcgccgcuucgcguggguucucgggcggcgggaacaaagcgcgcugaccuucagccgggggcggggcugcacggaggagggaccggcccgccauccgccgccacccgccacccggaccucugacccggucgccgcccgccucugcucgccgccauggcgcgucggccugcccgcgccgcccacuccuccccgucuccgccuccuccgccccagucccucgccagccgcccgccgcgccguuacccgccagcaccgcaccucgcgccuccugcggcaguggcgccuguccuaagcucgcuccggggcugcaccgccguggucgccaacaaaaccaccugccauuggccguaucgccgggcuccacccucugcgagcaaaacgggcgacgaauggacaauagagcuguuuaucaacugcaccaggcacuaggaaaggcgguauccaaucaaaaucuguugagggagcacggcguccagccuaagcccgcgagcuauauguaguuagaguagugacguguguuccggcgcacgcgcaguucgugcuucuuuaaaggggcugcugggcgcgcguguaggacuuugggcuuguuacaaccucuaggguuugagcuuccuggaccacaucggcaacgcucuuuccagauuacuuacaacucccugccuucccccggccugggaaaagcaccgccuacuucucaaggccuucugacccucugucuacagugccugccuggcaugggacuacccuucugauagaaaaguucagcacaucuguacuggcugguuuugugugucaauuugauacaaacuagaguuaucugaaaggagggagcuuugagaaaaugccuccauaggauccaacuguaaggcauuuucucaaugauuggugggagaggacccagcccauuguggguaguaccaccccugggcuuauugguggugucuguaagaaagcaagcugcacaagccaguaagcagcaccccuccauggccugugcaucagcuucugccuccagguuccagcccugcuugaguuccuauccugacuuccuucaguaaugaacagcaauauagacguguaagccaaauaaacccuuuccucccuaacuugcuuuuuggucaugguguuuucauugaagcaauagacaacaucugauaagaauaaauaacuugcuugcagauaauguguguuuuccuaacaaauucuacgaacagggcaguuggaaacaaagcuggguauggugcaacaugcaugccuucaaucccaguacuucugagauaagagauacaggugacagaaugagcaguuugucacuuccaacuauguagccaguguggggccagucugagcaacaugcaacccugucugaaaaacaaaaacuuaaaaugaagugugguuacugaaggccagaaggucuacagcauuguuuuucuguauuacuucucuuucauucuuaaauuggaacuauguauaaacaguuucgcuuacaaaauuaaggaaaguaaauaagcucguauguuuuuacuuacauuuuuuucugacauacauuuuuuuuuccugacauuuugauugguuaguggcugguuuugcuuuuccacgacaggguuucucuguguagcccuagcuguucuggaacucgaucuguagaccaggaugcccucaaacucacagaaauccaccugccucugccucuccggugcugagauuaaagccgugcagcagcaccaccagguuuuuacuucauuuuuauuuggggaguggaugugguuaaaucagacaaguauagaaaauaguuugguagccagggacuuauuugguuuggacuacacauaaugcuuuucuaauaaugcucugggcaguguaaaaguccccccaacauauuuuuaaaaaagauuuauuuauuguauauaaguacacugcagcugucuucagacacacuagaagagagcaucagaucccauuacagaugguugugagccacuaugcgguugcuggaauugaacucaggaccucuggaagagcagucagugcucuuaaccgcugagccaucucuccagcccaaaccccccuuuuuaauauuaaguaagacaccaggcaguaguggcacacaccuuuaaucccagcacucaggaagaagaggcagacagaucucuagaaauucaaggccagccucgugggccugucacagaguauuucugaucuguacuauucacuuuuggauacuauuuccuugcuaccuuacaaucuguguguaucuuuauuucaauuccuugaauaaaacacucagaccccaauaacugguaauaaguuuaauaaugguauuucauuauuuauuaucucuaagacagggucuauguagcccuagccuguuaacucauagagaucuaucugacugcuucugccuccuaggauuaaaguuauucacuaccaugccuggguuaauaaagcuauuugaauacaggcugaagcauagggauuaagagaggugcucagaagguguggggggggaggucuacagcaugacacuacuuaauuuuuuuuuaaagauuuauuuauuauauguaaguauacuguagcugucuucagacaccccagaagagggcaucagaucucauuacagaugguugugagccaccgugugguugcugggauuugaacucaggaccuuuggaagagcagucagugcucuuaaccgcugagccauucuccagcccgacacuacuuaauuuuuaacauuaauaaaauguuuagucauuuuuuuuuguuuuuuaucuacagauuucuugguauaguucugguuguccuggaacuugcucuguaggccaggcuggccucaaacucagaggcuucugccucccaagaacugggauuaaaagcauguaccaccaucacccaguuuaaacuuaaucuuuaacuaucacuguaaauuacauucuuugagcacucugacuuagccacaaguucacaucaacagcugaucuuaagguaggcagguuagccuggcuuucucucagcagcaugcacucaugucuuaaauaugaacuaucuuucaucuaagacugucucuuacucuaugccuauacuuaaauccaaagcaugcaccauuucuuaucucugcuuaauaagcuugcuaacuuugcuucacuaugacuuguccugaaauucuuuacugugguacaaucaagguuccaauuuuaccugacuggaggucucuguggagggaggaaauguacuaggcugggcuaugugccuucacugcugcugacaaggguagcagggagguauuuccucaauguagccuggggcuggagcagggagugcaguaccagcccagccuccccaugucaauuuauaaaaagcauuuaguuuggcuagcaaauaagguuaccaagcaggaaugaacaaauugucuucguuucuuagaaaugagucuuuuggggggcuggcgagauaguucagugguuaagagcacugccaccuguccagaagacccaaguucaauugucaacacccacauggcaacucacaacugucuauaaccccaguuccagaggaucuggcacccugacacagacauucauguaggcaaaacaccaaugcacaugaaauuuaaaaaaaaaaaaaaaaaaggaaaguaaagaaauuaguccuuuugccugguaaagguugcuuuggccagcauuuucaaauucaagucccaucuauuuauuuaacagucucaaaccaacucuuuccuuuuucuuucuccuuuuuuuuuuuuuuugagacaggguuucucuguguaauccuguaauccuggcuguccuggaacucacucuguugacccaggcuggccucaaacucagaaaucugccugccucugccccccaaguacugggauuaaaggcgugugccaccacugccccgcucaagccuacuuuuugucauggcaucuaucccuccuggggguuacuguggguaacaagaaggugggaggcaccgugguaagugguccuggcuccugaaucugaugaagguguguuaagucuuucccugcagugacuuaacuggcagguaggcaacauucuccccaaaccuccuguuugcaaagacuuaagagaaggcuguacugcuuuucugaguugcugcgaccaagcagcccaaauugguggcuuacuaaccagaaaugcccguuggaaauuagcagacugaagugcacacauggaaacuguacuccauugaaguuucagauggggccucccuccuugcacucuccucugcacggugcuccaggcuguccuuggcuggugacugcaauacuguaaucuuaacuacugucugcacauggcuuucccuuaggcccaaauccuaggccuacucucaugauuucauccugaugagauuacacaucuagggucaucuccagauguccggcgcacaggcaccaggaagugguucuucuacgagggcagcucaccugauguuaaagcaggguguuaguaguuguccuaguugucuggcugugcggaugcuaucaucagagguuaaagguuagggacuccugggugagacccccuaacuagcuggugacccugggauaagugccuguuuccccaugugccuacuucaagaggcuuggggauggguuuagagcagcaccaggugaguugucagcuugaggccaguguuagcaguucucauugacuccuguccacuuauguaguaauaacaagagaaagaauccaaccauccaaugucccaguagucagaaacugcagccuagcagaucccuuuaaucauaacccucagaccacaccaagcccaugggggacaucugaucucacucaagcccugugcucaggaagucgaaugcugaggggaaccagcaguaaugcaacugugggaucuauuuauuuauuuauuuauuuauuugguuuuuugagacaggguuucucuguauagcccuggcuguccuggaacucacuuuguagaccaggcuggccuugaacucagaaguccgccugccucugccucccaagcgcugggauuaaaggugugcgccaccaccgcccagcagaacugugggauuuauaaacuaagcugaagaccaauucuggaagcuuccccccucucccaauacaauuaaagccagagcuuuggcacaugcuaagcaagaacucaaacacugaucuauauuuuucaauggcuucaucaaagugcccaagcuggcuuugaacucaugauccauccuccugucuuaagacucccaaagagcuggggauuauauaacccgaaugccccaccacaccuaucucuaacagccauuugaguggauagaaggaccuguugaguucauagguuaacucaaggcuuagaugccaccugaagucuacuugccugcaucuggagcuguccaugcccuggcugucccucuagaucucuuaagaguuucaaagaaaguugagaauaaugucaaagucccuucugucugcauugcuccugugucagacccuucuccuaugauuuaagucuggcugacaguacccucccaagcaagcccuuggcuuccagcagaacuccuacaaucacugcugucugcuucaagucauuggauuaugcaguucucaacaccugcuccuugcccuuaccucccugccucugggaguguccaguuuuggaggaaaggauucuagggcugguaauggcuaaggcaguacaguagccauaaagccagcagccuauaauuaucuuaaguuggcucuugucccuacccagugcaggggaguguccucaggagcaggugccucugguccacugaugugacagggauuagaugugaagguaaugucagacuguaacucuagcaaggaucaugcugguaccuagugauucuggguaugcuggcaucuucugauuuuugagugccuggccuggaauuucccagcaggaauuugaagaacccuguaacaucaaccucccugaagcguaguucugugaaccccucaagauaucugccugaaauuacaacagaaagccauuaccaucuucaacagaguggcugugauuuucugcaagagccucagauggagugagucuacuguuucuucauaagaugugaaggucauuagaaccacuucuuccugcaccucccucccugcuguauguaauugugcuucagcuggcacacagcuuggcagaugcuggucuauagaaagcauuaacgaugggguggagggugagacuccauguauggggaagccaugcuggagugagccagugauggcgacuguuuggggauugcccaugcuucacucaugcuccugcaagcccagggaacucauuugacucguuaagcuagacccaguagagucucucacucuagucugucauuagugcaauggccugcugugaaaucagguagcaaacugguuaugguggcucaugguggcaauccuguaacucagggccaaggucagagaaucaccacaaguuccagggaaguugagguuacacagugagucccaggccugcuugagcuaucgggugaggaucugucucagaacaaacaaaauuaggugacaauuucacuugccuauaggaagaccauuuagcucuuggccuggaacuuacagauauccuaaaggugugugugugugccaccgugccugguuuuaagcauauucuuuauaguguuuucauuuuuaauagauuugguaauuguacaguuaggguggaaagugguauuucuauguauguuuacuguguagcaauuggaccaacauaucuguuaccccagauauuuguucuaaauauuuuuuaaacuuuauguaugugccagugcccauggaggucagaagcaucaaaugcccuggggcugaacuuagggaagguugugagccaucugaagugggucuaccuggaggagcagacucugcuccuaacugcugagccaucucuccaguccuaguagguaugugaaaauaaugaccuuccccagccuaaguuaugcuaugugguuguuuuccacacgcuagcuggacccuuguuuaacuucugaauucugcuuguuaaaugaaacacuaguucaugccuguuuuucuccuccagagagcagggguggcaaaugguugucugucugcuucccguggcugcuguaagaaaguaucacaaaccaggagcuugcauuaccagaaacacauucucacuggcuguguagaaccaggauuguggcagggccuggcacuccccagaagucucuaccuguguuccucuguccauuucucugcauguaugggugucugugucuucucuuccagcaauaccagcuguaauaaguuacaccacuauguuccauccugcaugaucagaacaugaaaucaaugccagaggcagacaugggcagaaagcguaguuacuauaucauguucuauauuauguuuacacaggcaggguugccguuacugccaucucugcagguuggaucugaaaauauagcuugggaaucagacuugugggaccuuugaagaucugcuacuuucucccuuagcauaauggccgugagaccuagcguauggcuaugugucucuagguugucccauuccuuugugggcagaccacuucucaugacuauggccacugcuguaggagagggagggcauuuagggcccagaaugcccugcugccacacucugccagcuugcccaucuguacugccuggaggguccauguuagcgucucugucccaaucuguauaacccauaauucacugcuguuccuuuccuucuuggguuugcuuugccucagcgaauagcugggguuccacucaguggucuuaccuacauguucaauaccuggaaaugcuaagagcaaagcugcuguagcccaugcaucccucugcacuucugcagcugacacacagugaacuacuucuuacaggcugacuuauggcuuuguggcuucucuagccuccacccucggggaaccugucucaucuccucacagugacauagguaggccugagaugcuucuaaacagaagcccaaggagggauugugcugaccugugagguuccauccuagaaagccaccuggugucuucucucccaggaaguacaccuauggagccacagcugccagaauggacaugcagucacccugaagccucaugagaccagagauauaagguacguaccucagaugauccugucugaugacuauuuuaaaaacacuguauggccuccuguggucucacacuauuaaacucgacaauacaugccuaugguaccccaggcugguacagggacagaguggcaggauacuuacagcagacacuaacauacuugucacaugggcuuuguggcaacugggauccaugccugccccugaacucucugaagauacccuuuacagguaccaggcagguucuggcugcuguuuuuuaaaucaucagcgaaggcuagacacauucaucuuaggugcugauucuuagcagggcugagagcaaacaggcaggagcagguggacaggaacacacuuggguuggaccuagacacacuuuaucuuacaagccagugguucugaacugggcuugcugucauaacggcagucccaggcagcuugccagagccccaccccacacagcaacgguccugcuggccaguugcucugggaaacccgcagugugugcucaucagagccagacagccaacugaguggcuuuugucugggacucagggggauccguuaggcugagucggccuuuucccuacuccaauaccaccaaaugugccaacacagcagagauuagcucagcuugccaaugugagggaaauuccucgggcaggcuggcugaaggggcucaauggacuaggaggccuaaguugcaagcugcugaccaggcgccuguaggucagcucuccaagugcugagagggcagaccagaccucaccguucagaagaauuuauuaucagugucccagagcugcuaccacucugccugauucaggugugagaacagcuguaaacaugaucagggcacggagccucaguagcuguggccuaguccauagcagccaggcuggcaggugcgccccuccugggcugccguggcaucacuggaggcugccauucuguaacauuugcagauacuccuuguacaguuucuccugggcuucaaagagcuucuucagcuucuuggccuggcccuugcucagcucuuugccuucggugucguggguaggcagacccugcaaggaccacacagaugccaucaguucccucugcccucugguccucaucccugcuggcaggagaugccucucucccugacuuggcuggauuuacucaggaucagcauccacccccuuauuuaucuagugcguuuuugagacgggggauacaccucaagacagaagcuggcugcaguaguugcgcaugccuuuaguccugacacucaggaggcagagguaggcagaucucugaguuccaggacagagugaguuccaggacagccagggcuacagagaaaccuugucucaaaagccaaaaaaaaaaaaaaaaaaaaauggggcuggcuucaagcuugagcuccuccugccuccaucucuaaaguguugggaucacgggugugagucuacaccucugguugucuggacaccaucacuggugugagucuacaccucugguugucuggacugguguccuuaguccagugugcuggucuggcgguggagcucuagcagcugagaacagagaaaagucuggagcacgucuuuuuuuuuuuuuuuuugguuucuucuuucuuuguuuguuuuugagacaggguuucucuguguagcccuggcuguccuggaacucacuauguagcccacgcuggccucgaacucauccgccugccuuugccucccaagugcugggauuaaaggcgugugccaccacugcccgacuggaacacucuucuuagggugaggagcagagucccacuaggaccuauaacuucucagcucagagguggccaggcagaugcagcaaugaauccaagggccugcagagacaccuaaggaacaaggcuguggccuuagcagcuugggcgguugggagggugccugcauaaccuacaaauuccuuuuucugccaccuuaacugggccugggaucagagucuacagugcuagaggccagagcucacuacagaacuggcagagacagccuagcuuagccuuugccccaacaggagauggauggucccagcuguccuuacuggagaccuacuccaaacuggagacccacuggccaaaggcugaaaguccuuggacuccagcuuggaugaug

SEQ ID NO: 33 - RNA, 40066 nt, Mus musculus
auguugaaaagguagggagaaaaugggcagccuugucuagucccugauuuuagugggauugcuuccagcuucucuccauuuacuuugauguuggcuauugguuugcuguagauugcuuuuaucauguuuauguaugggccuugaauuccugaucuuuccaaaacuuuuaucaugaauggguguuggaucuugucaaaugcuuuuucugcaucuaacgagaugaucaugugguuuuugucuuugaguuuguuuauauaauggauuucauugauggaauuucguauauuaaaccaucccugcaucccuggaauaaaaccuacuuggucaggauggaugauugcuuuaauguguucuuggauucgguuagcgagaauuuuauuaaggauuuuugcaucgauauucauaagagaaauuggucugaaguucucuaucuuuguuggaucuuucugugguuaagguaucagaguaauaguggcuucauaaaaucaguugcguagaguaccuucuacuucuaucuugugaaauaguuugugcagaacuggaauuagaucuucuuugaaggucugauagaacucugcacuaaacccgucugguccugggcuuuuuuuuuaucugggagacuauuaauaacugcuucuauuucuuuaggggauaugggacuguuuagaaggucaacuugauccugauucaacuuuuguaccugguaucuguccagaaauuuguccauuucguccagguuuuccaguuuuguugaguauagccuuuuguagaaggaugugaugguguuuuguauuucuucaggaucuguuguuaugucucccuuuucauuucugauuuuguuaauuaggauuuugucccugugcccucuagugagucuagcuaaggguuuaucuaucuuguugauuuucucaaagaaccaacuccucguuugguuaauucuuucaauaguucuucuuguuuccacuugguugauuucaccccugaguuugauuauuuccugccgucuacuccucuugggugaauuugcuuccuuuuuuuccuaaagcuuuuagauguguugucaagcugcuaguaugugcucucuccccuuucuucuuggaggcacucagagcuaugaguuucccucuuagaaaugcuuucauugugucccaaagguuuggguauguuguggcuucauuuucauuaaccucuaaacagucuuuaauuucuuucuuuauuccuuccuugaccaagguaucauugagaagaguguuguucaguuucuacgugaauguuggcuuuccauuauuuaugcuguuauugaagaucagucuuaggccaugguggucugauagguaggauauaugggacaauuucaauauuuuuguaucuguugaggccuguuuugugaccaauuauauagucaauuuuggagaaggucccaugaggugcugaggagaagguauauccuuuuguuuuaggauaaaauguucuguagauaucugucagguccauuuguuucauaacuucuguuaguuucacugugucccuguuuaguuucuguuuccacgaucuguccauugaugaaagugguguguugaagucucccacuauuauugugugaggugcaaugugugcuuugagcuuuacuaaagugucuuuaaugaauguggcugcccuugcauuuggagcguagauauucagaauugagaguuccucuuggaggauuuuaccuuugaugaguaugaagugucccucauugucuuuuuugauaacuuuggguuggaagucgauuuuauccgauauuagaauggcuacuccagccuguuucuucagaccauuugcuuggaaaauuguuuuccagccuuucacucugagguagugucugucuuuaucccugagauggguuuccuguaagcagcagaauguuggguccuguuuguguagccagucuguuagucuauguuuuuuuauuggggaauugaguccauugauauuaagagauauuaaggaaaaguaauuguugcuuccuauuauuuuuguuguuagaguuggcauucuguucuuguggcugucuucuuuuugguuuguugagggauuacuuucuuguuuguucuagggugugauuuccauccuuguauugcuucuuuucuguuauuauccuuugaagggcuggauucguggaaagauauugugugaauuugguuuugucguggaauacuuugguuucuccaucuaugguaauugagaguuuggccggguauauuagccuggguuggcauuuguguucucuuagugucuguauaacaucuguccaggcucuucuggcuuucauagucucuggugaaaggucugguguaauucugauaggccuuccuuuauauguuacuugaccuuucucccuuacugcuuuuaauauucuaucuuuauuuagugcauuuguuguucugauuauuaugugucgggaggaauuucuuuucugguccagucuauuuggaguucuguaggcuucuuguaugaucaugggcaucucuuucuuuauguuugggaaguuuucuucaauuauuuuguugaagauauuagcuggcccuuuaaguugaaaaucuucauucucaucaauuccuauuauccguagguuuggucuucucauuguguccuggauuuccuggauguuuugaguuaggauccuuuugcauuuuguauuuucuuugacuguugugucgauguucucuauggaaucuucugcaccugagauucucucuuccauuucuuguauucuguugcugaugcucgcaucuaugguuccagaucucuuuccuaggguuucuaucuccaguguugccucgcuuuggguuuucuuuauugugucuacuucccuuuuuaguucuaguaugguuuuguucauuuccaucaccuguuuggauguguuuuccuguuuuucuuuaaggacuucuaccuguuugguuguguuuuccugcuuuucuuuaagggccuguaacucuuuagcagugcucuccuguaauucuuuaagugacuuaugaaaguccuucuugauguccucuaucaucaucaugagaaauguuuuuaaaucugggucuagauuuucgguuguguuggggugcccaggacuagguggggugggagugcugcguucugaugauggugaguugucuugauuucuguuaguaggauucuuacguuugccuuucaccaucugguaaucucugaagcuagcuguuauaguugucucuguuaagagcuuguucuucaggugacucuguuagccucuauaagcagaucugggaggguagcucucuccuuaguuugagugggcagaguauucucugcaggcacgcucucuucuugcagggaagguacccagauaucugguguuugaaccggacuccuggaaggaguuguguuccacucacuagaggucuuaggaucccguguggaauccugugugcgcccuugcgggugucgggcaacucugcuggcaagguaaccuggggcucgaguggagcggaaggggcuugugccccaggucaggcccggguauuccgcuucccuauuuaccgcagucucagguucugcgugauuggauuggggcaggggcuguguuccacucaccagaggucuuaggaucccguggggaaucccgugugggccuuugcggguguccggugccuccacuggcaagguaccucggggcucgaguucauagugcuucuuauucucuccuaucccucuaucacauaauugcaugugguaguggcucccacugcagggggcgcuaucuuagaguuuuacugcugugaacagacaccaugaccaaggcaacucuuauaaagaacauuucacugggguugguucacagguucagagguuuaguccauuaucaucaaggcaggugcauggcagcguuugggcaggcauggugcaggaggagcugagaguucaacauuugaaggcuacuagcagaauacuggcuuugaggcagcuaagaugaagaccuuaaagcccucacacaaagugacauaccuacuucaacagggccacaccuucuaauagugccacucccugggcugagcauauacaaaccaucacagggaggccauauggcagaguacaggcuucugggugccuccaguucacacaugucucccucgaguuugcuuuuuuaagcuucugaaaaaugugacuuguugacauuuucuguuagccuaggaauggaccuguguucauuucuagccaguauuuaauaaagcuugauucaaacuuggcuuaaaaauugugggaguggucuuauucuugccuggugggauuaucauaaaacuacaaucggaaaagcacaaacucaaacuguaauuuaccuugaaacaugcacuuaaaauucaggcuaaaaaguuaagagaaucaaagaaagccagguaucaccucccacauuugcugccucgccagaugaccugaguucagaaucccugguauccacauauuggaaggagagaacuaauucccacagguugucuguccucugacauccuuacacaggcacacguacaccacucaaauaaauucauaaaugcaaaacaaagaauuuaaguugagguuuucuuaaguaguaucagauccuuugaagcaaggguggcccuugaacuuggaaguuauguucuuucagcaggcugacaucccaggggguccuccuguuucucuuuuacuuggugccugaguuguagcucugagaaggaagccugugcaggacugugccugggaugcagaugaaagugcucacuauugcgugaagcaagagcucuuaacugcuuuguugucucucugacuuaguauuucucucugacacacuugugaccuucguguuugcuuaagucuauuuuuucuuuuuuuuuuuuuuuuuuuuuaagauuuauuuuauuuauaugaguacacuguagcugucuucagacacaccagaagagggcaucagaucccauuacagaugguugugagccaccauguguuugcugggcauugaacucaguaccuuuggaagagcagucagugcucuuaaccagugagccaucucuccagcccuguuuuuuucuuuuucauuuucucuuuugagauugggucucucucuguacugaggcuggccuggaacucaauauguagcaaugguuggccuggaauucccaggaacucacagguuucaucuucaggauugcacaaucaaccacaguuucuuuucagacuucuaucauagucucuauaaaaauauuuuguuguuguuguuuuaagccaccagaucugucaguauggguguaaaacagguaaaagagaguaaauccagcuuuacucaugaaucuaacagccccucaagaaauaauccugccuggcucaaguaaaccugacugguggaccucuagaggaagcaagcaucuugcccugcugcuucaagaggugacucggguccagaauccaacacagugcaauccaaggcuuucuccaggguggggagagaguacugggucuggggugggggauuaaaauaacaacaaucuccccaguguaaggcaagcaaggacaugccugcuccaagguauguuugaagggaagguuuuuaauuuuagauaugagggagaguccagccagaggcaucuggaagaguccagagcagagagagaaaguaggaaacuaaauaugaccagcagacugacccagaccacagugggaggggugcgacaagagaggaguguuaguuuacagacaauuccucuaguccccacccaccagccaccuaccuagaaacagcuuacuaggggccugccaggugugaaccaggccuguaagacuacuugcuacccacucucucucuugcccuucuucacucuuucucuguccccacaugcucccagcuggcuaccucucucucucucucucucucucucucucucucucucucucucucucucucucuguucuuccucucuguacuccuucuuucccuuucucuguugcacugucccuacucuccuuguagguccuuauucccucccuucccccaauaaacuuacuuuuauacuaggcauauugcauugagugauuccuggggggugggagggacaccucagcaugggcccaccaagguauccccacagcugcuacaauuauauugcuuuauaaaacauaauaacaaggagggccaagagaggcggggcuuaaggagcacgggggguggggugggggggugggggggugggggaggaccaagaagguccaugaccaaaauggcuggguuauauaggaaugagaaacuggaggaaggaaagcccaaagaggcugagaaguuuaagguacugguggggugagaagagccucagguacugagugagccuggggucagcaugcucuuugauaugcuaauaggaaccacaguucgccauuuguccagaguuuuuuuuaaaccccaaauucuaacuuuuuguuaaugacaaaggccugcauaaucucaucuguaacugcuucuuagcugagauuaugauguaaucaucaggacacagaaaggcuggaaugcuggucaaagacagggaagagagaaagaguucaggcuuggggacaucugguuuaugccuagccaaguucugugggaccacauggggcuagagcaggcagcuuugagucagucuggaaauguugguucuagucuagggcuaacuggcuuugauuuggagcaguuuucagucgucaguugauugggaacuggacauauauagacuaaggucagaagguaaaguuaaggaccuuaugggaaaaaucuuuaugucgggugcacacuugaaauaucuaggccuaugguggcaagugguaggcugcuucuucuuucuuucuuuucuucuucuucuuucuucuucuucuuucuucuucuucuucuuucuucuucuucuuuuucuucuucuucuuuuucuucuucuucuuuuucuucuucuucuucuuucuucuuucuucuucccccuccuccuucuccucccccucccccuuuauuuauuuauuuauucauuuauuauaucuaaguacacuguaccuguauugagggcaucaaucucguuauagauguugugagccaccauguaguugcugggauuugaacccaggaccucuggaagggcaguccguacucuuaaccacugagccaucucuccagccccaagugguaggcuucucuuccucuuuaccaguggccucucacacgcacuauugucucgccagcaagaacacacgcgugagaaaccggauccuucugcagcaacuuuauuacaccaguuucaagaugaagaggaagaccccaagcaccaaaaaggugcugcuuguauacaccuuaguguggcauguccacaccugauuggcugcucucccagagccucaucaccacaccccgggaugggccaugacuuggcacgaaaacacucucccacaugugcacauugcuuguuuaccaauuaggccaugcaggcacagugaaaaccgcuuccaaaaguggcccaacauuuuugaaaucuaaaccugggcaugagcucucucgcuucuuggaagacagcccuucucaacuugaccuacaaacacaucacuguuaagucucaauccuuauuuucuuauucauccccaagaucuaaauaacuuuaaaaguuccagucuuuacaaauucuuacauauuaaaauuuuaaucauuuuaauauguccaaucucuuuuaaaauacaaagucuuuuuacaaugaaaagucuuuuaaaugugggcuccacuaaaauaccuucuuccuucaagagggaaaaauaccagggcccagucacaaucaaaagcaaaaucaaacugcagcuguucguucagcugccugcacucuacugcugcuccuauucuugguggucgucucaugguauuggcaucuccaaaacacuggugucuucuccugcaacugggcuucaccaauagccucucauaggcucucuucauugugccaagccucaauuucuuugcaugaccccuucaguccugggccaucaacugagacugaggcugcaccuucacuaaugaccuuccacagccucucacagugcugagccucagcugcucuccaugaccccuucaugccuucaaaaccuguaccaccugggugacucuuacauguuacuaagucaagggucucucuggaacacagccuuacacaaacuuugagguuugugcucucagaaaacucuucccagaauauuucaccucaguaaugcugguaucuuccuaaucaccacuaauuucuuggcuccagcuaaccagaaucaauauucccaguaaugcaaagguuuugauuuaguaguucuggcaucuuguuaaucacagcggauucuucaccugcagcgaaccaaaaccacagaaacuugguaaucaaaacagcaacggcccugauaaaagucucuaauuuucccucugaaaucucacaagucagaucuccauuuucugcacuguucucacauuaucuuccaagcuccuaagcaacaucccacagagcucuucacaucccauugacucuucuagcaaaaaguuccaaaguccuuccacaguccuccucaaaacauggccagguugucacaggaauaccccacuccugguaccaacgugcuuuagucaggguuucuauuccugcacaaacaucaugcccaagaagcaagaugggguggaaaggguuuauucaguuuacauauccacauugcuguucaucaccaaaggaaaucaagacuggaacucaagcaggucagaaagcaggagcugaugcagaggccuuggagggaugcuacuuacuguccugauucuccugcuuuguucagcuuucuuucuuauagaacccaagacaaccagcccagggauagaaccaccuacaaugggcacucccuacuugaucaauaauugagaaaacgccuccuggaagcauuuccuuaacugaaguuccauucuuugugauaacuccagcuugugucaagucaacacacaaaaucagccagcacacagguugucugaggagaaggccuaacucugcaccaagaaggccauguaccugggauuugaccuccaggaagauaggaaguccuuauccaagucccauaaacaauguuaggaauucccauccuaucagugaaaaauugauucagggaauuuugggggucagcaggauaguauaagugaagcucuggauuacuggauuugcugaauuagguagaccuuuaggugaagucaccaaaaggucugaggauaccauucaaaggcucucuaacaccuauaccaaggaaggauggcaccucaccacugaugggagaugaauccuucccuggauccugaaaggauguugacacaauuacauaguuggagucaucuagguaugacuaaauugaccaguuuacucaacaggaacuacuauaucccuggucuggaccagauucugcaagacacagucuccagaugucucaacucauggguaccaacccuauugggagguccugugccaaggguaaaagagaaagaaaaacugccucaggaguauauuggaaauuggacuucacugagauccaaccaagucaauauggauagauauuugcuaguuuuuguagauuccuuuucaagauggacugaaauguuccugauagaaaaaagaaaacuuuacauauaguggcaaagaaacucuuagaagaauuccucccagguaugguguuccuuaggauuugacgaugugccagcauuuauaucuuagguuguacaagguauaccuugagccuugggagucaauuggaaauuacaccauguacaucauucucagaguucaggacagguagaaagauugaguccaaucuuaaaggagaccuuaacucaauuaaccauagaaacugguaagcacugaacuauacccuccccuuugcccuuuuaagaguuagaaauacucccugaugauaaguuauuuuuccaccagugaaaugagccaauucaagccagauuagauuauauuaaacacaguuuuauuggaauauugcucucaguugaguucacugacccagggaagaaggugagggaaguuaccacagguaugggguaaaaggcaaaggggaagagaaagugcccaugugcagagagagaacaggaagaccaaaauccucuggauuauauagggaagagccucugcgggaauggcagcccagucccuaggugggaaguucaggauugggggcagguuaugccagguaaggacagaaggaugcugggagaaccuggaggccaggucugcuuugguauguaaaauaugcaacuaagcaacuuguccagggcucugaaaccaaacauuccagccuucuguugauaauaaaagaauaaggggugauguauuuauucauuuaugauuucuuccugcugacauuggggcaucauuauggggguggccaaaaagcuugauuguuggcuacuucugggaggagcuggcugucucccugcuguccaggcugugggaccaucuggugcuaggagugcacacacccaauugaaggauucugugaggcugggcuggagcaccuauagguaacaguuuugguccuguggcagcaggggacuccuaccaaaaucgagguggacaccccuggucuugguuucugcuuggggacacauaaauguuugagggcucuguccaacugaccccacuccucaucuggaaaucauaggagagcuggucauggugggagagcaaagcacugaccacacccuaguuacauggaaguuuacugagcagugagagcaagccacugaccacaccccuagauaguggaaauuugcugaguagugagcacaaggcacugaucacacccuuagccaagaggaaauuuacugaacagugagaguaaggcacugaccacaccccuaggcaaguggaaauuuacugaguagugagcacaaggcacugaccacaccccuaggcaagugaaaauuuacugagcagugagaacaaggcacugaccacaccccuagccaagaggaaauuuacugagaagugagagcagugcagugaucacaccccuaggcaaguggaaacuuacugagcagugagaaaaaggcacugaccacaccccuaggcaaguggaaauuuacugagcagugagcacaaggcacuaaccaaacccauaggcaagugaaaauuuacuuagcagugagagcaaggcacugaucacaccccuaggcaaguggaaacuuacugagcauugagaaaaaggcacugaccacaccccuaggcaaguggaaauuuacugagcagugagagcaaggcacugaccacaccccuagccaagaggaaauuuacugagcagugagaaaaaggcacugaccacaccccuagccaaggggaaauuuacugagcagugagaacaaggcacugaccacaccccuaggcaaguggaaauuuacugagcagugagagcagugcacugaccacaccucuagccaaggggaaauuucugaguagugauagcaaggcauugaccacaccccuaggcaaguggaaauuuccugcuauggugaggagaagcaaaugguuagagcaaguagaggggagaagcagcugaagaggugaauuccagguuuggaguucacuaugguagguugcagaagccugcaggaacaagugauccauccaugcauaccuuaggaagucgucaaaccaacagcaugguuuggcuaggagaggcugagucucuuggauggggucauauauauuccucucugguuucaggcaccagauguacaaagugaggacaaaacuguuccauuucugguuagggggaaggguuuuauuguagauaggagggagagcucagccagagacaucuggaugaguccagagcagagagaaaguaguagauuaaacauggccugcagacugacucaggccuuaagaggcggcugguggagagugggagaggaagagaaauaaggaccagaagagagggggaaaggagaggaagaaccaagaaggcacauuaccaaaaaauggcaggguuaccugggaaugagaagcuaggggaagggaagccagugagguggagaagucuaaggugaggucauguucuucaguauguuaauaggaaccacaguggaccauucauccugaguuucuuuuggaccugauaccaggacuugccuucaucuaaauuguuacuuacucucaaggagggccuccaccagagagcugcagagggcaauuguuaaccuguggugguuugaauugguuuggcccucauagacucauguguuugaaugcuugccucauaagaaaugguauuauuaggagguaugaccuuguuggaggaaguuugucacuguggggacaggcuuugaggucuccuauguucaagcuauguguaguguggcacacagucuccuuuuauugcuugcagaucaagaugcagaacucucagcuucuucuccagcaccaugugugccuccgugccuccaugcuucgcacuaugauaaucauggacagaacuucugaaacuguaagccagucccaauucaauguuuuccuauauuagaggugccuaguccggaucucugugaguuugaguccagccuggucuucaaaucaaguucaagacauuaaaaaauaaaauaaaaugaaagaguugccuccaugguuucucuucacagcaauaaaaggaagcuacagacaccaucuguagaaccuuuaucuucuucagauacagaagacaauuagcaucaguaggaacagccaguuucugggaucuaaaagugggaaaaacaagaaauauuuuggucaacucaagaacagaaugcuggaauuauaggccauggccagugugcccugguugaauuuauuguauuuuuggcaguacuggggauuaaauuagggcuucaugcauguaggguaauacccuaccacugagauuuagcccaacccucaauuuuucauauguuguuaaauacaguuacagcuuucauucuuucauagguauagguucuuuugcuagcauuauuauuauuauuauuauuauuauuauuauuauuauuauauugguuuuucaagacaguguuuuucuuuguagcccuggcuguccuggaacucacucuguagacaaggcugaucucaaacucagaaaucuacuugccucugccucccaagugcugggauuaaaggcaugcgccacuaaugccaggcuagcauuauuuauugaagaggcugcccuuuccccacugaauauuugguguaagggucuacauauuauaaggaauuauuaaaaaugccauuaacaugggaaugagacagcgugggugguacaugaugauucaaccgugacaaggcaugaggcgaugacagagcuucagccuagaucagccuuaauacaugaugguuggguagcucagugguuaaggcguucuugcaggggaccccgguucacuucccagcaugcauaugguggcucauaaccacaacggggaacuccagucccagguaaguugacgcuucuucacacacauggcacuggcauacgugcagcaaacccccauccaugcagagaaacaugaugcugaaacccagacacaaaagccacacacggcgacucuaccuccaugaaccauucagguaggccagaccacugaggcagaucuucuugggagggugggucaaagagagacauauguuugggagacauuguaacagauagaggagcugguauucaguuucauuuugauguccauuuugaaacuguuaaugcuaugguauguacauugucauucaauaagaagacaaccauagcacuggcugcguauguggccuaggauggcuuaguugggcaucagugggaggagaggcccuugggccugaggguguucaaugccacaguguagggaaugccagggaggaaagaugggaguggaugguugggagcacccucauagaggcagggggaggagggaugggauaggggguuucugaaagggagaccugguaagggggaaacauuugaaauguaaauaaagaaaauuuucaaaaaauaaaaaaagagaagaagaggaagaggaggagaaggaggaagaagaagaggaagaaggaggaggaggaggaggaggaggaggagaaagccauaguauuuaaaaauauaucugucuuacuugaaacagaugaacugcacacaguguuagcuguggaguugcauuccuggaggacagggauuccuuggggacaccugcagagagacacccucaguucauccugccagaccccuccugcauucaucagcagcagauguccagcaaggcgugaugccccuccaaaccacaucaggcagcauccugauccaagaucugcaacaguguucuggccacacagcugccaccagacccacuggcaucucagacaguaucguguuauuacuacuuaauacacgucaguuacuacauuuuccuccuccguugauguccauagcuucuuugguggacuugcagugaggaaaaggagaggccugccuggccucucucaagagacucagaguuuagauuccccagagaaguaacaguccuuuguaaguggcuugugcuggugccccuaggacucaacaacuccaucugacugaagcaacacucuuacugaggggugaaaccacaggauuucccaaaccuugcccagcaguuucaucccugaacccccauguuaacccaguacuaccuugcugauaaugaaugaggcauuacccagcccuuccaaagccaaauacacuaagaacccucuggaagaccuaacucaggaaaaccuagugcuuuacccgguguugucuacuuucucucaagggacauuagccauggagaucuccagcaagaaguccuguaccacccagaccacaaagucuucaucacacaaugucaucugccaaaguaugagacagacugucccucucccuggacauuagaggcuauucaggcaacauauaaagcuaccaccuacccaggccacagugguacuuacuugguacaugggcggcaugauuccggaaauuuugggucauaguaguaaagaccuauuuggcacucgcauuuccggucacugguggcagaacagucagccaccauauucuggucugcaauccagggaagaauagggucagguuguggugcaaacgcuuacauaugcacacagaccccacugucaccugaaaggaacacaguguguccugguaaaccuucacauucccaucacagauguacugagugcuaagcagcacuacugggaguauccucauccucgggccucuggggugguacccagaccagagaugauggcuugggagguccauuguuuagcauccugugcaauagcaucacacugcccugaggacuccaacaugggugguccugaucuguaggcacaccucugccccacaaaguucccucuccagaagccaccaucuccaucagacaucucugaagaugcuuuguuuaaucaccuuauuguucuaugaagagcaccuagugaccuuguacccagagcccuagugggcccuugggcucuggguguauaccuuccuuaagugagacuuacucaguggcuuauaaaagaagauggcuuucccauugggguguuccauuuuaaccuugugcuuauaguucaggacaccauaaacacucaagcuauaaaugucaccucucacaauucucugaaucuaggcauuguccuuucucagaauacagcagggagcacaggcagggaggacucucaguccagcucucugcagaugucuuacagcaucagggaucugugaauguggaaaaugguucugucuuuuuuuuuuuuaaucugauguuuuauuucauaucaaugaacauuuuuuuaauuagguauuuuccucguuuacauuuucaaugcuaucccaaaggucccccauacccacccccgcaauccccuacccacccacucccccuuuuuggcccuggcguuccccuguacuggggcauauaaaguuugcaaguccaaugggccucucuuugcagugauggcccacuaggccaucuuuugauacauaugcagcuaaagacaagugcucccggguacugguuaguucauauuguuguuccacuuuagggaugcaguucccuuuagcuccuuggguaauuucucuagcuccuccauugggggccgugugacccauccaauagcugacugugaucauccacuucuguguuugcuaggccccggcauagucucacaauggagagcuauaucuggguccuuucagcaaaaucuugcuaguguaugcaauggugucagcauuuggaagcugauuaugggauggaucccugcauauggcaaucacuagaugguccauccuuucgucacagcuccaaauuuugucucuguaacuccuuccauggguguuuuguucccauuucuaagaaacgguaaaguguccacacuuuggucuucguucuuguugaauuucaugcguuuggcaaguuguaucuuauaucuuggguauccuaaguuucugggcuaauauccacuuaucagugaguacauauugugcgaguuccuuugugauuggguuacuucacucaggaugauacccuccagguccauccauuugccuaggaauuucauaaauucauuuuuuaaauagcugaguaguauuccauuguguaaauguaccacauuuucuguauccauuccucuguugaggggcaucuggguucuuuccagcuucuggcuauuauaaacaaggcugcuaugaacauaguggagcauguguucuucuuaccgguugggacaucuucuggauauaugcccaggagagguauugcuggauccuccgguaguacuauguccaauuuucugaggaaccgccagacugauuuccagagugguuguacaagcuugcaaucccaccaacaauggaggaguguuccucuuucuccacauccucgccagcaucugcugucaccugaguuuuugaucuuagccauucugacuggugugagguggaaucucaggguuguuuugauuugcauuucccugaugauuaaggauguugaacauuuuuucaggugcuucucugccauucgguauuccucaggugagaauucuuuguucaacgcugagccccauuuuuuaaugggguuauuugauuuucuggaguccaccuucuugaguucuuuauauauauuggauauuaguccccuauccgauuugggauagguaaagauccuuucccaaucuguugguggccuuuuugucuuauugacagugucuuuugcuuugcagaagcuuugcaauuuuaugaggucccauuuaucgauucuugaucuuacagcacaagccauugcuguucuauucaggaauuuuuccccugugcccauaucuucgaggcuuuucccuacuuucuccucuauaaguuucagugucucugguuuuauguggaguuccuuaauccacuuagauuugaccuuaguacaaggagauagaaauggaucaauucgcauucuucuacaugauaaccgccaguugugccagcaccauuuguugaaaaugcugucuuuuuuccacuggaugguuuuagcucccuugucaaagaucaagugaccauagguguguggauucaucucugggucuucaauucuguuccauuggucuacuugucugucacuauaccaguaccaugcaguuuuuaucacaauugcucuguaguacaguuuuagguccggcauggugauuccaccagagguucuuuuauccuugagaagaguuuuugcuauccucgguuuuuuguuauuccagaugaaucugccgauugcccuugcuaauucguugaagaauugaguuggaauuuugauggggauugcauugaaucuguagauugcuuuuggcaagauagccauuuuuacaauguugauccugccaauccaugagcauggaagaucuuuccaucuucugagaucuuuaguuucuuucuuuagagacuugaaguucuuaucauacagaucuuucacuuccuuagaaucacgccaagguauuuuauauuauuugugacuauugagaaggguguuguuucccuaauuucuuucucagccuguuuauccuuuguguagagaaaggccauugacuuguuugaguuaauuuuauauccagcuacuucacugaagcuguuuaucaggcuuaggaguucucugguggaauuuuuagggucacuuauauauacuaucauaucaucugcaaaaagugauauuuugacuucuuccuuuccaauuuguauccccuugaucuccuuuuguugucuaauugcucuggcuaggacuucaaguacaauguugaauaguuagggcgagaguggacagccuugucuagucucugauuuuagugggauugcuuccagcuucucaccauuuacuuugauguuggcuauugguuugcuguagauugcuuuuaucauguuuagguaugggccuugaauuccugaucuuuccaagacuuuuaucaugaauggauguuggauuuugucaaaugcuuucucagcaucuaacgagaugaucaugugguuuuugucuuugaguuuguuuauauacuggauuacauugauggauuucuguauauugaaacaucccugcaucccugggaugaaaccuacuuggucaggauggaugauuguuuugauguguucuuggauucaguuagcaagaacuuuauugaggauuuuugcaucgauauucauaagggaaauuggucugaaguucucuaucuuuguugggucuuuuugugguuuagguaucagaguaauuguggcuucauagaaugaguuggguagaguaccuuccguuucuauguuguggaauaguuugugaagaacuggaauuaggucuucuuugaaggucugauagaacucugcacuaaacccgucugguccugggcuuuuuuuuggcugggagacuauuaaugacugcuucuauuucuuuaggggauauaggacuguugagaucauuaaccugaucuugauuuagcuuugguaccugguaucugucuagaaacuuguccauuucguccagguuuuccaguuuuguugaguauagccuuuuguagaaggaucugaugguguuuuggauuucuucaggaucuguuguuaugucuccuuuuucauuucugauuuuguuaauuaggaugcuuucccugugcccucuagugagucuggcuaaggguuuaucuaucuuguugauuuucucaaagaaccagcuccuugauugguucauucuuugaauaguucuucuuguuuccacuugguugauuucaccccugaguuugauuauuuccugccuucuacuccucuugggugaauuugcuuccuuuucuucuagacguuuuagguguguugucaagcugcuaaugugugcucucucuaguuucuuuuuggaggcacucagagcuaugaguuuuccucuuaggaaugcuuucauuguuucccauaaguuugggaauguuguggcuucauuuucauuaaacuccaaaaaauccuuaauuucuuucuuuauuccuuccuugaccaagguaucauugagaagaguguuguucaguuuccacgugaauguuggcuuucuauuauuuauuuuguuauugaagaucagccuuaguccauggugaucugauaggaugcaugggacaauuucaauauuuuuguauauguugaggcuuguguugugaccaauuauguggucaauuuuagagaagguaccaugaggugcugagaagaagguauauccuuuuguuuuaggaugaaauguucuguagauaucuguuaaguccauuuguuucaucacuugucgugcccgcucucgaccagcaagaacgacgcgaccaccaguccuucuaacagcaguuuauucaguccugauucuucuuguuuauaucucccccgaacccugggccucucacuccuuuuauacucucucucauccacgcaccgcagggcaagcccccucgccagucacgaggcuucagcuaaucagggcagcagggguaaaucuccaccaaauuggauucaccuguauccugguacaccugcgcagcacucaagauguuugugucuuauaugaggaagucaggugcaagucauaugacuuagcugcagucccuggcgccuuugggacugccgccacacccgcuccccacaaucacuucuguuaguuucacugugucccuguuuaguuucuguuuccaugaucuguccauuggugaaagugguguguugaagucucccacuauuauugugugaggugcaaugugugcuuugagcuuuacuaaaguuucuuuaaugaauguggcugcccuuguauuuggagcauagauauucagaauugagaguuccucuuggaggauuuuaccuuugaugaguaugaagugccccuccuugucuuuuuugauuauuuuggguuggaagucgauuuuguuagauauuagaauggcuacuccagcuuguuucuucauaccauuugcuuggaaaauuguuuuccagccuuucauucugagguagugucuaucuuuuucucugagaugaguuuccuguaagcagcaaaauguugggucuuguuuguguagccaguuuguuagucuaugucuuuuuauuggggaguugaguccauugauauuaagagauauuaaggaaaaguaauuguugcuuccuguuauuuuuguuguuaaaguuggcauucuguucuuguggcugucuucuuuuaguuuuguugagggauuaucuucuuguuuuuuucuagggugugguucccguccuuguauuggcuuuuuuuucuguuauuauccuuugaagggcuggauucguggagagauaaugggugaauuuaguuuugucguggaauacuuugguuucuccaucuaugguaauugagaguuuggcuggguauaguagccugggcuggaauuuguguucucuuagugucuguauaacaucugcccaggcucuucuggcuuucauagucucuggugaaaaaucugguguaauucugauaggcuugccuuuauauguuacuugaccuuuuucccuuacugcuuuuaguauucuaucuuuauuuagugcauuuguuguucugauuauuaugugucgggaggaauuucuuuucugguccagucuauuuggauuucuauaggcuucuuguauguucaugggcaucucuuucuuuagauuugggaaguuuucuucaauaauuuuguugaagauguuugcuggcccuuugaguugaaaaucuucauucucauccacuccuauuauccguagguuuggucuucucauuguguccuggauuuccuggauguucugaguuaggaucuuuuugcauuuuccauuuucuuugauuguugugucaauguucucuauggaaucuucugcaccugagauucucucuuccaucucuuguauucuguugcugaugcuggcaucuaugguuccagauuucuuuccuaggguuuccaucuccagcguugccucacuuuggguuuucuuuauugugucuacuucccuuuuuaggucuaguaugguuuuguucauuuccaucaccuguuuggauguguuuuccuguuuuucuauaaggacuucuaccuguuugguuguguuuuccuguuuuucuuuaaggacuuguaacucuuuagcaguguucuccuguauuucuuuaagugaguuauuaaauuccuucuuuauguccucuaccaucaucaugagauaugcuuuuaaauccaggucuaccuuuucagguguguuagggugcucuggacugggcgaagugggcguucuggguucugaugauggugaguggucuugguuucuguuaguaggauucuuacguuuaccuuuugccaucuggcaaucucuggaguuaguuguuauaguuaucuuuguuuagagauuguuccucuggugauuuuguuacccucuaucagcagacgugggagacuagcucucuccucugaguuucaguggucagagcagucucugcaggcaagcucuccucuuucagggaaggugcacaguuaucugguguuuggaccuccuccuggcugaagaugaaggcccaaaacaggaucugucccagaagcuguguugcuuuggccaggaagguggcugguugucuggugccgaagaugucgccgccucagaagcucucuggcucucgccugucccagaaacugcuggccucuguauuccauacccucacccgugcagccugcccuccacggaaucccgguaccaagguggcucccgccugagccugaggcagaaaccucucagggccgggcggaccccugugcucucaccaggaagguggccgguugucuggagcccuuguuuuuuuguuuguuuguuuguuuguuuguuuuuguuuuuuguuguuuuuuuuuuuuuuuugcgacaauaugucucuguguagucaugauguccuagaacucacaacauagaucaggcuguguagagagaauaucuuauguuuguauggauguggcaucugucaauaagucugauggccuauggcuuaggcaagauauaggaggugggacaacugagagaaagaaagaauucugggauagagccaggcaggagauugguccaggaagaugugaggagacacaugguaccugagcacaggcaaccagccauguggcagauuguagacuaagacaaauggguuauucaaaguuauaucuagucagagaagagccuagcuauauggccaagguauuuauaaauauauucugaguacaagucuuauuucagggugcauggagcugagaggaagaaccagaaccuaauuucuacaauuaggcugcacacuaaaguguccuuucuauaucugccucccgugcucugggaccagagauaugugcugcuauacucagccuguuuccaucucuauguuuaguagaugcaaaugacagggcugaagcaugagauauuguaguauuugccacuuaguuuaacaugauucuguggcauaggaguguguacauaggcacacaugcaugcacacacaaaacagaaucuucgcccccacuccccucuacgucagagaacaaacccaggccuucuucugcauacuaggcaggcacucugugagcugcuuccaguccuccaacaaaugcuuaaaguuuguauguuuauuguguauugauugagucuuacuauguagcuuuggcugucuuuaaacucacuauguuggucaggcuguccuugaacucacaaagaucuaucuucagagugcuuggauuauaugcauuugccaccaugcucugccugcuuaaaguuugugaaaaagguuuuauuauguuucuauauccugucaagacuucugcagguguggcccucgucucucugcugcuuccccagaucugugugcccucugaccuacucuuuuagcucuucucugugugucugggaagcacacaugauugcuuauccacagagguaugaucuuucuagguaccagcauguguuuuacuagguucugcauucaauugacaaguagaagaaaaauuaucuucaaaaaaaggcagaaggcuaugauugugcuuuuucugacacugauuuuacggaguccuuuuuaacucauaaugaauaauuuuugccuugguuuuauuuugagacagggucucacuguguagccuguggaacggcccuggaacucacuguauaaacaagauggccucgcagggcaguggugaugcaugucuuuaaucccagcacucaggaggcagaggcaggccaauuucugaguucgagaccagcguaucuacaaagugaguuccaggacagccagggcuacacagagaaacccugucucgagaaacaaaaaccaaaaaccaaccaaccaaacaacaaaacccaggguggccuccaagucagagaccagcugcuucugccuucugugugcugggauuaaacauuguacaaccaugcccaucggcaggaaacaaguuuuaugccaguggggauucuguggcugcauucuggcauccauuagucaugacuacuccauccagguacuucugacucuaaugccagucuucacagcuagucugccucugcuaagucacauacucaccuuuaucacagguggagcaaaguucacaaucaugcaggccauuaucuuucccugugaauguuccugggugacacuucucacauuguccuugaguaugggggauuuugcagggcgccuugacaaauguaccuggggauaagggcagaugggaucagucuugcucaggcacacagcaauaaggggcuaucuugcucuagguaggcuuaacaucuuuacuacaaguucaaaauaaucucugggcugucacaaagugcuugaggaucuaugagggcugcugguucccugaucuacacucaguccuguagacaucuuacccucaggagacuaggaaccaagguagccuagggugaguagaaugagauccugacucccuacugggcuuccauaggcccauguaugucaccagggagugacacuauuugaaaggcuuaagggguguggccuuguuggaggaaguauuucacuggagcuuggcuuugaaguuucaaggguccaagucaggcucaguguuuguuuuuuucuucugcugccuuugcauguggacagagaacucucagcuacuucuccagcaccauuuuuaucuauuucaacccuaccugcagucgggccuccugccauugugauaauggacuaaaccuuuaaaacuguaauccaguaaaaugcauuccuauauaaaaguuguggucacggugucuuuucacagccagagaacacuuuaaacaaucucuagaaaagagacucuggcucccuguaaguugugcagagugcuuuuggcauacagcuuuaaaaaguugucacccaugcuaggcuaauauuacaauauguaguugcauuagucaccuaugggugugaaagcgaccccaauaaacucaaugguucaccaaaccacacuuggguaaaucgcuucuuuggucuguucucagugacuauuaucacuuccuguuaucuggagugaacaguugguguuuaugucuccccagaaauaauuacagaaccaggguuccugauacagagcacaugugcuguuaacugggagcagaagagcaaggauugacauugccaccaagguagagugugaccauagcaagcuacuuaagccacuuucuccauuggaagugguagcagugggggcugaggguucccuggcacccaagacaaguacagguagaugaaauuaacccucccagcucgcuuuuuugacccuuccucuuagcugggugccuuuggauaugggcauagaacucaugccuugaaggauggagaguugggugacccuauauuagugaggccuugcaaugaauacucacaccaacccucuugaacagacagagggccuccuuuaggggugacagucuguguaccuugguuaggaagcaucuccuagaguuugaaagaguaggcaauggcugaguugagcucccugauccacacccuccucaucuuguauagccacuggugugccccaaagcucacccaugucuaugcuguggcacugggucucauugaagaacucaccugagggacaggucuugcaacagacaucauuagacugguauucaccaucgggacaguugaaggaguaugauucaggcauagcaaauauuaccugugaguggaaaaggacaaggggcagcucauacuuaugguaacugcagaggaugguuuggauaaugguggaaaaggaaguaccaaggcagggccuccuugugcagagcccagcagggacuaucugaugcuacgcuguggcugaugcuaugcuguagaacucugaagccugcaguugcccauggaagguuguacaauacaccacugccaagucuaguggcucuuggcuuuuugcacagcaguaucaugcccacuccacuccaucccuaguucacuucuagcagcagcagcaaauuuucuagcacaacuugugaccuauugggauccuauaaucugaaccucaagcuuugauggcugcucccuaugcuggggcugcagauagagacaccaguuggaacaacuugcaaaaggacaaaggagugagagcucugccuuguuuuuuguuuuuucuuuccuuccuuccuucuuucuugucuucuuucuuucuuucuuccuuccuuccuuccuuccuuccuuccuuccuuccuuucuuucuuuucuuuuuuuuuuugaagaauuguuuuuuuuuuauguaugugaguacacuguagcuguccucagacacaccagaagagggcaucgaugguugugagccaccaugugguugcugggaauugaacucaggaccucaggaagagcagucaaugcucugaaccucugagccaucucuccagccccuguuuuuucuuuuaauuuaccuccuucacauacuauuucucuaaguacaccaaagcuuuagauguguuucuugggcuggagagauagcagguaagagcauaugucguccaggcagagcgguacauaucuuuauccaagcacuccggaggcaaagaaaggugaaucuccugaguuccaggauagucagagcuugucuuaaaacaacaagaccccccccccaaaaaaaaacccaaacauauucuguucuugcagaaggccagaguuugguucccagcaaccaugcaagaggcucacagucaccuguaacuccaguucaugagaaucugauguccucucuggccucaggaauugcagacaagugacauacuuaacaacccuuuaggaaacacuuaaacaaauaaacaaaaucaaauacuaaaauaaaugaauaaaucaacaaauaaguaaaaucuaauuuuguuuggucuuucauuacucaaagccucaaguaauuguaaguaaauaacugguuuuacuuuauuuuauuguaguacugaggauuaaacccagggcucacacuaggcacuaauuaauugcuaaugugcuauauuucuaguucugcaacagaugacuuuaaagauuuauauuuguguuuaugagugugugccugcuugaaugcauauauaccaugugugugcagugauugaggaggccagaagaaggcagcagauuccugggacuagaauuacaaacaugugugggugcuuggaacugagccuuguuacucuacaagaguagccauuacuuaaugcaccccagauacugauacaugcuacaugaaacagaggcaaauaacaaagacaacaaaacaaaaaaacaaaaaacaaaccauaaaaaaccccaaaguuugauguagugaucauugaucauuuauaggggauugaaagaacauguguggagccaugauaucacacaagcuaacagagucuauggauuaauaggauauucacuauuuaccauccccaugucucacuuuucucaucuguuaaauggagauauuaauauacuuacuacucuagucacuugagcucuuuacaaaaaaaaugagcacugaggcucacuucuuuauauuugcauuuuuaugguacacacucuggaaaaaaauucuccacagcaucaacccuuagggcccaucuauacauuugugggagccaucaucauucauccuuaccacuguguucugaucucauagcuagccaguguuguccagccuucaggagaaauuccuuggccacaggauuuuccugguucauagauaggaucucucucucucucucucucucucucucucucucucuguccguguguuuguguguguguguauguauguauguaucugucuucuguccgucugucugucugugucugucuaucuaucuauaucuauguaucuauguaucuacguaucuauguaucuauauaucuauguaucuauguaucuaucuaucuaucuaucuaucuaucuaucuaucucuaucuuucugguauucucugcccauuuauuuugucaggaauucugcccuuaacucgccaggcaggagucuucuuuuuaggguuccuagguucaauaccuucaucuugauucaucgucaccauuauuauauguugaagcugacacuucaucacugcccugaaggcaauacuauuuuaccccuuggagauggccugcuucaccuguacuuacacuuaggaaggacaugaccacagguuagacaguggauuuaguaggauaucuucacagcccaugucuuuaauuccagcaggcagaccucugaguucaaggccagccuggucuacagagcaaauuccaggacagucagagcuacacagagaaauccugucucaaaagaccaaaaaucuacacacauacccuauuuuuuaaaauuucaauauucuuugaggauagucuuuuuaaaaaauauucuugaaagagauguuaucuucagucuuuuauuuuuauuuuugacuuuuacaggacagugucucauacacagucuggcuguucuagaacucacuauaaagaucagacuaaacccaaauucacaaacaugucuaccucgucucucaauugcuagaauuaagggcgugcacuaccccgcccagcucacccucagucuuucuuuggaguaccuucuuuuuguggcauuauuugagacgaucaccauuuuuucuuuacaacaaccuuaaaacaacaacaaaaacaaaaacagccuaauauugucuagauuguuucuggggauuucuggacgacaaaaugcaccacuuuucaggcggugccugggcaggcauggagccccagagcccuaauagggaugggaagagauuucagggucaagggccaucccaugugaaaccugccugugaaauauguucgaagucccucaaagugcugggaacuuugaagucaccucugaguugcauauccucuggccccuugcccaggagauucccagggaagcuggaugcccucuagguccauuucugugaaagcugcucaccagcagcuagcaaagaauuacuauuaaccagcuccuagaugguuuaaagaaaugcugauuacauguaaguggucucugacugcucagauacuaucuuagaacaaucuaaggguuauuuuguuguuguuguuguuguuauaacuaaagaucugaauguguuagaaaauggauauccuuacagguuauaaaacauaaaccuuuuucugccuauuuuuggguuugaagacucuuaugagagaaaauugacauaaaauuaaguuggcuguaacuaaaaugucauuuacaggauugucuagguuuuuuguuugguuguuugguugguuuugguuuuuuuuuuuauuuguuugguuuuuuuggguuuuuuuuuuccguuaguuuguuuugguuuucagccuuucuguguguaguucuggcuguucugagacuccuuauguagaucaggcugcccacuaacuuagguuuaacugcaguuuaagauuaaagagacaagaagcgaucucgggacgaacuuagcagagacccgaaaggcccaggaaaggcauagccaggccuuccacacagauccuuuuguaguaguuaguacuacaccccaagacgagccgggccggacccacccaaggcgcacagucgcgcgggccacugcaguccgcaauggcacuuucccgagucaccuucggaaggaccgcuuucagaugagaaagcgaggagaggcguguccgucuuguccgggagcucagggaccaaccggacacacuuucucuggcuacccgcuuggccauuccccugccucugcuucaccuccacaauuccccaacucuggaccacuuaacucuggacgaaguucugaggaguugguuggcggugccaaggcugacccuggcggaagagccaauucaccgcccgcaguagcuuuccucugcagcccggggauccggugcccagcgcgaaucucagcuccgcagggccauaucuacucaccggcaagaacagauucagcagcagcagcaagaggaaccagugacucagacuggagacguggcugaagguaaccauggcugugagcuagcauggugucacucagcuggaggagcucuauuucaagcugguggccacgccucuugucagcggauugguuucuguaugguugccuaaucucgugggcggguccagcgccaccacucuugccuucccaccaccaucagugcucaguaauaucuaguuuucuauaaauacaguaauuuuaaaugccugugacguuauuaacagaaucauauuuguuauaagcagcaagcuaaagucgaauucucugccuucguuuguuuuccauuacaguauacugcucuuuauuauaaguuaauuaaaaauuuuccuggaccugaguggagggagaggcaugaacuagagcuggaaucguuauaaaagucagacugcagcagacuguaaaccuucucaaaagcaacaaacaaaaagaggaagauaagcuacaacacacacugucuuagcucaacauggggaaguuugaaguaacucuaucccuguagcuuuccugugaguguucacuggucaauggucuggagcagcagcugaaggcuucacugucagagucugaggggcugugugggacucgcugacucugaggaccucaaaauauccaggacucguaggcacucuuccagugcugggguuggggggggugugucgggggaggagggcuguaugaacaucccuggacugugagucccucaccucuucuuccuuucacuguguuuagcuccacugugugugccaauccaagcucaugggacacaggacauuuaagccaagucuacuagucuaacacaggaaguagaaugcuuauuucucuagggaacuuggguugguucaucuguuccacccgcccccuccagguauucgaaaaaguggcccacuaccagccccauccaucucccuuccaaaugccacuuccucuuuaaaaugagggaggacucagagaccuggauuucaauggcugccccaaagaagaggagccuggcuccaggcaccugguacucuuuaauucaucucuugccucucucccuagggccagggaguggagccugugcccaucugcccucaccuaggcuggggagugggaggggccaauuccuuggccagccugaugcucuucuauuucuugucuucccucaggcuggugucugcucaggaguaaaccaaaucaaaacacaaacaaguguuuagaaaguuugguuaguucaacacgcugaacugucccucacccuugggaagcagagggaaaguagaggaagggaagaggagaggacugugcacuuguggaugcuguugucccaccagucucugaguagcucgggagcagggggaggcuaguggcuuuccuuuucugcauacaguuuacagaucugccuugucccacacuguagguggaggggaggugaaaggaagaggccugucuacccugggcuagauauuugugcuccagguccuucucugcccucugcccuuugcuccuuuaaaacauuuauuuuaaaaugugugugugugcaugugugugugugugugugugugugugugugcgcgcgcgugcguguccaugcgcacaggugccuccagaggcucgaggugacauaucuccaauagcuggagauacacauggcuguaaucugccugauaugagucuggagaucaaacugguguucucugcaagaacagcauauccucuuauuggcugugucaucucuccagccaucucuacccuugcucuuuaaggugggauagugggaugucauacuguuccaggaagccccuaaugguucaaagcaguugggugacauucucaugagcccagugacccuugauggucuuccugcagagaugaagggugcccacaauggaagaguuggacucauucaauaccaggagaaucuucucaccccuagaauagauguauuaucuauuguaauauguauauaucauacccuuucuugggauacuuucagguugcuucuggguagcuugcugcuugggaauaugugaggauucugggguuuuuucccucucugcucuuucugcagugcaaugaaaaaggagagauauagccacguccuuuagguuagugugcaagaaaguaacagaggucugcaaaggaccuuggaacuguuaaaaagagaauucaugaggacauuccaaauguccagauguaugaugguguugugagggacaggaccuaguucugcaugggggccagggugcaggagagaaggugaggaguucagagcuuccugucuauacuggaaacagagaugucugagguagaaaauggcuacuugcagacauccaugcuccagggugacuggcugcuucauggaggcuccaggagcaggguccuccagagaacuccugggguagguagaugcacagccacuuggcucuucuuuacuucacccucuccuggcaucugagguagggaggcauucuugggguccccucucauggguguuguuuggccaccuucauucccucuggucucuguuaucuucuauggguuguuggggaggggcgcuacagcuucccuuugagguggugugggguguguugucagaugccaagggauauucuggaugccucagagcuaugucagaauacagagcauuaagcauuucagcaaggcuguguuggcuauaggaggcugacaaguaagcaagcugccuggaaugcccuggcaggccacaucccucccaugccacaguugcucacuggcugacugaugggacuccaguucccaauggcuccagguggguuaucuucucacucaacacugugaaccugcacccaccuucugaaccccucacuuggcaccuccagcuuaagacagccauauuacaccgcguuuccaucuccccagaaguuccucuuguucccaaggauucccccaaaagagaaauacauguauuuccauuuauuucaaggcauggagcagacauacccccaggauuggggaaggacagagacaaauggauacaaaacuuggaaaaugaaaggaucagauacaauggagauggcaccaacuaaguauuaaggcuccaaaugugaguacgcauaggugcucacauacauacacacgcacacacacacacacgcacacgaagagcgucauccacauaggaucaggggcuggaugcagaggcugcucacugcacauagcugccucagauauugcaauucuauguagucagaaugucaacagaaugggaagacuguauuggucagggagaguggcaagcuugggccucccuggccuuuggggucagccucugggcacuucucuugcuuacaaacucacacugcaguuggccagggcacuccuguggcacaggugggcuccucuggcuguagggcagauguaggugaaguaacuaccugaacaggcuucuguggaaacagcuuaacaacaggauaaaagucccaguguccucaccagaguagcuacagccuguccaugcuugugugagcacaaggugggcagauuguccagaagucaacauuaccacccaaagagcuccggggaauccuggagucuuccuuccugcugcuccuggcaaccucacucucuccugugcugugguaaguggcuguccaaagccugcacaggcccuccugacccccagaucugaugccguauggcaagugggggcuggcuugggagugcaacuugagauuaccaggggcacacugcagggcagaaacugcauuuggcuuuagcguuaaggccgguacuagguggagggcuccaaagaagaggccagugcucccuggaggguccuacagcuggagucacagcacccucauagccccaggccccaccugucauccucuugugcgaggacccuucugucccacuggccaugccugugggccccacugccucugcaggccgguguaaagugcugggugccuaggagggaguucugcaggcgucaccuugcugauuccaagggcucuuauuugaggauauaguuaaugaauagcugacacgucaggaagaugcagagcaggaaccaggagcggggauucugcaggaggcugggggcuggcgccugcccagcacgcacuguggagcuuaacauggucgaaaggugccugcaaugaaagggguagaggcugugucaacaccaguaugaccacccuccccagugagaggcuagucugggacaagauggcauaucugucagcuggggacauggcuacaagugugggugggagcuccuuagggagaggagucccaggccugcacuuccugugugucaacugugggacaggaggaucugggcuuggggacuaggccucuaguauccuuccugccagcccuggggugacgaugaacagugcccacuuccucaaaccuguguugacguccugaccacuggacuauuuggagauaagaucucugaagagguggccacauuaaaaggcucacuagggugggcccuuaaucuagucugggauccuaagacgaggggaucaagacagagacagacagaggaugaucaugucugaaagccaaggauggagucacugagaagagccaggccuaaaacuuccaucuuaggcuugcagcuuccagaguaugauacacucagugccuugcuggcauccuacgcugagugucaaccagggacauuggaacaagcccaccaaaccuggauucugaugucuguucucucuguuuccugggugcagaaguccuuuggggggggaagcuaccagguuucccuuucuuugcccccacagcuugggaaaggaguagcuugaaagacaagugacuguauuguugagacauugacuagaggagucaaccuggauugacuuaaggauuccuagaaaccugggcuagcaccuccagggagcuagcuccauucucagcaggcacagcccacuucacaccuccuuagcccugggucagccuucugggucugggacuccccacuguggcauuagaagaacuccagagacccuagaauccccacucucauuagcugauauguauauguaugugacccgcagcaggaaucaaauagggccagcaaguguugagacucaaggcuucacugauggccgacuacaggcaaagcacaggacaaguacagcccacagaaagaugucauguuccaaucaucucccacacccucugccucuguuagucaauuuuccacacacucucccaugaguuaaugaggcuauuuuuagaccucuagaagacacugugacgugggaaagcaggaaaaaccugcacuuggcauggguggcuguaagguuggcagaaucaugaccuuuccugggaccaggguaccauuucuggccucaggaacugacuccagccuuucuggcccuagggucuuguuauucaaccgccucccuucaggccacugcacagaccaaagggucucuagccaacagacuucccaacauccaaaccuagagcaguugacuucagccaacgcacagucagguaucuaaaccucugccugccuggagccuacgugacccagaagguacacaaccacauuccacuccugucuccacccuccugggugucccagcucugacucacuuccuuccagcuuuaugucucuaccagucaguccucuaggcaagggcaaucaggaggugucuggaggaugggcccaaagcuugguccccacauccucuucauucggcucccgauccucuugucugcuaugaacccauuuuacagagaagcaagugguuugguauaugacgcccucacaugauaccaugugcugauaggaaauccacugaggucacguagcgugauuuccagacacuuugcuuugaggauccucuaugcagggugcuggugagcuacagggagccugaggugucugggagggcugcuacaugcuuccacacaccugggaggcuucccuggcucugaggagcucuuuggcccuguacauucuucuaagcuccuugccugugcucaauagcgccuucauggggggcuguggugcccuaugcuggcagcucccuccaccucccguguucuuaccuaugcagcucuugcugagcuuccugaauggacagcacggccucuuguagcaucuuuagccgguguaccucucgccugcaccgaggacaugggcucucaccaccugaauuuccaggguggagaaagcagggagaaacagaccaggguaagcuaggauguccuagcugacccaacuccugauuuaccacucucaggagccaggcacagacacaagagagacagggaaagguuaggaggggaugcaggcucagcuagcuuguaagccuuagagaugagucaccaagacaugauccacugcagaugugggaacaauguugggagacaagauugcucaguaagagcaaaggagccaagagucucaccagggcagaggcagggucagagucaggggcuggacaauggacagaacccaaccaaccucucauguuauccuugcagcucagggagauccuagccuuggaccacuuccuccuagucccauuuuuuuagaguagguuucaaguaugugaggcuggucuugaacuuaauguagcagaagaugaccuuaacucuucaucucucaugugaccucuggaguacugggugauagguguguaccaucaugcuguguuuaugcugugcuaggacugaccccaggccuucauaugugcuagacaggcauucuaccacugagcaacauaccucgcagucucuucucuuccccaaccucuggcuacagcccucaucaggcucugagaaggcagaucucuuagggagacagcaggguaagaugcgcaaagauguacuaugagaauuccugccccugugugcucaucucugaaaggcacuuccuggcccuucuuauccugcagaggggcugcagguagggaccggcucucuccuucuguucucccugcuagucaagguccaagguguucacuagucagggccaggacuaaccagcauguauaaaacucuaggagccacuuaccaggaacaaaguccucaucagagaggucugggcaggacucagguguggagccgcugcucucagugaccuggcuauggccagagggcuggucacuggcuuugcggagccgccgaucagagcuaggccucuguaaagagaugaaguuacuauacuuagugucuuuucccauggacccuuuggggacaugguguuccguucaugcacuagauuagggcagugugcggaggacagaacugaggcuuuguaguucgacacaggagguuugaaccucccccugcccugaacugaagccauuccaucucaguggccucaguuuccuaucaggaacauaaaaccguugaccuccucuggaggcaugaggaccagccagcccugccaccaggcuggcacauggucagcaugcuauucacaccuggaacccagagccuguggcuaggccaaccuggcggagcaauucauagucccaccuugugugcgggcaccacccucccucuauuucccugcacucccccaacccuuugacaucccuccugcuuuccccaugcagggauggacguuggcuuuuccuccucuuuccugggcuagccugagccuggguuuauuuagcuauagaaugggacaaagugacuucaggaggugacaggcuggcacagaaucuugaccugugaggcccagggugcccaugaaccaaguauuuugcaucucaggucccccacuggaaagaaaaaaaggagcaaugaggaaggagccuggugacagugaaggcccauugccagguaggguugagcuaucacagagaugggcacugagggacaaaggccagguggcaggguggaggguaugagggccccaggggugcccacacacacaguugagaucaauucugggcuggagccuuggugagggguacugaccuugugccuggagucaggacuccccagaaagguugucuggccagacauagucucccucuguagaguaugaagaaucccaucuugcucauauugggcaauguccuucagcgggucccaggggcugaggcuagaggauccagauggugaccgucaguagaggugaugacccuuaugggagaggguucuguccuagccuagacccagcuucucauggugucccaagggauaaccaccauucagggguuacaaggaaggauuagggggucuaucugaccaucucuccuuaugccucgucccuaagguacuacugaaggcagggagagaagaugaaagauucuacagucucuccaaaccaaggcaggcacaguggacucagucugcaagcucccgccccaccacacaggccccaggccaccugcuacucacuccucauaucgguagcgccauuccugagugagaggguccaguaagaacaacuguggcuuccauggagugaggcucugcuggugcucacgggcacgcugccgcugcgccucuuccagcacagacuucuccuguguggcuuugugcuggucacccucacggauggcccuggugacaugcugccacagccuguaggucaaaggaccaaugagcucagaguagggcggcuccacuugugggcagcccagaaucaauucccucuaguuuggaaggggggcuuagaguguucccugcuugguugccuuccgugacaaggggcuggcuaucuugcaggaagccugugucucccagguuuuuauucuacaguaugagcuguauuuuuuccuaagcagggcuccugccugccaccugcagggaucuacuuguuagcaaugauggggcccucucccaccagcuguccccagcagggcaggugaucuggcaugagggaucuauucuggggcugcccuugccaaugacacccuagaaugugcucccagcaucgugacccugacaacccuccaccuggccaucaucgucuguggucaccagggcuccuggguacagggccucaccucucagacuccaguucacucugcucuuccaacagcacugugugccgcuucagccgcugccugcggaccuccucacucggaguccagaagagcucggugccuccacugcucucuuccuugauaaauacaucucuguccuggcccagauggcauagcagcaucagagcugcuggcccaguuggugaccacccuagggcccaacuaggcucucccuaagggaugacgccuuacccaguguccagugaggcgugccaggacuuccucuccugacaugaucuucccggaaaucugguugauguuggcgcugcuuccaaagaaaggcuacaagagcagauggaaaccaaugaauagggaggagggggcucuacccagaggcacauccucagagguacagaguggucauucucaugacuguggcuuagacgaggcucacuacuagaaaaaggugcccucacucuacugucuugaccuggacccaaaccuauagagucugccaccauuccauuaggacaaggggacuuagacuugcaggcugugcuguguagccugcgggcaacaccguucucucucugggcccugucuguccuauggggaugcaaagcaaucuaccccaguuguucucuuuuggagcacuuugccugacacagaaggagggggaaccccacucgagcuccaugcauucccucccacaagcuguacacauuaccuugagcuugaaguccaguucagcuuggagguuguucuucucacacucgauguucacuuugccucccagcuccauggucauggugccguagaggaucccugaaauacaacugguguugggguucaauccugaaagccugcaucacagggcaggcaaggaaaagugugugaaggguuuguuaagauggagccaggacccugcuuguuccucaguacugugucccaggaaggggcuucugcucuggccuggagaugcuacacacuucauugggucaguuccuucaggagcccugaucccacggucugaccaaccacaucugcaccagcccuagaacuagagaauagaugugucuacucu

SEQ ID NO: 34 - RNA, 73202 nt, Mus musculus
uuuaguagaugcaaaugacagggcugaagcaugagauauuguaguauuugccacuuaguuuaacaugauucuguggcauaggaguguguacauaggcacacaugcaugcacacacaaaacagaaucuucgcccccacuccccucuacgucagagaacaaacccaggccuucuucugcauacuaggcaggcacucugugagcugcuuccaguccuccaacaaaugcuuaaaguuuguauguuuauuguguauugauugagucuuacuauguagcuuuggcugucuuuaaacucacuauguuggucaggcuguccuugaacucacaaagaucuaucuucagagugcuuggauuauaugcauuugccaccaugcucugccugcuuaaaguuugugaaaaagguuuuauuauguuucuauauccugucaagacuucugcagguguggcccucgucucucugcugcuuccccagaucugugugcccucugaccuacucuuuuagcucuucucugugugucugggaagcacacaugauugcuuauccacagagguaugaucuuucuagguaccagcauguguuuuacuagguucugcauucaauugacaaguagaagaaaaauuaucuucaaaaaaaggcagaaggcuaugauugugcuuuuucugacacugauuuuacggaguccuuuuuaacucauaaugaauaauuuuugccuugguuuuauuuugagacagggucucacuguguagccuguggaacggcccuggaacucacuguauaaacaagauggccucgcagggcaguggugaugcaugucuuuaaucccagcacucaggaggcagaggcaggccaauuucugaguucgagaccagcguaucuacaaagugaguuccaggacagccagggcuacacagagaaacccugucucgagaaacaaaaaccaaaaaccaaccaaccaaacaacaaaacccaggguggccuccaagucagagaccagcugcuucugccuucugugugcugggauuaaacauuguacaaccaugcccaucggcaggaaacaaguuuuaugccaguggggauucuguggcugcauucuggcauccauuagucaugacuacuccauccagguacuucugacucuaaugccagucuucacagcuagucugccucugcuaagucacauacucaccuuuaucacagguggagcaaaguucacaaucaugcaggccauuaucuuucccugugaauguuccugggugacacuucucacauuguccuugaguaugggggauuuugcagggcgccuugacaaauguaccuggggauaagggcagaugggaucagucuugcucaggcacacagcaauaaggggcuaucuugcucuagguaggcuuaacaucuuuacuacaaguucaaaauaaucucugggcugucacaaagugcuugaggaucuaugagggcugcugguucccugaucuacacucaguccuguagacaucuuacccucaggagacuaggaaccaagguagccuagggugaguagaaugagauccugacucccuacugggcuuccauaggcccauguaugucaccagggagugacacuauuugaaaggcuuaagggguguggccuuguuggaggaaguauuucacuggagcuuggcuuugaaguuucaaggguccaagucaggcucaguguuuguuuuuuucuucugcugccuuugcauguggacagagaacucucagcuacuucuccagcaccauuuuuaucuauuucaacccuaccugcagucgggccuccugccauugugauaauggacuaaaccuuuaaaacuguaauccaguaaaaugcauuccuauauaaaaguuguggucacggugucuuuucacagccagagaacacuuuaaacaaucucuagaaaagagacucuggcucccuguaaguugugcagagugcuuuuggcauacagcuuuaaaaaguugucacccaugcuaggcuaauauuacaauauguaguugcauuagucaccuaugggugugaaagcgaccccaauaaacucaaugguucaccaaaccacacuuggguaaaucgcuucuuuggucuguucucagugacuauuaucacuuccuguuaucuggagugaacaguugguguuuaugucuccccagaaauaauuacagaaccaggguuccugauacagagcacaugugcuguuaacugggagcagaagagcaaggauugacauugccaccaagguagagugugaccauagcaagcuacuuaagccacuuucuccauuggaagugguagcagugggggcugaggguucccuggcacccaagacaaguacagguagaugaaauuaacccucccagcucgcuuuuuugacccuuccucuuagcugggugccuuuggauaugggcauagaacucaugccuugaaggauggagaguugggugacccuauauuagugaggccuugcaaugaauacucacaccaacccucuugaacagacagagggccuccuuuaggggugacagucuguguaccuugguuaggaagcaucuccuagaguuugaaagaguaggcaauggcugaguugagcucccugauccacacccuccucaucuuguauagccacuggugugccccaaagcucacccaugucuaugcuguggcacugggucucauugaagaacucaccugagggacaggucuugcaacagacaucauuagacugguauucaccaucgggacaguugaaggaguaugauucaggcauagcaaauauuaccugugaguggaaaaggacaaggggcagcucauacuuaugguaacugcagaggaugguuuggauaaugguggaaaaggaaguaccaaggcagggccuccuugugcagagcccagcagggacuaucugaugcuacgcuguggcugaugcuaugcuguagaacucugaagccugcaguugcccauggaagguuguacaauacaccacugccaagucuaguggcucuuggcuuuuugcacagcaguaucaugcccacuccacuccaucccuaguucacuucuagcagcagcagcaaauuuucuagcacaacuugugaccuauugggauccuauaaucugaaccucaagcuuugauggcugcucccuaugcuggggcugcagauagagacaccaguuggaacaacuugcaaaaggacaaaggagugagagcucugccuuguuuuuuguuuuuucuuuccuuccuuccuucuuucuugucuucuuucuuucuuucuuccuuccuuccuuccuuccuuccuuccuuccuuccuuucuuucuuuucuuuuuuuuuuugaagaauuguuuuuuuuuuauguaugugaguacacuguagcuguccucagacacaccagaagagggcaucgaugguugugagccaccaugugguugcugggaauugaacucaggaccucaggaagagcagucaaugcucugaaccucugagccaucucuccagccccuguuuuuucuuuuaauuuaccuccuucacauacuauuucucuaaguacaccaaagcuuuagauguguuucuugggcuggagagauagcagguaagagcauaugucguccaggcagagcgguacauaucuuuauccaagcacuccggaggcaaagaaaggugaaucuccugaguuccaggauagucagagcuugucuuaaaacaacaagaccccccccccaaaaaaaaacccaaacauauucuguucuugcagaaggccagaguuugguucccagcaaccaugcaagaggcucacagucaccuguaacuccaguucaugagaaucugauguccucucuggccucaggaauugcagacaagugacauacuuaacaacccuuuaggaaacacuuaaacaaauaaacaaaaucaaauacuaaaauaaaugaauaaaucaacaaauaaguaaaaucuaauuuuguuuggucuuucauuacucaaagccucaaguaauuguaaguaaauaacugguuuuacuuuauuuuauuguaguacugaggauuaaacccagggcucacacuaggcacuaauuaauugcuaaugugcuauauuucuaguucugcaacagaugacuuuaaagauuuauauuuguguuuaugagugugugccugcuugaaugcauauauaccaugugugugcagugauugaggaggccagaagaaggcagcagauuccugggacuagaauuacaaacaugugugggugcuuggaacugagccuuguuacucuacaagaguagccauuacuuaaugcaccccagauacugauacaugcuacaugaaacagaggcaaauaacaaagacaacaaaacaaaaaaacaaaaaacaaaccauaaaaaaccccaaaguuugauguagugaucauugaucauuuauaggggauugaaagaacauguguggagccaugauaucacacaagcuaacagagucuauggauuaauaggauauucacuauuuaccauccccaugucucacuuuucucaucuguuaaauggagauauuaauauacuuacuacucuagucacuugagcucuuuacaaaaaaaaugagcacugaggcucacuucuuuauauuugcauuuuuaugguacacacucuggaaaaaaauucuccacagcaucaacccuuagggcccaucuauacauuugugggagccaucaucauucauccuuaccacuguguucugaucucauagcuagccaguguuguccagccuucaggagaaauuccuuggccacaggauuuuccugguucauagauaggaucucucucucucucucucucucucucucucucucucuguccguguguuuguguguguguguauguauguauguaucugucuucuguccgucugucugucugugucugucuaucuaucuauaucuauguaucuauguaucuacguaucuauguaucuauauaucuauguaucuauguaucuaucuaucuaucuaucuaucuaucuaucuaucucuaucuuucugguauucucugcccauuuauuuugucaggaauucugcccuuaacucgccaggcaggagucuucuuuuuaggguuccuagguucaauaccuucaucuugauucaucgucaccauuauuauauguugaagcugacacuucaucacugcccugaaggcaauacuauuuuaccccuuggagauggccugcuucaccuguacuuacacuuaggaaggacaugaccacagguuagacaguggauuuaguaggauaucuucacagcccaugucuuuaauuccagcaggcagaccucugaguucaaggccagccuggucuacagagcaaauuccaggacagucagagcuacacagagaaauccugucucaaaagaccaaaaaucuacacacauacccuauuuuuuaaaauuucaauauucuuugaggauagucuuuuuaaaaaauauucuugaaagagauguuaucuucagucuuuuauuuuuauuuuugacuuuuacaggacagugucucauacacagucuggcuguucuagaacucacuauaaagaucagacuaaacccaaauucacaaacaugucuaccucgucucucaauugcuagaauuaagggcgugcacuaccccgcccagcucacccucagucuuucuuuggaguaccuucuuuuuguggcauuauuugagacgaucaccauuuuuucuuuacaacaaccuuaaaacaacaacaaaaacaaaaacagccuaauauugucuagauuguuucuggggauuucuggacgacaaaaugcaccacuuuucaggcggugccugggcaggcauggagccccagagcccuaauagggaugggaagagauuucagggucaagggccaucccaugugaaaccugccugugaaauauguucgaagucccucaaagugcugggaacuuugaagucaccucugaguugcauauccucuggccccuugcccaggagauucccagggaagcuggaugcccucuagguccauuucugugaaagcugcucaccagcagcuagcaaagaauuacuauuaaccagcuccuagaugguuuaaagaaaugcugauuacauguaaguggucucugacugcucagauacuaucuuagaacaaucuaaggguuauuuuguuguuguuguuguuguuauaacuaaagaucugaauguguuagaaaauggauauccuuacagguuauaaaacauaaaccuuuuucugccuauuuuuggguuugaagacucuuaugagagaaaauugacauaaaauuaaguuggcuguaacuaaaaugucauuuacaggauugucuagguuuuuuguuugguuguuugguugguuuugguuuuuuuuuuuauuuguuugguuuuuuuggguuuuuuuuuuccguuaguuuguuuugguuuucagccuuucuguguguaguucuggcuguucugagacuccuuauguagaucaggcugcccacuaacuuagguuuaacugcaguuuaagauuaaagagacaagaagcgaucucgggacgaacuuagcagagacccgaaaggcccaggaaaggcauagccaggccuuccacacagauccuuuuguaguaguuaguacuacaccccaagacgagccgggccggacccacccaaggcgcacagucgcgcgggccacugcaguccgcaauggcacuuucccgagucaccuucggaaggaccgcuuucagaugagaaagcgaggagaggcguguccgucuuguccgggagcucagggaccaaccggacacacuuucucuggcuacccgcuuggccauuccccugccucugcuucaccuccacaauuccccaacucuggaccacuuaacucuggacgaaguucugaggaguugguuggcggugccaaggcugacccuggcggaagagccaauucaccgcccgcaguagcuuuccucugcagcccggggauccggugcccagcgcgaaucucagcuccgcagggccauaucuacucaccggcaagaacagauucagcagcagcagcaagaggaaccagugacucagacuggagacguggcugaagguaaccauggcugugagcuagcauggugucacucagcuggaggagcucuauuucaagcugguggccacgccucuugucagcggauugguuucuguaugguugccuaaucucgugggcggguccagcgccaccacucuugccuucccaccaccaucagugcucaguaauaucuaguuuucuauaaauacaguaauuuuaaaugccugugacguuauuaacagaaucauauuuguuauaagcagcaagcuaaagucgaauucucugccuucguuuguuuuccauuacaguauacugcucuuuauuauaaguuaauuaaaaauuuuccuggaccugaguggagggagaggcaugaacuagagcuggaaucguuauaaaagucagacugcagcagacuguaaaccuucucaaaagcaacaaacaaaaagaggaagauaagcuacaacacacacugucuuagcucaacauggggaaguuugaaguaacucuaucccuguagcuuuccugugaguguucacuggucaauggucuggagcagcagcugaaggcuucacugucagagucugaggggcugugugggacucgcugacucugaggaccucaaaauauccaggacucguaggcacucuuccagugcugggguuggggggggugugucgggggaggagggcuguaugaacaucccuggacugugagucccucaccucuucuuccuuucacuguguuuagcuccacugugugugccaauccaagcucaugggacacaggacauuuaagccaagucuacuagucuaacacaggaaguagaaugcuuauuucucuagggaacuuggguugguucaucuguuccacccgcccccuccagguauucgaaaaaguggcccacuaccagccccauccaucucccuuccaaaugccacuuccucuuuaaaaugagggaggacucagagaccuggauuucaauggcugccccaaagaagaggagccuggcuccaggcaccugguacucuuuaauucaucucuugccucucucccuagggccagggaguggagccugugcccaucugcccucaccuaggcuggggagugggaggggccaauuccuuggccagccugaugcucuucuauuucuugucuucccucaggcuggugucugcucaggaguaaaccaaaucaaaacacaaacaaguguuuagaaaguuugguuaguucaacacgcugaacugucccucacccuugggaagcagagggaaaguagaggaagggaagaggagaggacugugcacuuguggaugcuguugucccaccagucucugaguagcucgggagcagggggaggcuaguggcuuuccuuuucugcauacaguuuacagaucugccuugucccacacuguagguggaggggaggugaaaggaagaggccugucuacccugggcuagauauuugugcuccagguccuucucugcccucugcccuuugcuccuuuaaaacauuuauuuuaaaaugugugugugugcaugugugugugugugugugugugugugugugcgcgcgcgugcguguccaugcgcacaggugccuccagaggcucgaggugacauaucuccaauagcuggagauacacauggcuguaaucugccugauaugagucuggagaucaaacugguguucucugcaagaacagcauauccucuuauuggcugugucaucucuccagccaucucuacccuugcucuuuaaggugggauagugggaugucauacuguuccaggaagccccuaaugguucaaagcaguugggugacauucucaugagcccagugacccuugauggucuuccugcagagaugaagggugcccacaauggaagaguuggacucauucaauaccaggagaaucuucucaccccuagaauagauguauuaucuauuguaauauguauauaucauacccuuucuugggauacuuucagguugcuucuggguagcuugcugcuugggaauaugugaggauucugggguuuuuucccucucugcucuuucugcagugcaaugaaaaaggagagauauagccacguccuuuagguuagugugcaagaaaguaacagaggucugcaaaggaccuuggaacuguuaaaaagagaauucaugaggacauuccaaauguccagauguaugaugguguugugagggacaggaccuaguucugcaugggggccagggugcaggagagaaggugaggaguucagagcuuccugucuauacuggaaacagagaugucugagguagaaaauggcuacuugcagacauccaugcuccagggugacuggcugcuucauggaggcuccaggagcaggguccuccagagaacuccugggguagguagaugcacagccacuuggcucuucuuuacuucacccucuccuggcaucugagguagggaggcauucuugggguccccucucauggguguuguuuggccaccuucauucccucuggucucuguuaucuucuauggguuguuggggaggggcgcuacagcuucccuuugagguggugugggguguguugucagaugccaagggauauucuggaugccucagagcuaugucagaauacagagcauuaagcauuucagcaaggcuguguuggcuauaggaggcugacaaguaagcaagcugccuggaaugcccuggcaggccacaucccucccaugccacaguugcucacuggcugacugaugggacuccaguucccaauggcuccagguggguuaucuucucacucaacacugugaaccugcacccaccuucugaaccccucacuuggcaccuccagcuuaagacagccauauuacaccgcguuuccaucuccccagaaguuccucuuguucccaaggauucccccaaaagagaaauacauguauuuccauuuauuucaaggcauggagcagacauacccccaggauuggggaaggacagagacaaauggauacaaaacuuggaaaaugaaaggaucagauacaauggagauggcaccaacuaaguauuaaggcuccaaaugugaguacgcauaggugcucacauacauacacacgcacacacacacacacgcacacgaagagcgucauccacauaggaucaggggcuggaugcagaggcugcucacugcacauagcugccucagauauugcaauucuauguagucagaaugucaacagaaugggaagacuguauuggucagggagaguggcaagcuugggccucccuggccuuuggggucagccucugggcacuucucuugcuuacaaacucacacugcaguuggccagggcacuccuguggcacaggugggcuccucuggcuguagggcagauguaggugaaguaacuaccugaacaggcuucuguggaaacagcuuaacaacaggauaaaagucccaguguccucaccagaguagcuacagccuguccaugcuugugugagcacaaggugggcagauuguccagaagucaacauuaccacccaaagagcuccggggaauccuggagucuuccuuccugcugcuccuggcaaccucacucucuccugugcugugguaaguggcuguccaaagccugcacaggcccuccugacccccagaucugaugccguauggcaagugggggcuggcuugggagugcaacuugagauuaccaggggcacacugcagggcagaaacugcauuuggcuuuagcguuaaggccgguacuagguggagggcuccaaagaagaggccagugcucccuggaggguccuacagcuggagucacagcacccucauagccccaggccccaccugucauccucuugugcgaggacccuucugucccacuggccaugccugugggccccacugccucugcaggccgguguaaagugcugggugccuaggagggaguucugcaggcgucaccuugcugauuccaagggcucuuauuugaggauauaguuaaugaauagcugacacgucaggaagaugcagagcaggaaccaggagcggggauucugcaggaggcugggggcuggcgccugcccagcacgcacuguggagcuuaacauggucgaaaggugccugcaaugaaagggguagaggcugugucaacaccaguaugaccacccuccccagugagaggcuagucugggacaagauggcauaucugucagcuggggacauggcuacaagugugggugggagcuccuuagggagaggagucccaggccugcacuuccugugugucaacugugggacaggaggaucugggcuuggggacuaggccucuaguauccuuccugccagcccuggggugacgaugaacagugcccacuuccucaaaccuguguugacguccugaccacuggacuauuuggagauaagaucucugaagagguggccacauuaaaaggcucacuagggugggcccuuaaucuagucugggauccuaagacgaggggaucaagacagagacagacagaggaugaucaugucugaaagccaaggauggagucacugagaagagccaggccuaaaacuuccaucuuaggcuugcagcuuccagaguaugauacacucagugccuugcuggcauccuacgcugagugucaaccagggacauuggaacaagcccaccaaaccuggauucugaugucuguucucucuguuuccugggugcagaaguccuuuggggggggaagcuaccagguuucccuuucuuugcccccacagcuugggaaaggaguagcuugaaagacaagugacuguauuguugagacauugacuagaggagucaaccuggauugacuuaaggauuccuagaaaccugggcuagcaccuccagggagcuagcuccauucucagcaggcacagcccacuucacaccuccuuagcccugggucagccuucugggucugggacuccccacuguggcauuagaagaacuccagagacccuagaauccccacucucauuagcugauauguauauguaugugacccgcagcaggaaucaaauagggccagcaaguguugagacucaaggcuucacugauggccgacuacaggcaaagcacaggacaaguacagcccacagaaagaugucauguuccaaucaucucccacacccucugccucuguuagucaauuuuccacacacucucccaugaguuaaugaggcuauuuuuagaccucuagaagacacugugacgugggaaagcaggaaaaaccugcacuuggcauggguggcuguaagguuggcagaaucaugaccuuuccugggaccaggguaccauuucuggccucaggaacugacuccagccuuucuggcccuagggucuuguuauucaaccgccucccuucaggccacugcacagaccaaagggucucuagccaacagacuucccaacauccaaaccuagagcaguugacuucagccaacgcacagucagguaucuaaaccucugccugccuggagccuacgugacccagaagguacacaaccacauuccacuccugucuccacccuccugggugucccagcucugacucacuuccuuccagcuuuaugucucuaccagucaguccucuaggcaagggcaaucaggaggugucuggaggaugggcccaaagcuugguccccacauccucuucauucggcucccgauccucuugucugcuaugaacccauuuuacagagaagcaagugguuugguauaugacgcccucacaugauaccaugugcugauaggaaauccacugaggucacguagcgugauuuccagacacuuugcuuugaggauccucuaugcagggugcuggugagcuacagggagccugaggugucugggagggcugcuacaugcuuccacacaccugggaggcuucccuggcucugaggagcucuuuggcccuguacauucuucuaagcuccuugccugugcucaauagcgccuucauggggggcuguggugcccuaugcuggcagcucccuccaccucccguguucuuaccuaugcagcucuugcugagcuuccugaauggacagcacggccucuuguagcaucuuuagccgguguaccucucgccugcaccgaggacaugggcucucaccaccugaauuuccaggguggagaaagcagggagaaacagaccaggguaagcuaggauguccuagcugacccaacuccugauuuaccacucucaggagccaggcacagacacaagagagacagggaaagguuaggaggggaugcaggcucagcuagcuuguaagccuuagagaugagucaccaagacaugauccacugcagaugugggaacaauguugggagacaagauugcucaguaagagcaaaggagccaagagucucaccagggcagaggcagggucagagucaggggcuggacaauggacagaacccaaccaaccucucauguuauccuugcagcucagggagauccuagccuuggaccacuuccuccuagucccauuuuuuuagaguagguuucaaguaugugaggcuggucuugaacuuaauguagcagaagaugaccuuaacucuucaucucucaugugaccucuggaguacugggugauagguguguaccaucaugcuguguuuaugcugugcuaggacugaccccaggccuucauaugugcuagacaggcauucuaccacugagcaacauaccucgcagucucuucucuuccccaaccucuggcuacagcccucaucaggcucugagaaggcagaucucuuagggagacagcaggguaagaugcgcaaagauguacuaugagaauuccugccccugugugcucaucucugaaaggcacuuccuggcccuucuuauccugcagaggggcugcagguagggaccggcucucuccuucuguucucccugcuagucaagguccaagguguucacuagucagggccaggacuaaccagcauguauaaaacucuaggagccacuuaccaggaacaaaguccucaucagagaggucugggcaggacucagguguggagccgcugcucucagugaccuggcuauggccagagggcuggucacuggcuuugcggagccgccgaucagagcuaggccucuguaaagagaugaaguuacuauacuuagugucuuuucccauggacccuuuggggacaugguguuccguucaugcacuagauuagggcagugugcggaggacagaacugaggcuuuguaguucgacacaggagguuugaaccucccccugcccugaacugaagccauuccaucucaguggccucaguuuccuaucaggaacauaaaaccguugaccuccucuggaggcaugaggaccagccagcccugccaccaggcuggcacauggucagcaugcuauucacaccuggaacccagagccuguggcuaggccaaccuggcggagcaauucauagucccaccuugugugcgggcaccacccucccucuauuucccugcacucccccaacccuuugacaucccuccugcuuuccccaugcagggauggacguuggcuuuuccuccucuuuccugggcuagccugagccuggguuuauuuagcuauagaaugggacaaagugacuucaggaggugacaggcuggcacagaaucuugaccugugaggcccagggugcccaugaaccaaguauuuugcaucucaggucccccacuggaaagaaaaaaaggagcaaugaggaaggagccuggugacagugaaggcccauugccagguaggguugagcuaucacagagaugggcacugagggacaaaggccagguggcaggguggaggguaugagggccccaggggugcccacacacacaguugagaucaauucugggcuggagccuuggugagggguacugaccuugugccuggagucaggacuccccagaaagguugucuggccagacauagucucccucuguagaguaugaagaaucccaucuugcucauauugggcaauguccuucagcgggucccaggggcugaggcuagaggauccagauggugaccgucaguagaggugaugacccuuaugggagaggguucuguccuagccuagacccagcuucucauggugucccaagggauaaccaccauucagggguuacaaggaaggauuagggggucuaucugaccaucucuccuuaugccucgucccuaagguacuacugaaggcagggagagaagaugaaagauucuacagucucuccaaaccaaggcaggcacaguggacucagucugcaagcucccgccccaccacacaggccccaggccaccugcuacucacuccucauaucgguagcgccauuccugagugagaggguccaguaagaacaacuguggcuuccauggagugaggcucugcuggugcucacgggcacgcugccgcugcgccucuuccagcacagacuucuccuguguggcuuugugcuggucacccucacggauggcccuggugacaugcugccacagccuguaggucaaaggaccaaugagcucagaguagggcggcuccacuugugggcagcccagaaucaauucccucuaguuuggaaggggggcuuagaguguucccugcuugguugccuuccgugacaaggggcuggcuaucuugcaggaagccugugucucccagguuuuuauucuacaguaugagcuguauuuuuuccuaagcagggcuccugccugccaccugcagggaucuacuuguuagcaaugauggggcccucucccaccagcuguccccagcagggcaggugaucuggcaugagggaucuauucuggggcugcccuugccaaugacacccuagaaugugcucccagcaucgugacccugacaacccuccaccuggccaucaucgucuguggucaccagggcuccuggguacagggccucaccucucagacuccaguucacucugcucuuccaacagcacugugugccgcuucagccgcugccugcggaccuccucacucggaguccagaagagcucggugccuccacugcucucuuccuugauaaauacaucucuguccuggcccagauggcauagcagcaucagagcugcuggcccaguuggugaccacccuagggcccaacuaggcucucccuaagggaugacgccuuacccaguguccagugaggcgugccaggacuuccucuccugacaugaucuucccggaaaucugguugauguuggcgcugcuuccaaagaaaggcuacaagagcagauggaaaccaaugaauagggaggagggggcucuacccagaggcacauccucagagguacagaguggucauucucaugacuguggcuuagacgaggcucacuacuagaaaaaggugcccucacucuacugucuugaccuggacccaaaccuauagagucugccaccauuccauuaggacaaggggacuuagacuugcaggcugugcuguguagccugcgggcaacaccguucucucucugggcccugucuguccuauggggaugcaaagcaaucuaccccaguuguucucuuuuggagcacuuugccugacacagaaggagggggaaccccacucgagcuccaugcauucccucccacaagcuguacacauuaccuugagcuugaaguccaguucagcuuggagguuguucuucucacacucgauguucacuuugccucccagcuccauggucauggugccguagaggaucccugaaauacaacugguguugggguucaauccugaaagccugcaucacagggcaggcaaggaaaagugugugaaggguuuguuaagauggagccaggacccugcuuguuccucaguacugugucccaggaaggggcuucugcucuggccuggagaugcuacacacuucauugggucaguuccuucaggagcccugaucccacggucugaccaaccacaucugcaccagcccuagaacuagagaauagaugugucuacucuccauauucccacaggacugugcaaaugugucugaaaacugccuuuuuccucaguucucuuauggucauauggaaaacauaaucuaaauuugaaaaccaccaccauaauugugguuugaauaggaaugccccuguaggcucauauauuuggaugcuaauucauuuuggggugguacuauuugacagagauuaggaaguguggcccuauuggaauaggugcaacuuuguuggaggaagugugccacuagggguuggccuugggguuucaaacguccaagccaggcuagugucacucuugccugcagauccagauguaggacucucagcuauuucuccaacaccauaucugccugcauauugccaugcuuccugccaugauggcaauggacuaaaccuuugaacuggagagauggcugcucuuccagaggacuggagauaaagucucagcacccaugugacagaucauauccaucuaagaucaauucuaggggaaucugaugaccugaugccaucuucuggccucuguagguacugcaaguacaugcuucauauacaugcagaccacacagacaaauaaaaguaaaaaugauagcugguaguagaggcauacaccuuuaaucccagcacuugcagagaaugguagaccucugcaaguuugagaccagcguguuuuacagaguuaguuucaagauagccagggcuacacaaugacacccugacuuagaaaacaaacaaacaaacaaacaaacaaacagauaaaaaggauaacgagaugauaaagaaaaggaccaggaagaagacagagagggcugaagagaugagauggaggaagaggcagaccuaaggaucugagaccuuggcagguccugauagcuagcaguuuguccccagagcuuuccauaccacagagacucuuagaaacugucucuugucauaagagauugcugcagaaugccuuccauggccaaggaaucacuaaggaccaaccccuggcuuugggggguucaauggauacuuucuguguggucccgaacauccagcuuuguagagcuggcagagacucccagcaaaauuacaucuuaucuaggaucacagacagccauuguuggcuccuggguuuugucugcucucuaaaucuuugagugcuuccuucuaugggacuaugacacuuacauauucuggucucuagaccuuagaccccagaaucauccauugaacagcaacaaaaacaauuuaaaaaaaaauuuguuugguuucucgagacagaguuucuuuauacagcccuggcuguccugaaacucacucuguagaccaggcuagccucagacucacagagaucccauagagucauuaaaggcauggguuacuaaauaaguuuuacugagcaucuuuuaagguacugccgugggccguggagauacauguauguaauucauacacagggcaugaggcucccagacugggaagauaaagcaaccacacuuaaaacuguacuggggggaauucugcagauccuaccagaguaacuaccucacagcaagcugagugccagacugcugcaaaacacauggccagaaucccgcuaagaucagggauguagcacgcacagucgugugcuuucuuggacucuggcauuccugugcuuguuucucggagugugcaucgcccugcugcuuugauucacuugucucucucaggccaaguucucaucagcucugucacagacuuagagacacuuaaggcaggaacuuggcaggcaggguggagacaggggcauaagccaaucucugcucucuaaaucaagcugcacuuguccaggucauccuuuggguugucagagcuaugcccagucaaaggugagguuguauguauguauguauguauguauguauguauguauguauguauuaagauauggccuuauuauguagcucuggucuugaacgcacagagaccugccugucucugccucccaagugccaagauuaaaggauaugaaacacuguaccagguuuaagauagacucuuuuuguuuguuuguuuguuuguuuguuuguuuucucccucucucucucucucucucucucucucucucucucucucucucucucucucucgcaaguccuggggguuggacacuagccucagccucagccucagccucugccucugccucugccucugccucugccucugccucugccucugccucugccucugccucugccucugccucugccucugccucugccucugccucugccucugccucugccucugccucugccucugccucugccucugccucugccucugccucagcguccaccagagggauuuuuaaggcagggaagcucuuccauuugacauuacagugguaacucuaugucacuauccuuaaaaucuauagaauauacacagagugggcuuuagaggaaacagaggacuucagcuaaaagcuaagccuuaaucuggauuugccauggaagaugccugagauuggaggcugaggguggauaggaguccacaggcauuauacuucugggugacugguuuggugugguggugguggugguggugguggugguggugguggugguggugguggugguggugguguguggugcugggguucauacauacuagauaggcaagugcucuaccgcugagccauggccacagcuccuuucuuaucuuuaaauuuuaagacauugucuuauuuaguuauccaaguggccuugaacucauucugcagcacaggcgggcccugaaguuucaauccuccugucuaagccuccucaauagcugggauugaucacuaauacaagaggagccagaggcaaaaucaaagaggugaaacuggcaauccaccuggaguuaaucacucagcucugaaaagucacccaugagguuggaacaucuucaaauaggcagacagugccuagcaucugcucugguuggucugcuccaccugaauuuagaaucaccuaggagacacaccuugggguguaccuaugcaagugcuuccaaggagguuuaacagaggaaggaagaccuacccuggauauggguggcauucccugucauccguggcugaauaaaaaggagaaaugaacugagccccagaguucacaucucugcuuccagucuauggauccaauacgaccacuggagucaccuaccugccccccgcucuccaugggcuguacccucaaacugugauccaaaauaaacuaauuucuuccuucuuuguuuucaacacauuacaguuaccagagaaguaacuaauucagcccccuaugccacaacugagggcuagccugggcaaaaggugggggcacggggaucggcucaguugcucaccucggcagugggcauagggcauggugaggguauacuccuccuugcgauuaaggaaggugaguuuagccuugccguccagaagcgccgacaaugaguucccugcaaggacagaguagggacuguuuagggcacagaccuuuagcaucaggcugcugcaggaccccaaggucugaauguccuuagaacaugucccagaguuccaagcaccuucaacuggggcacugagggagagacacacaaccucugagccuuggguauuauaaaaacucuugucuaguuggcaucuguuaugcauccugagaagucgucugaauugcagcacguuaguggucuaucucacaacaccauggaguuucagggaggacaacaugaaccuuuuagagccagccugaggccagagcauaggugggaggggugaauggaaccugggcacagaugccacaugcuacccucugcugcugccaggcacauagaggcccugagcacacaccugcacacuagagaugagggcaaacaggggccugcugggaaaguguguuggugagguuccugggcagugccauuuucaagcuuagagcagcacagggcagaacauggcugcuccagucugggauacucaaaugcuugccaccagccagguguagcuaccaaagcacuugauggaacaugcaaugggacacuguucauacucugauuucacuucuauauaccuaccuaccuucuaucuaucuaccuauaacccaucuacccacccaugucugucugucugucuaucuacucuccaccuuccacuucccauuuauacaccuaccuucuaucugccuagccuaucucucuauuuucuguccaucuaccuauuaucuauuaucuaucuaccuaguaucuaucucuguuuucuaccaaacuacauauuaucuaucuaucuaucuaucuaucuaucuaucuaucuaucuaucuaucuaucuaucuauccauccauccauccauccauccauccaucuaucuaucuaucuaucuaucuaucuaucuaucuaucuaucuaucuaucuaucuaucuuaucuaccuaucuaccuaccuucuaucuaucaacugacuuucugacuuuuuaaucuaucacuuuauccaucuaccuaccuaccuuaugucuguuuaucugucauauauccaucaucauccauuugcaguauuagggauggaacacacagccucugcauguugggugcacacuucccacugguccaaccccccuuuaaucaguacaagcagccacauguggcuggcagcuauaaagucaggcagcucuguaggagcaagugcuuccccacaagcuucuccuuuguuuccuggcuuccccaggugucugcuuucaacugaguuagggccacccacauacacugucccaccaguauucugggguucacccacuuccacaaggcccaggcccggccaucccguccucauccccaggagucuccucaccauagaacuuagacuuugcugugaugcugccacucaugcagaagccaucuuuccuguugcugacauagaaggcagacacaggaggauggugagacaccugugugaagagagaugggucuaaagaaggcuccagaagugacaaucccagaaaggacaucuggguuccaugggcaagugggaggugaggggcacauuccuacaaguaccagggcagagccuggauccuggggucugagucauccaaagaugcccuucacggggaagucagucaggcugcucgcccuccuucaggaaauccuacagcaccaucacgccugcccucccuucugggagaauccccauggauggugagcaggugugaagccuguccuauggcagguacaggccacugaaaaccccacucucagucccacaagccccuguccaccacccacugcacauacugagcuggaaggcaagcugggcgguggggucuugccuguucugcuauguagaaggugugacuguuggucugagggugcagccagcggcagcgaaaagucucccccagaaugggauuauaggguuucuugaugcccuguggggagcacaaagaugcacuggaggaaccaagaggagagagccacuucugugggcccaguuaggguuguuccugccucuagaagagguuuugucucccuuauucugcuuuggggugacuacuuuuugcugguagcuuacaguuguguguguguguguguguguguguguguguguguguguguguguuuguguguacugccucaagaauuccuaaauuccuaucuucuauucagcuuggaggggccucaagaccacagcuagaucugacugucccuggacuggggcacagaccauacauaacugggucaaagcuaagcuugggagguaccaggcuuccaggagacuuuggucuagcuuagcuuacuguaugacucuagguugguuucuucugucugggccucaggcucaccugucuacaaugagacacagaucuggaaucaaacucauugcaaccuuucuugccucugccuccugagugcuagcauuauacgugugaguuguccccaaccauucccucccccaccauguguguaugcgugcauccgugcgcgugugugcaugugugugcaugccuguggaagcuggcagucaaccuugcauacuguuccaucuugucuuugagauagggacucucacuagcccagaaguugcuaagcgggcuaagccagucagugagucccagguauccuccugucucugccuccucagcacugggaucacaaacaucugcugucauaccuagcccuugugagguuuuccgaaugaaauucaggucuucauacuugcauggcaagcacuuaacuacugacucagcucuucccaaucccccuuccccuuuuaagauggguucucacuuauguagucccggcuagccuugaaccucaggaaaucuuccuguuugugcuucccuagugcugggauuacaggugugcaccgccaugucuggcuagaaucuugguugccaaguuuauggacuaaggaaccccagcuccaugugggccugcaggucacuccauaaccagggaggcucuguuaccagcagaguccggcuuugaguucucaaaaggggguuccucagaaaucccacaggugccuugcaacuuagggucaaaugcuccuuuccuaacacuguugugugugguggcgcuugucacauagccuaaggcuguuuccucaaacacugagcaaggcucaagcuaauggggacccuaauggggaccagcauugggcuggguaugacaggaaguccaaagagcugcccuccaccucucuggaucuggggccaugguggagauggcuggcuuucucccaugccguggaagaguuggucccacucauggugggcucacaaaccccuuggcugagauccuguccuucccacaggccccucucaccuugggcuucuuauagaagccagacagguaccaccggagcacaagcuucaugcggcaguaggggucauccucugcugcugcccugugaugggguggagagcucuaauucaggcuagggucccuggcuacccuccucagcacgcaccucuuuccccaaccaucccaaccuccaucuacuuggcuaaaagaggcagucucaccccagaugaccugggcacccugcuccauccucccagguagggcagaaguaggcaagugggcucaccacauaucgagaauagugcugaggccaacuccacaccagugcagaagggcucugcacacuccacacuguuuggugcccccaccucuaggaagaacccuggaugcucacacccuuauuucccucuuccuggcuccaccccauccccugccucugcaguccauaggguuguggaacccccuccugcuggaaggugcaccuggagagcaggucuccgugguaguaguaaucagagagcuugccgaggaaggaccgaggcuccaacacgaaggucggcagcaccacacgggacagguccaugccuggccgcagcugucgcagcagcacccacaucaggcucuuguuuuccucugacacugucuccaccugggaagucucguccagcugcggcagagggacaugaccagaccccaugagcugggcuguaaagccccugcucugggcugccuaagggagcugagggacagggauccagaacagcacaucugacccuugcccacuggaugccauuggaugcauguccacucugaacaggugucaccagcccccauccugagcuugggagugagagaguuucucgguggaaugggugucaccacccacccacacuggguuuaggagugagcagcuuccucaucaggucugggacaagaccagcuuuucuacucuggcauccugguucucccucuaacaugcacaacugccaugguacuauucaccacauggcacauccacaagacccucaccagaggccagauccacagggcugccugauccuguaugucuggccuccaaaacccugaguuaaauaacccucuugucuagaaguucuagcugcaggaauccgguuuccccaguccucuguguuuaugggugugcuaggcaguuuucugcuacuauaagaaauaccugaggcagucaaguuaaaaauaagaaagguuuuagccaaucucagcacuaaggagaacugguguuuguggccagccuuggcuacagaguaaguuuuaggccaaccagggcuacacaggaugguugggccucacugcuuugggccucuggagaggcgguacaucauggaggaagcacuuggcagcacaagugcucauggccaggacaugaaagagggaaauauccgaccaucagaccccucugaggccauagccccugcaaccuaacuuccuccugcugagccccaccuccccaagguuuuaccaccucccagcugugacaagcuggugaucagaccauccacacucaccaugcacaugacaauacucacaugacagcauaggugccugacugggaugaggagcucccaggggcagggucauucuagguguauguagguccccagcacguauaggacuggggggggggggaucauucuugagcugccuguccacucuggccacacuccacuccagggaggcuguuuguuuggggcuggacccucacaucacccuugcaucucaugcuaggcaggcaggggagaguugagcaggcaucacucagauccuugccguguccuguuuccccuccgaguuaacagggcucucaccucucccagcuccuccuggaccuguuccacauagguaguuccccuccauggcccaccagggcugucuagcaggucgcucccacucucguuggucuugcggcugugauccugggucucggcauccgagucuucugcauucucucguucugacuugucugagaaugcaucguucuccaaggcagacccauucagccuggagaguagaaaugccagugggcccccaauuccaggcaacaccuaggaccuaggacacccaccuggguacccagccucuuuuccugcagggaaguugcacacugccuaacacuacgugaccuguauuugcaccacugcuccuguuuaucaguaaggaugcaaagacugguucccaccggaaagaacaaguccaucacuccagcugacccaucuccugcugcuuaggggacaccaugcugaucaccucucaccccguucacucacgggaacaggucuugaucugggaugguggccgaggugggcaguccguagagagaagagggagaggcaucaggcgaggaccccugcuccccaucucgacccugcuugcacgugcucagucgcaggaggcuggagcagcgaagggccagcuccagggcaucuagccagcagcggccuaaggggcacagagggagacugguggguggcuucccuucuauuuccccaccaaggaaccuuaaucugccuguugucugaaauagccuuccaaaaccaaucuccagccaaggaacccugcccuuuagucaugaaacuucuagucccacaccuuacuccaccucacuagggccaaguuaaagaucugccuccuccacagaccccagccuugcauguagccauccuggcaggaaugaauauguacuaaagagacaggugugcccucccuuuggccauuagacuauugaaacaguggaccccaaggcauuggaauugccccaggagucucacgcugggggagagaagggcugaagucuggggacagacagaggggagcuugucucuuagagaccccacggaguucugagaacgugucagagauugcaggagagauuggcgcugagacagugaugggcaggaccacacccugacuaggauucuuagcucuguacuccuccugcccucuguuuaaaccucaauuucacaucaggacccugaagacuugagauauaucuuguugggccugccaggccuuggagugagucaacagcucugggaaugugcauacacauguguauguccuugggguugacacaguguaggauagacaucaggagggcagaggcugggcaggggucuuacgugcuagugaaaagucacugaccagguaacuucaagagguagcaagagauaguuagggcugagggauagugggggaggggaugacagacagggcagggccucugcuuuggcccugagguucugcuugcuuugugacagugugugugcaugaguguagaacuuggguuagaccugugucauaccacuguucucagggguguggcggggugauaggagggcacuguuaagagcuaugggggagagggacccaugcaggugacaccaaugucucagugugaucacuaacagcagcgcuuccguccacgccucagagucaucuauaaaugauaccaugcaugcccaaaggacucaugagugagggucccagcucaagguaagaugaaguucuugauuccuaagcuugcaugcuggguguccuugggaaguguggauuucuuucccuaacuuaaagcugcagagacuuuuguuugagagccccugaggcuacacugggacauucaugggaacccaccugguacccuggagcugccccucuugcugagggauauuugagaucuuggacuuacuguaggcuugguuugagcacagugcuaccuccugugaggcuggacauuuguaaggacagugaguggguucuggagguuaugcaacccaggaugagagcugguuguagaauuagacuuagggcccaaaugugcauuuuguggcugccacaaaagacuugacauccugaauguuacacagccuuugggaaccauuugaaauucuuugccucuucuugcaggaagccgauccugauauacaugguaugcagguaacauucuuccuugacuguggcccccugacaaucagggauucagcucugacuugucaucugguggcuggcuuacuggucacagacccccaacgugugcaggcucugugagggcauagguugccuguuuacccuagagcccagcagguucaaugacagaaugagugaacaacagucaaaacaacguaugagggcgugugaaugcaacuuuugaccaccaggaggcaccauagcaccagcaguuaagcuaucugcaggauuccaagucuggacaguuggauccuaguugucagggccuuggacuuccagcagggggugcaguccugaggcuuuguuaaggagccacagccuggcuagaagcugucacuugaaggacuucuaagaauggggcugcugcuuggauucuguuaccuaguucagagaaucugggacucggggaagcccacauuaauaucuguagccuauuuuugccagaauaccucuaggcugccugugacuuaauuuaccuauuaaauucacaacugucacuugcuugcuuccauacagcccugggauuccuauagcauugggcugacaaguguggcuagucccacuuaaucugugggaaaucugaggcuuagcugagagagggguaucacuguaagguaggcucagucugugucugacucuaggggacccuggggagggagaaacaggacagguagcacuuaccgucugauucagaagcggcccugaagaucagguagcugcuagggaggggcugagugauggagcccacacucucgccuuuggggcccuggagagacagagaucugcagggucaggcacugggccaggaaggcugugguacacucuuuaucccuucuaaucagaagccuuuccuuccacuuagcuucucaauuauggcuaauaauucgccuaaggcgaauccuggacucacaguugaauuuuaacuucagcgagacagugaagggcaguuuaguguaaguaaauuugucuuacuuggaauaaauguguuuccuuuuguuuuguuuuugagacaagaucuuacugcaugguuauggcuggccaguaacuugccauguagauuagacuagaccuuaaacucauagagaucugccugccucugccucuggagugccaggauuaaaggucugaccuaucauggucagguuggaauaaauguaaacagucagaauguucauauaaaacaguuuuauuuuucccauuuuugguuuuucagauaguuuguuuagaggcagggcuaugcucacucugcagccuaggcuggccuggaacuuucuauguagcugaagaugguuuugaaccucugauccuccugccuccaacccaagugcugcccaaccuugugugauacgaguauccucagagcgcugaagaaggccgcacugugccaggucggucauguuaauucauuuuuugaaguggguauuuuuuuguuuuuuuuguuuugguuuuucgagacaggguuucucuguauagcccuggguguccuggaacucacucuguagaccaggcuggccucgaauucagaaaucugccugccucugccucccgagugcugggauuaaaggugugagccaccacugcccagcgaaguggguauuuuuaauccacaauggguuuuuuucagcuauaguuuauaaagugggggagaauauuaauuuuaaaacuaacagcagcagccaggcauggugguuuauaccuguaauugcagcaacggaaaggaugaggaaggaaggcugccacagguuguagguaagucugagccucagaaugagccaugaguuaggaugggccguagaguaagauaaacccugucuccaaaaccagaccaacagcaacaaaccaccaccaccaacaacaaaacccaagcugggcaagguaguagacuccuuuaaucccagccucaggaggcagaggcagguagaucucuaugaguuugaggccagccuggucuauauacauuuuaggccugccaaagcuacauagugagucugucuuucacccccaucccaaauccagaacaacccuaaaauuuguuguuucucugaaacccacauauaaucaagauuucuccuggggacccaccccuauccugaucaguucugccuggcaguccugguggugauggaugacaccugagacagucccuuccuccucuccagacagcacuggaugagggguuugauguauagcucauugugccucauccauacuucuagcagccugccugaggauagccaccccuccagggaucccuugcuaggggucccauuuugggacagcagucccaggcaaagccuccguuguccccgagucuccaccuggaugcccuguggaucggcucaccuucacagcccacacagacugguccagcggguggaagaguuugaagcagaagccguccuucuuggaggggcgcucaauaagcucgcagcagugcagcagcaccgugcccacccacuggcccaccuugggugucuuguaaaugagcagcaccccuggcuucaguacacaccacagcuucguccagcucuucagggucccucggaucugcaggaggauucauggucagggucacccaugggagcugcccccugggccaucugugcagcuugguggggggaugaggagcagagacaaggacuggaggccccuggaacugggagaacuaucccagagcucugaaguuagugagguccucaacagcaucuugacuugggacucugcagaccuaugagaagccagcuuuaugguggggucauuaguuacaguagucaggguccacucaaacuguguagugacaaacacuuagacuugucucccaagugccauggauuccccagucgauaggagucucugggaguggcaccugcuuaccuuuaggcugucagccaugaugaccacacuggggucagucagggcacugaacagcugcuucguggcccgcuucuucuccugccgauaguucuccuucugugccugcaaccagagaauaugugggucauggagugcauggacugccccagcucccccaucgccagcagggcacagggaaaggaggauauagggggugugggcauccccuccgucgucacccugggccaggcccaccuugagagcauccuucuuggagacccuggucguuggagagguacauuccuugucagauccauugcauagccuguacucagccugcaagagagacagaccauggugcuggaggugcuaggguaugguugggguugccaggaccagggcagcagaaagcaggggucccagaaugaccaaaaaacgagacggugagcugaacaccagcauucaccucugccuccugacuguggggguaauaagagugacugccucagcccuggcagccguaucuucuccucccugaccaugaucgacugugccccugaacuaugagccaaaauacauucuccuucccuuaaggugacuuuaucagccguuuuaucccagcaucgagaaaacuaacagaguuuugguggcagcuaggacaugguagugucaaguuccuaggcuguaucacccauaucucccacgaugaucagaauggacacuccuuggccaccaucaagggcucaucucuaggagacugugguagagagguucacugguucugggggagguaugucucgagggucagugcguaggccagcuacagaugggagccaagcaucuguaccugggcccacggcucgcuucucagacccagaagaguaaucuauaaaucauggagcuggaaggagccacaaccccacacagacagagaaacugagguccaggguguggagccugaacauggucuaaaagccacaguuuggggauggcaaacugugccccaaaccccacaugccaccugcugaugugucccuggguucuacagguguaauguaugugauccuggcaagcugacacaugcuguuugaacucacugagaagcuggcccugggaaugaggcugcacccuacccccauuucagaccauguguguuugccucgguauuaccaaggccccugaucuguggauggcugcucccuccccaacucugugacagggugggaagacaguagcccuaaagaauucaagugcugugccuuugagaacagcuggaaggggaccauuucuaacggaggagguuacuguuauugaaugucauaagugucuacagugagagcaaaggcccagaacucagcuauggacagaaggcacaguugggaacugcagcuguguguguaacucaaagacaacuugcaggaguaagcucucucuuacaguguggauuccagugauugaacucgggucaucgggcaugcuggcaauaccuauugagcugucucauuggcuuauacaugcacauuaaaugcuuacaugccucuaauucuagcacucaggaggcaaaaagaggcugaucucugugagcugaaggcuagcuuggucugcauaaugaauuccagaccagccaaggcuacccaguaagaagacccugucucagagacaaacaaaccaaucacagcaagcagcucaagucacugguauuacccgaggcuggcacagcaaggcucagaagcaacaauguagcaaauaagaagccaagcugggacugaaccugguagucccccuucagagcagcauccucuuagcuacauagggacauuacagauggccagagggagugcugggggcugggggcugcgcagaagcagucucgagcugagaauagugaugagcaugugucagguagcaggccucuagggacaggcccuguuaggacucugcggacugcuccucagccugacccgauccucucucuccacauuucucuuccucaguccccgaguggccugcccagaacgaggacagcucugaccacagggguggugacaugcucaggguuuagacaguucaagcucacagccaguucuguggugagcuguuuguccgagcacccuuguggggcagcuaacucagcuccugcucagacuagcagcugguguuugucaagaacuaugaagagauggacaaauaacaggaugguuucacuugaaacacuagucugauggugagccuagccuucagugccugagccaugucuucggcccaauaauacuauucacaggaagauaggacucagugguuaagagcccuuuagaggacacagguucgauucccagcaucuacuuuguggcucacaauccucuguaacuccaguuccaggagaucugaugcugucuucuggccuccuagacuaccaggcaugcaggugcuacagaggcaaaacauccacacauagaauaagucaaucugauuauuuacacuauuuacagccgugagacugaccucugccgccagcuuuucaccagacuggccugaaccagcugugcuuguuuuaggccacagaggaagaaggaaggcaagccaggggccuggggcagagcagccacugcauccugggaggcaaggccaaggccgcucugagggaguggucaagucagcagagagccugcugggcacugcagaagggauucccccagcaggcugugcuuggcauguugccugcacaccagagacccccagacacuuguguguccucauguaucccuggcaacacaggaacacuuaggaaaugggacgguccuucagaaguggggauuuugaaaucuuccuggaacuccgcagccuauaaaaaugacuuaaaagcugaaauuggagacucaguggguaaagcacuugccauacaugcgugcaggcuagaguuuggaucccuagaaacaagccguguaaaagcagggcagauguugugaccacuuguaaucccaacaauugagggguagagucgggauucuggagugggcuggcuagcaagacuagccagaauuguuaccagggagagaucgugccuccauaaauagaauggaaagcaauagagaacaaccugauaucggcuucaggucuccccgugcaugcacacacaccaccuauaccaugcaaacuacacauaccacacauaccuauaauaagauaagaaacuguaauugaaacaaccuccaaaugagagaaagcauuuacaaaccacacaucugagaagggcugaggauucagaauauauaaagaacgcuugcaacacaacaagaaaaaaauggacaacccgaucaggagauaagugaaagauuugcagaugcacaugaugccaugcugagcugagucaacccggaaaccgaaccacacugagaugccaaucaggaaggcuagagucaaaacagaauagaaaccaccagugcuggcuggggaggacugagggagggcaaccuguguugugccgguguucacuaagugcacgggaguuuaacaguucuucaaaaauuaaacacagaauguuuuagaaguccauaauugccuuaguacuuggcaacuucacaaaggacuguagcccagauacauaugcacauggguacccacagcagcuguuuacuacagcugaagaguggaaaccaccgggaaguggcagcagaggggacagcagaguguggaaggaagaacgaaaucuaauagcuuggaaggucucccuaagcagaggggcuuccuucuccccaaauaguccuggcuggcaggagucccauuuucagguucacugggcuaugcuaagcaccuaauaaaacaagagacacagcugccugaaccccaugcagauagcgggcagccugagagcugacgccuuuccucaucuaaguauggggaccucagguucagccagcaccccgcugucccuugaccuaggcucccugccuccuggcccucccucagccuggcucuuaccaguggcaccuucguggcggagccuggggucuggggcucuucaucucuggguugugaugggccguuggacuccaugucccuuccuggaagacaguggguaggcaggacucagagaggcaaaagugcacuauaaaggcugccugggaggggcaggaagccacaagagugguguggcucugagagguggagugagcuucaguaaagggucccaggggcucuggucagcacucacaaccacugagaggaaacaggggaggagcuagaggaaacaagggcaguugggccaggggugugugugugugugugugugugugugagagagagagagagagagagagagagagagagagagagagacuuaggcucuuggaucuccaaggaaacauggcgcccagguucagaggcacaaaauacacaacucuggcaguuccauagucuugcuccagauuagaugaagaggugggaggaaggcuuggcaccaggaccccugccuggccucccuguucucuguagcuuaaaggagagagagagagagagagagagagagagagagaaugaauaguggggugguccaaagccagucccaagugugauuugaccgcucucccuugcugaugcgggugaagggccuaugauuuagaacagaggccaugaaucugugguggugguggugguggugguggugguggugguaacucuuccuguugaagcuacaggccagggauggguaugacgggaaggaacagcugggaggcugggggcucugcaaaccacuucccaagagcucugggaagggcuggguggagcugagcaguagagauauucucuccggaaaagccaggguggugacccaagaaaguauuucuaccuacaggucagagagcagcaaccacuugaggucaccuaacaucccagucuggugacccccccaugugaccaaguuucaggaacuacuacucucugcccauacagcccccugacucagaccuuggagcugggguggggaugggcagcuguccacucucagaggccacaugcgggaagguggacucuggguagggaggggugagcagaggugucacgucaggugagacaggccagcacuagcucugcucuuuccaccauacauauccugugcacaccccugcuccgggaaccugucaucgcuuccauucucugaagaaggccuggagccucccaguccuuacauggcccagccaguuguccuacagcucaagauuccagaaaaugaucacuaacugaagcuugccauucccaccuuuccuucccaccuccccuacugggacccaucgaucgaucaaucgaucaauugaucaaucgauccucuccucgccuguuccugcagccuaggugagugagggccacgggccacuagguaucaaccuuccuuguaucccagugacuguccagagugcccuccccauccagccucaguuuccccuucugguggcugagauuguugacaugacuucuagcucuccuucccugucacggccuuccgccuguccucacggagggcuggugucuucuccacacuggguauccagcaguggaagguagaagagggaagaggggaaggcagggcugaaguccacuggagcaguauaaucccaucuuccauucccaaaaggaagggcuaaguucucuaaugccacugccacccacaggcuagagagggcucuaaccuggguggacgggccuggaguccaucagaacauucuuugugguggggcccagauuccaggacccagaacuuuauccacaaguggcauggaaguagcauggacugaaauguuucuuccuaggauucaggacugcuugggaaggugcugaugucuccauuuuauuaacaaguaaacugagccccaguaaguggucugcagguacuuagccaugacagcagggcuagggucaggugccuguccccacagccaguguuugggauaacugaucuuuaucaucucuaaguuagaaccucaccagcagacaugguccuucagugugcugugaacccuuugcccacaacaaucauagucccauuugugugacucucucacuggccaugaagguacuagaugggguggaacacuagcuaaacucucaaacugcagagccaggaggaccccagauccccauggcuuguaccaaccuggggugaugggaccaagcucauuuucgcagcccagaagcagguuccgugggacuuuccgggggucagucuucuguggaguagaagcugguggacacagcgagaaacggcgccggagaaaggccuccuccuucauggugugggugcuggggggcuucugaaaggaagaagcagggacauauggucagaccucaucuaaggcuagggggaguguucugguauguccacagagaggucaagggagggcagaccagguggccccgaagagugaggaggcaagauaacaggaggcugggugucccuggggucugcuuguucuauuuuuaggacauaugagguuucuggcccugccugagugucuguggucccaagacucaaaguccugaacagugagaagguacaggagugcucucacaggucauacuagcccaugauaucaccuaccugcuggaagcaguucugggaccaggggagguuacagaggaggaacuauaggcagccucaccacacucuugaccacuggcaaugucuucagcaggugacagguccucacagucucacccuaaacacagccugccagcugagaacagcuuggucagccaccucccaagccuuucccuguccaccggacagaagccauccaaucucagcuauuuuuauaaauaagagaaucacaaaugcucugcucuggagucuccuggcaggugcuggcaagcagagacuuuuuguccugcuucaucuaucugcuuucaaggacagguuuuucaauaguccacugaccagcuuccccucuugcccagcuuucuagggacauagccugagccuccguaguuggccaauggcuucucuuuuuccaauggccugaucccaaauacgcauagcauuuccugcugaacuuggggaccaggugagauucgggaaugggcagguaccuggaaugucaaugguuccagagguuucuguucacagcccaaagcccaucuuugucccaugcacauuucauuacuuaguuaagauuuccagauaacuggguaguuccaggcccagggcaacuaaggcaagcugggcccuuagggaccugcauagggaaagggcgucaugcagugugacaaaggguguugacauaauuggucucuccuacuggaagcuucacuuucuuuagggauugagugacacaggcuuggggaagaguucacagcuuccugucagccgucccaucaggcaucugcccacgugcaguaaguguggucaggggaggguguguguaaguaucuagaaggauucuucagaaagugcaccccaucauucacuagcauacacacuauucugucuuccuccuucccuccacuaaaucguucacuugcccaucuguuuguccacuccucucucccccuauucauccaucacccaccuacauauccaggcaucauuucucccuucauuagugucuauguaccaccuacccauccauccauccacccacccaucuaucuauccauccauccaucuacccacucaucuauccauccaucuauccacccauccauccauccacccacccacccauccauccauccauccaucuagccacccacccaucuauccauccauucagccagccagccagucacccacccaucuaccuauccauccauucauucauccauccauccaucuacccacccaucuacccaucuacccaucuaucuaucuaucuaucuaucuaucuaucuaucuaucuauccauccauccaaguauccauccauguauccauccauguauccauucauccacccucucauucucucuucucucccuaaaucuuuccagucagucacucagcugaccagccugguucccacuuccuucucauucacccauacucagacacaugaggugagaagggcagugacuacucugucaacaugaacagacaccccaaccuccagcccuaaugcaauucagguauacaccagaacagcuaccagcugguggcccagcagauucucucaaucugcccugcagagcuauccugaaacccuaacuccaccgucccucuuugugccccaccgugcccuuuagagaugccacugucacacacuaggugugguggagaugcaucucacagcccaggugaugcaucuccuagucccgagcucugcccacccugugccacuggcucuuucaccuacuggguuccagccaaccacagugggcuuccucacaguccuggcaaaugcugaacccaaacuugcugaaggaccucuguauggcucugcucugcucuuguccugcauccccaccccuagugcacaggcuggguuuugucacauuccacucagaaguguccucugggugaccacucuuuggcugcaacucugcacauucucugcauagcacuggaggcuccuagaaacccucccuggcaguucuuuguuaaaacucuuggggcaggagagauggcucauuugguaaaauguuugcuguguaagcaugagagccugagcucaauccuuauagccuauaaucccaaugcugagaaguaaaagcuuuaacucagcuugggguagacucugccuacaauagauguccuuccuguucagggucagccagaccugcuccuuagccuacauaggcugcaggggaagcagccaccucucuuccuccugcuggugcugacagaguggcuuuggugggccauacucacauggccaccugaccuggcuguccagcuacccuucugucuuugcucugucagaguccacagaagacagggacauacacacaucagaaagggacauuuugaauuuggcuucagaauggagauaugugacucuuagaagaacaauguucugaauggaggaugggcuggguguaccuggaacccugagguguggugggagaaguagggggcauguggcugaacuccugauccacagagaaugaaagcugggugucaagucagagacaguguggauaccaugaggcccaggcagagccuguucgcuggccgagcccauggaaaugggggugaguguggggcuugcaggcuccgcaucuugcuaagagaaagaggugugucaccauauccaccccaguuggccuaugcccauucucucuaccuagguagcugaagugugccucugccuccacaggacuuuccaugguacucuucuccuuccuuagagaaucagcucuuccacagaacacuuccucaggccacuguucugguaccuguguucuccuacaguuccuaugggaaucugugccaugccauauugggcuuguaugaggcacacaucaugugcugauuugacuacuuaacccuuccguacuccaugaacuggguauacccauggccauguaauaauguacuagcucauggauggaaagagggcucagaaaaagcgggaguugcuucuuuaaggaagguuccugaaggucuagcagguggccagacccaucccugaggcugugggaagugacccgucuugcuuuuccugguaaagcaguacuccucccuuccaacagggauagacacacccuccugagacccugacacccccuuccagacccucucuggauccuucccuaucugaaccccaggcucaugggccuggggcuuuugggauccuugcuguugugacaguaucuguagcuuccacugugcugcuaccucacggcaagguacauccaugugucugagcccgggagaagcaggggcuuggccagauuuaugacgcccacugugcggccaucuuuccuugaccucaggcaccuccucgucccuuuccucaggaauucugcucuuucccgcccagcugaguaucacaggccaccuaggacacaggaaggugucaggguaagagcaaggggagaaggcaguuccaacuccuaccuuggcccugccuuccacauggggccagauaggcuccucagacgcagguucccaucaggcauagaagccugaugugguaccaggggugauguugccucccagagcagacaaggcagagccagcacugucucugauccauuaaucccaugucccuguggacaaaggucuggaaagugggcaaggaccccuggccagcugguccaccucacacagaguggagacacugucaccuacguuauccucuuaaugaauguauuccuccaucuuagcaguuuaauccccaaggagaauaccccuuccagcugggucaccccuccaaguaagcgcuagcucacugcccuccagcuagcuuccaaacaaggaucugacugaccaucgaugcacaacucccuccauugcugacagacgcccaccuuuggccaaaacaaugggaucauuguggagaaaggucaaggccacacacaaagaggcagagaucugaaauccgggcccaggcuugucugagccucagagaaggaaucgaugaagcuguccauucccacacucccuucccauuccaccugcaugcacucaagcagauggggcagcucugaucugaguccauucugucauccugcagaggacuggggaccaugagaaguccagccccgaggccacacucauuuugcagcuauguguagagguucuuuuucagaguggggccaugagguaccuucagcagccaagggugcccauggcuggcacuguggacucuggguagcuuccucacucacaggccaugaggaucugcugggggcagacaggccaggaugccuggagagaggugaggcucuagcugcugggacuuucuaucguugguagaggccucccucucuauguaugugcugauguuuuuuguccgaguucauuaaaagcuauuggggugcaaacccuugaaaucaguucagaaaugaaggaacguggccugcaagcccaacuuuucugcagauccucuggagaacuggcagacucuauagaaugacagcagcuaucaccaaaaagcccuguccacaucauggccugcccagucucuucugccccccuccaacugagaggagucuuugauuuuggauacaaacugcaaucaggacaaugcucuuggugguuacauaagcuggcaugggacacuaugaaggauuagaggaaggacaggggcuagugcagccaggaagaggggccuaccaggggucaagaacucugucccacuuucagcccagacuugccaugugccuccacacauagaugggaagagaaccuggcuucccagggacaaccagacauguuucuggggaaagcgccacugcagucaaggccagugcucuacuaaaugggcaugccugaggggcucccacggggggagggcugguguugcagagacaccccaaguuuagcucucccacuauaauacucagcaugccucccccagugggauggcucugcaggucacuccuacccuagguguggacugauugagagacaagaagcugucauugggucacccaucagggaagcuaggugcugcccggaguuaccugcuugccuggucuagccccucacuuuccccauguagguuguacuacuuggauagaccccaagaagacuggaggagacaagguagccauagucucucuugcuuccucccuaauagcaccagggaccugauguccaaagggcagugacuaccauugcugguucugagaaucuugugcagucccauuggggacuucugccccagagaggcucaugcuuccuggauaugguaggucguucuggauccuggguguggcuucuaccucucaaucagaaagaaggauggguccuaaagacccagcaagccacguucucuaagaugguagguuggcuggcuggcugugugaaucuggugucugagaccaaggaggucaccagagggaccucugcugccugcgccauaccagccccaccacaugaucuaaggcugucuggcugccccucguggccaggagcuaacccacauggccaggagcuaccacacaggugagaugcaacaaagccagaccggccugaugucagagaggauggcgaggugagcguuucucuaccccuccauacguggcugcagcugauccuguggcagguccauauuguacugaccuuggcauguagucccugccagaaaacccuagaucaaguaacuacuggagacagacaucccacaguuacuucaacccuaccugcugagugacaaaggacacagaugugggagcccggaaguguuguggggaagacccaaugucaaacaccacacaacacccacaucagaugugcccacucaggcccuaguggaacuugggggacaggacugguggacacuaaauacuaaguucuagucuugggccaggcccagcucuggaucaggguaggaaggcuugcaccauauacuacaggguaucccaagguuaccuccuacccucccuuguccucuggugccaagaggcauccuggcuuaagaggguugaguuguguauuuggacugcaguggaacuuaaaacuaauaaccaacuauccaaaggcauuaggggaacucccaaggacaaggacacgacccucugggguucagccacgcagcuccccucuuuguguccaccuggcuucaagaacucccuaacuacuuguuggccugguccuaguuugggacaaacuguucccuccaccuccccaagacuuccuccucuucaggaaaaaacaagguucuagaucuggagauggaggaguuccucccucugaugaaaugagcaauggcuuccucacuugcugggguggugaacugagcccccuggucccaugagcuauaacccuguacauaugcuccuugccaggcuggagugugacucuguaccugagaagccacuccccaccugggcucauucaccuggggguugccagauccuggcuuccuccaugcaaagcuucagaccccacauguccuucugcccuaguuuguggggucaaccacacagcccccucugcuguccauaccaugagagccuucccaaagggcccggucauucuuaccaguggacacaggaccaaggaguuucaccgcagcuugguuggcaaggggagagagugacgcuguugaaagugagcugccugugaggccaagcuguuucuggguaucuagguuuggcaaguuuagucucaucaacagcucucucgggagccacccuguguuccugccccugcuugcugaauauggcagaugccaggcuggcagcaggcccuccuccuuuucucggccuccccacugccuagggccagcaggauccugggugcuugaaguaacaaagacccugaagauuuauagauggcucaggaguuaagaguauucaccaugcaaacauaaggacuagaguuugggucccccagaaaucuauguaaaagccggaugggugugguacccaccugcaaucccagccucggaaggcagaggcaggggaaucgcacggaaagcuggagacuagccauacucaggaacucuggguuuaauugagacgcucccucaaaaaaacagguagaagagcagucaaggguguuuccugacaccaaccucagauuuccacauguaagugcacacauguacauauucacauguacccacacauaugaaagaucauauaugcucauauguguacaacacauaaaaggggggggagaaagagguccaaaggcuucuagcacucucuucuaauuucugucacucaacagauguggcaucuggggcacaagccaccacugaaucacacaggaucauguggcuggucagggcaggccaggccuuacuggacucugccaugcucuacagugaccgccagugucugugaggaacaccaaaccaggacagcccaggaggagagcuuuggguggagacaccugggaacccacugcucuccuugccuugcucugcccccuccaagaacccaggaccccuucccauucacugcuuaggguaccccaccuacauuccucccccagacuucacccuaggcuguuagcuccuuuccauuuuacaaauggugaaacaaaaggcacagggaaacugaaacaugaggaaaaaugaagccaguugauuccuaguuugauuccaagcugggagcagccugcccugccagcccuaccuccuuuacucacccgaggccagggucucaggacgcuguggccucggaccucagcagaucucauuaucccaguuacuaacuggcagccucaugggcuugugaguacaggagggugacuacacuuggggggggggcuuguggauaaguagcugugacaauucucgccaccauaucucaugcuguggguuauuacuaccuuggcuggcccuucccugugcuuuguggagaaacugguucugucagucaggugagagccacagugagagcuacaggcaguccugacaaguggguggggcccacuacuaucaggugccacuucuccaccacacccuaccaagguaggaguaguguuugugggccuugcuuucgguuucucucuucacggccccugaacccguucccuggcaccaaaggcccacaggugggugcauagcuuuucagguggaagaguagauugaccagagaaccugcccacucuggacuaucuccauggagggguuggugugcucccuggcgggggucccagagaccacuguguagcagcucuuccuccuugucagaacccaccagaaaucuuaaggcaaccccuucugagaagcuccuccccuacucccauuacacagauggaucaaagcaaagauuacucccuccucaucacaaggacacaccacuggccaucccaccacccaucccagggaccguaggaaaccacaagggacacucagucuucugcuauggcugcuuggccaguucacuaguacugagauacagauggguccagagaccucucccccugguugguccuaaguccuagagccaucaggacuaagaaacaguucuagaggaguggugagaaagcuuggcuuguccuuaauguccccaggccuaaauuuggaucuguacacugacaugcuggucacacucugaaaugacaaguucuaaaccagaagcacagccacaggccccgugagcagcaggugacaggugaaaagagagagaaggggcacgcaucggggagaugcagcgagcgcgugcacccacucaagcccccaccuccacuugcacaugaagucugaugcuaacagcccacuacuccugcuuuucucucgucuuugggggaucuccuccucaggaacugaagccuuccaggcacacugcaugcagccuccuacugauggaaauaaauagcuggggggggggacuuccuuggccuuugacaucagcuucccccaagaggagaugcauucuuccccagcauagcuuugacaaagaagcacacacaauggcuuaaagguuuauuugcucauaguguagaggccccaaguccaaaaucaaggugccagcugagucacagugcccccaaggacuccgagggagggaccugccuugcuucugugccuucugugcaccccaggcaucuccuggcuuguagcugcaucuucuauacgacucauuaguucuccauggcagaucucuuacuaagacccucauugucacauggaaaggcccucccaagugagagcaccuucacaggccccagggaugagggcuuggguauauucgggggugggggcauuacccgacaccguauaaggaacaucuggggcauguuggaagccucggggugcggggucagcucauuauucagcacccacccuuggaggagaacacuggcugaaaggcuagaagcuaagcuuggaaaacuacuuuguaggaucagcaccagguucaguaaggcagagggaggggugcaggaacuguggaaaaacagggagcccauggccagaaggugcaggaggagacacagucuggauucuuauugucaaggaccccauuuucuuugcuuccacuauuaugccaacuucaccuuacccaggccaggccugggccauguccugcuaaaggcuccugaggccugaauguaguagagucacggucccagggcaccuacgcucaagguccgucuuugcaugucuacccugaaaugauauuaccaaaauguccacuccaccagccuccacaaucccucggauguaggcuuuucaggaauugggaccagccgagagaacaaguagcaagcggccccugcagccacagcagccacugcaaccacugcagccacugcaaccacugcagcagccacagcagccucagcaggcacagcagucacagccaaaguagcagcagcauaggucucauucacuaagggugcauggcuaaccuaggcucguaggcccucguuuguuucuaagaccacaaguaguaggugcugccaggaugcccauuguguauaaacauaaagggguaaagcuguggccuuucucugguucuggaggccccacccuagaguaaagguauacuccagaauagauagucucuugugccugcucuagcugccucuugaucaucaaacaaucugucucccaaugacuaucaagagaugguuggugccaggcaacugggagccuaaugggcggcuauggucauuacuguuuagcucuguaugguagcacaagguccuuguuuccugcuuccucucuugcaccugcucucccaaugucaugacuacacacacacacacacacacggacacacacacacacaaggacacacggacacacggacacacggacacacaagccuauguaugugcaucaggucagaggugucaaagcaccugagccacaagcuucugcauuuuucucaggguggcgguccccugcuagaggccucugaugcuguugucagggcagggggcgcugcagggcugugagaggcaauugaggcagcuuccccagacagaaagaccuggucucaggaguagaguccuggguccccagggagcagacagugcaguuuggguuuccuuguuuggacaagggcuuuucaaagacuguuuuuccguccccaaguaaacaugcugacgcaauggcuccuucagguuguccucuggggcagaggacuagacuaaguauuccagaucucaagagggggccaggagugauccaggcacccagagcacaugcaacaugugcuuaacauuaacacacaagagugggccaggagggaugagcaagcucgggucuccaaggcaguagaaagaucacuuccuggugguccacagaagcagucugcccucaucuccagccugaggaaagacuacacagaagaaauucuguugucuuguccucuguggugguggcccaagaugguaacauaccagguagagggaccugaagggagugggugguccccacccacguaugugacauuagaaaucucugcucucagcaacccaaaggccuuagaaagucgauguucaaggugaccugcugcugcaucuaaacccagcugcauggcuugccccaucucaugggcccccaaacagccuugguccucuccacacaaagaacaggggcucggaggugaguucucauccugacucccuacccaguacuauccugauucuccugcuccucuuuaauccacugcugcgcaccugucugccagaacccaggagggaaagcaagcucugcagagagcuacugaugcugcaggugccaucccaugcccgaaagugaggaugggucccaggcagcauggcgacuggauggcugagugccuagcaguuggaaugcaacuuguuuucuuccaguccccauguguagggcccagggucggaucagcucgugggcccccugccugcuccuggggaaaggcucacacucagaaccugccccugaagccgcugcuuugcucccugacagacuagaugaacuccugucaccuguguuuccugaugaaacuggcagcuuggguggucuuguccagaccaguuggagaagcaugagagugucuugaugcacuuuuggucucuugaugcuuucaaggaaaaagggucuggcucuuagaccuccaaaucugcuucccccgucuaucuguuagagacaaugacccuggcaaagccuguggugguugaacucuggucaggagaucauuccagcacucaggaguguuuggggccauccuggacuacauaguaacaaacaaacaaaccaacaaacaccaacucucaaaaaugacaaaccaaaaccagacaguaaagcauucaguggcuacaguauaggcaggcauucuguucuugaaugugauuuuaguuagccauguagcauagcagauacuagccaggcacaagggcacacacuuguacuugggaagcagaggcaggaggauccugugugugaggcuuaccugggcuagucagugagaccuaagucguugggccaccuugaccaggacucaguagcaacccaugguccucucagguuaacacacagugcucagucacacugcuccaaggcuccucauuagguucagcccaucucaauacaguggcucucuaucuccauacugcuuaucucugaacucuuucucagagaggcagggaaggucuccuagacuggguucugggaaaucuguucuaugccaggaaggacaucugcuaaacaggggccauagucccucgccacaguggcucaugcuggauuacggucaugaauaugauacucagucuugacccuaggaaggacaagguuuggaagcagccaaggcugccuuggagucuugcuccccacggagaggucccagggcuuccugcugacaccuguuagaacaugauuggcuugcuuguguuucuuaauuuuuaaauguuuuauguguugacuguuuugccugcagguaugucuguguagcacauacacgccuggcguccauggaggucagaaaagggugucagaaccccuggaacuggagucauggaagguugugagccacgaaguggguguugggaacggaacccaggucuucugcaagagcacccaguucucuugaucaccaaaccaucucuccaacaucugucacuccauggagugccaggguucagcugaucuggccagauaggcagauauuccaaauguucccauccuuccucauggcucuaaguaugucccucaggaagcuacagugcucaauccuagaggauaaccuuuccugaauagagaaguaugggucuugggcugaggcucccuuguucgagccuccaaauaagucuugcucacauuucuaacaccaccacuuaucuguuguuccaggcagcagugaacauagccccucccacaggaaguuuaaggaauuuggagcccagcagcagcagaggcucaauccuagaacaccgcaccauuucucuacaccuuggguuuauggcacaaguaucacuuugggugccgguucuaacucuagccuuguauucaguggugaccuggggaagaucuugccaccucugaaccucaguguccccaucuguaaagagggcaugaguagauguuagccauuaaaaggccuucagggcucaggauuuggcugcugguagaguacucacccagagugcaugaagcccuggguuccaucacuagcaccucauaacccaagugagguggcaccuaucugcaaucccagaauucaguuaauggccaucuuuagcuauguaguaaguuugagaccaaucugggcuaccuggggcccuaucucaagaaaaagaaaaaaagaaaauaauuuuuuaaaaagggccaaauggucuacaaaaugaacuuagucacaggaaauaguuuuuuuuguuguuuguuuguuuuuguuuuuguuuuuuuuuuguuuuuuguuuuuguuuguuuuuuguuuuugaggcauuguacagcuagcccugacuggcuuggaacuggauauguagacuaagcuggccuuaaauucaucgaccugccuuugcuucuugagugcuagaaucaaaggcaccauaccuggaggaagagggucauuucucauggcacuuaagguuucaaggagguaaguccuuggugccuuuauaucuaucuauuuccauugagcauagaacagaguucaaagcuuggaucccaggaagauuagcagugugaucuuggcaaaagcaccaguggccugcagaagcuccuaaggcccacuauggcugaugacaaacaccagcauccucagugggaugaggccccaaggaugaugacugaccacagucagugggcauaggcgccugcuggacauacacagcuuguuccccaaauaggcgagguuugcaaauaaaugggaaaacagacucagguuaaaaauaacgcacagggugagggggguuauuuaugugcggucguucauuuaaacugcaguuuacaccaacggaaagcucaggcugccgggugacacagacccaaguugggaaaaauucccgagugauccacguguccaggccacaagggaugggcuguuguccaccaaggcugccugggaggagcuuccagcuuuccccuuacacugcauuagggcucucagcugagcugcugagggcacaggcucuggcagcagggagcccuggggugucucccccuuuuccauaugcagcgucugcaggagugccagggaccgagggagccugaaaugcccaagggugcugagggcucucuaccagggucuauagacagugccugauaagggaagcauagaagacccagggaagaccccagaccuucauugccagugaaaggcaggagggugggccuuaggggugugugaucuccucacacaguggaggcagaaagcacucaggaaagacacagcacuaauugcuccccagcuuauggauucuggccuaggaaucuaugauugacaggaggcaggcagcccuaagguagaaaugaccagugaguggcaggacaugacuguggagguuugcuggcucuguauacaggacaaccuguccaacagacuuccugcuugcucuuucagugugaguccuaaaugguuagugcuggggucgccaugcucauuuaaagcuugacuuacgacccgcugagcuuucugggcugacagaaaacagccacaguuugaacagcucaaugcugacaaaguugauauauuuuuauggguacagaagucugugaucacaucacagacacgcgugcaaggccauuuggcaccguaggcaacagugggccuugugcuagcacuggcuccaugcagacccugcaguccaucagccagacuccacccuucuggauucucagggccucagggaaggucaggccaauuuuuuugguuuuuaauuaacaaacuguauuggccaauuagaaaugcuggaaggccuggcaagcaucugugggaacaagccuuuauucugcaagcugggggugagggaaccauacucccuauaauaucuucccucuaaauggauuagaggaauugaagucuucuccagcaauagaugaaugcaugugguagauagagcccccaaggccaggagagucaggaaugcacuccagcuggaaugugaccacaucccaauucaaugaugauggacaucccuuagcuacccaucccuuagaagaucuuuacagauaccuggaaagauaccuggacacaguacuccagccagagagaauggaagcaaacuagacauuuccacacaaagcaagaaaaacaggaggcucucuaaccacagagcagaggccagcugccaaggcugggcacuacuuucuacagcaucugagacacaagcagaaggaaggggugagcagaaugaaaccccagcacucuggaagcugaggcaggaggauugcagugaguuccaagccagccugggcuccagagagagacgcuaucuccaaaaaccagacaaacaaaacaacaccagauugagacgggaccaugcauaacuggagcccgggaauaguguccacucaugacagcccauccuccaacaguaaaggcacucaguggaggccugggaauggcuacaaggacaaccuggagcugcagucccuagggaaggugcugcagcggagggacugcacagggaccuuucuuccucccucagcaguaugacugaccucucagaaccaaccugaaacagauacagacaaacauggaugccucgauaaagcuggcacacucugacucuugaggccagcauggcuucgauugguuuaugugguuucugaguuuaaagcuuucacaaugcuugauuauuaaucgacguuuuuuauuaaugaaaggaagggcuucuccccauuuugagaucccgugucaucucuaaacaaaaccguguccuggcugaaccuugcacucacaguagaucuagcucaugcucuugucgaaucuucucagcaucccuaccagccuggcaacaggacaacccauuucacagaugaacaagagaaacugaggucugcacauuccgggucacugggggugggagccucauggcuaacaauccagagucuauaugccuuggugcucagcagacaccuaaauggcacagacaugucacacagcaaccgugggacacuugcuggcuagagagaagagugggcuccacuaagcuuggauagaaggaaguugggaccaguaaggcagcagggagauucuagcccacagagcaguugugucuaaccuuuugacacaaccuuugacaauaggauaggacauugucuuaguuaggguuuuacugcugugaacaggcacugugaccaaugcaagucuuauaaaaacauuuaauuggggcuagcuuacaggucagagguucaguccaguaucacaaacaacaacaauaacaaaagccagacucaugcccggcaauauuuuaauaaaauacaauauuuuaauaaaauuuaugcuuuugucuugggcuauauucauuacaauccucagccuaaugaggugcaccagccacagguuaaacauccgaaagagggauaagugaggccuaugagauggcucacuugguuaaaaaaaaaaaagacacuugccagcaagccuugugaccugaauuaaaucccuggaauuuauaugguagaaggaaagaacgaccucaccaucucccacaagcuguccucagacacuauagccccacaaaaguuuguuuguuuuuuccuuuuuuuuuuaaggaaggaaagugcuggguguaguacuacacaucuugaauccuagaaaccaacuggcugaggcaggcagugcucugagacuucaggaccagccuggucuagauggggaguuccagaccagccagggcauguaguaaugagacucugucucaaaaaauaaauuaaaaaaaauuaaaaaaaauaaaaagaaagaaagauacagaauauugaguuagacuaaugauggcccacccugaagaaacaggcuagccuccacuaauguaggugcccugaagaaacaggcuaauaucuacugaugugggugccagaagauaugggugauaugaaccggguauugggugcugaacccaucccaaacaucuugcauguacuacacaccuguuggggacacugggucaaugucccagacagagacagggacaagauuuucauccagggcaggauaucugagaggacagagggaugcaggcacuaagccagggccauguucggggcagguccacagagccaggccuauacucaggcugguuagauagccauauggccaccaacacuagcugccccgagucauacugaaggaaguaggggugaagauggcugugcuccugaccaccagcgaccucgauccucuaccuucaguugagacuacaggaaaagugguccaggcugcccaguucaauuucuccugggaagguagacacugguuaugguggaugccaucgggaaggacuuguauugggaaagagcucacugagaagaaagggcagcaaggaugugugucugaccaccuauauucacagagccuggacaagcccacccaagcugugcacaccaaucugucccucaggugucaaacaucaguccucuauccccuuuaccccaggacccucuacaacagcuuaccugucuggccauuggcaauagcuagcaguggccacugaguugagaccagcaagcaagcccugcccugagcagccucacccuuggguuaacauucugggguugaauuucugggucaaagccaacagccucuuuacaucccaaacucccuaucgauauguagccaaaugccauccucuuccuagcagccucgccugcccuuuggggaccugcuuuccagggacuugucauucuguugcuauucagaggcagaaucuaggccucucagcagcuggggcccacgcuuuccugcaggugccaggcccaaaguggaaacccagcauagcgccacagugggugagggcucccuucaaagcuggcugcucugucccucugcccacagaggucaaaggaugccacagggcaucagguaaagguuuguugcucaugcugguaccugcuuuucagagcugcuucuguccugguccagggacugcaggacaguaggguggggccacgggaaagugggcuuugucaccaguagcagguacaucagcuguggggaagccacacaaggcugcagguuagacacgagugcugagugacacugaaugcaucugucugugccagugugugagagccugugggagggagggguaaggagcagcuuucaaacuccuuagaauaaacagaaacuuuuugugcaaaaaacauguugugacucuaaugauagaaaaugguuuaaggagcauugugggguguguguguguguguguguguguguguguguguguguguguuacucuguggagaaccucuguuuggagaaguucuugccugaacaucauguacuuacaggagucccuggaucugcugguuagaggacagagucagguaaaggagccuuaaggauagagaacuugaugcuggguggaggaaaccuuguauuccuauuaaaugagagcuggggcaucagcagcccaaauuuacccugagaagccuggaaagggcuggagaaacaaggcucaggauugggcauguggaacucuggaacaagaggguagcaucuaaggacucagagcugccagacccuucccacagccaagucuuccuaggggacaggcaugcuccagaggccagaauggccugggaauugcuaccaccccugccauucagucaucuuggagacggaauacuaguccugguacccaggccuggcuaaugaaagaucugguuuguaagccaagcgaugauugguaggcaaaugggggucagaaauaggagacuccacaguucuugaggccuuggaucagagggucucucuggaccugcuccacgugaagauucugaguugugggaucccagcucuguaggcgacagcaggcaugcuccugacacuggggucccacggaaucacugccuuucacagguuggguguccaccacccacacagacagcuuaggauagcugggacugaggcuaaggucauaagcagagaaggagcuguaaagggagggacgggcaggucuugaguagaagcaggguccacuugggauuccgcccgcagaaggcccguggugacagcaggugggagugccaagggagaugauggcuagagaguagacaccuuugacugggauuuuaaggaauauaaaauacacucagcacauaauggccgaugucacccaauacuggagacuucacuugaguccagugauacacacaaugacagguaacuugaagacaaagaaccaucauggcaugacacuugggauacaacauuucuguaagguuuccauggccaggccuuuccauccacucauuucgccaagggcccugcgagucucagaagccagguaugguaccagggaucugacuggucugagugguuugagcauuugggauuguggcugauugaaggggccaagagugguccagagcuuagcagccccucacuguccuggcucacccuuccagaacaaagaacacaagcacuacuccagucccugccccacaggcugaaccccugaaugaaggugcuuuugugauacagcugagcacaaaguuugucauguaaaccagaaaccuggccugccuucuuccaccuggccugugccuacuaaucaggcccaggcuccucuaccucuguacuugggaaagcagcacuggcuauaucaauggaccagaaucugggagguggcuucccuccuagccugaaaaaaaaaaaaggcagaggcagaguucagacaggagccaccucagccugugaguggagaccacuucccaggccugauccucucuaagggaccugaacucucuauacugcacucacccagagagugugcaggauccccacccaccugcccugggcaugccugcccgugugccacugccuguauuccuguucacauucucagguugggugugagaaccugucccccagcagaaaggaaaagguauaggccaacaaacauucucugcauuguuccugaaggccuggcuucucccuaugcacgcacaccgugugcccaccaaccccuggagagaugguucugugacuuuacagguuuccaaacuccccaggccuuuguccagggaagguaacuccacaccaggccagcauccugugaauaggagaucucuuaagucucuacuuaaguuaugagcccuggugaguuaacucuuuuuuacuaucugacuuugagcaagggccaacagccaccugcacauaccacauaaggauacaggggucuucugcaccaaggcugaucugcaggagucauuccuaauucagaggcugaaggcugagaggcaagagucauacacaaugccacaguaggucuccuaccuccugaugcugggaaggcaggggagggaaaggcaagguggacaguuggcuucagaccugccacuuucuggggauuuccuuucuaaucucacacaaguacugaaggcugacuaugugcccagcccuggggauugagccuagagcucacauucagagagcagacaaugaugcuaggugacaguacccucucgcaggcugccucuggcccaacuguucuccgaauaucuagacgucaaauuaaauaaaucaagauaacuucagauauaguuaaauuauguuaagaaggaaacaugagagcuacugaauuuaaaacagucacuuuaggacagggacagagggugucuggggaggagugacaccuuugguggaaccugggucagucaugaucagaucugggaaagcugaccacagagauugcagucagugcaaggccuugagguaagaaaaccaggcaugcggaugagucccugggagugaggaauggggggaggugaaagcagaagccagguguagcucccuugggaccaugagcuuacccagagacccauggugaauagaagagcugugaaaggucaggcuauacacacacacacacacacacacacacacacuccuuugcaccuuggcugugcugggaauagaagccagagcaucacagacuuggaauaagugcucugucccuaaguccagguguguagaggcugcucacuaucugauggcuggaggacuagguaggugugauaggaagggagggcuagugagguggggaacacugauguccuaugcaggagcugggcggguggggagcugggaaagucaugugaagcuugagcuuagagccugagugacucugagccuugaucaaaggccauuguauauucuagguucuuccauacuggucaaucuacacuggucagccaggcuccugccuugaccuauaaaggcuuucucuuaugucucaaugaccuggauaaccuuaguaaggcuacauugaccagggugacccuaggggucugacuagguggcuccccaccuuuucucaaugguuuuuaggccccucccaucccacaggccuaucaucacccucauaaggaucccacugugggccagucgucugcacaucugccucuuauccuuccuucuuuaugagguaugaagauuccccagcuagaucuguggacaaagaacuccaagcuggagccucuguuuugcccuaauggcaucccaagccuuuuccugaugccaugacuggugccaguccccucagcugagauggcagaacaaggcaacccgcuucccaugugugcaugcuccugagcccacgcuuggaaacugcaaugcaaagacauucccaaugggaucccaaauccaaauccaaggguccuugaccccacugcaaaauuccuuaucuaugcauauuuuucuaaugagugaucaguaaacccuuagggaucugggcagguugugaauucuuuaucuuugagcuaaggcucaguaagucacaugaggauucacagagaacaguaguuuuccuacaggacagccuucaauagcaacaggacaucaucccaggacaggcaguauggcuuuuagugggcagccuguggaaaggccagcuucacugcccugccccacccaacacugaagaugcucaccugggcugcauacagcccugcaaacagccugcagugccuccagggaggcguuugaacucaauaggcccccgugcuugaggucauuuguaucucagagucagaauucaagcucccagacccacauguuuccaagaagcagccccacgcucugacccacccuuuucuugaacaauaaauggggaugaaggugggacacaccccuacuaccuugagcaagcucaguaccggugugccaggaguggcgugugucuacuuguauguggcugugaaccacagauggcucaaggccccaguacagacacaauacauaauucuagacacaauacuccccagcaugugccauuucugucucucccccacccccuugugccaugccggaucucuacuguacugagagugcuucuuggaagaagccugggugacaagggaaacugacccuggauaucuucagcauggcagacacaaucagggugugggggaagagaugccuuagguauuggcagagagcccagagccaggcuuggaaggacucacaccccuuggcugggcaggagaaccccucugacauccaggauuugcugcugcucagguugggccucagcacagccgucucccugagacaaggcacagcacugugggggaguagccucacccagaugcuucacccuucucuaaacaccgccuggcgaaagcaaaccagacagaggcaaacacuugguuccuuggcacccaggccuuguguuuguuaaaaggcuccacuccgcugccccauacacgugcaggcagacaauagaucugcagucaggagccugaaagggacagccagaugucaccacuugccacccagaucacccugauuugucugacaccugcaaagcucucugcgcuccucuggaaccccaccaaguucgaaaucucagcaagcacccccaccuccauccaugcugcugcuugagcaaagauauuggggcagaaauguaguaaggaaagucagccacuuggcuguuaucgcaagggagagggggaaaugacagacagacggacggacaggcagacggaugauggggacauggaaaacaaacucaaaagugcaauauccaccccauccaagggucuuucccacuucucuaggcccugacaccaccacuucugcuccugugaccagacagagguguguagcagaggcuggagccaaagguugauacauauaggaaccuuuaaguacagacaagugggugacaagucccagggagaaacagagagcaaaagacaagaaauucaaaucagugguucuaguaagccaagcccagccuggcucagguugggugaggggugaaaaagccccccuuggcccuaauugggggugucuacccacaaccccaggagccacucacaacugggaucagggacuuggaccuaaaaagccaggauaucugaagugggaggcaaagccagcuggaccuguggcugggaggggcucaaguccuacccaccccagucguagaaauccgcaagugcagcucaagucaucuggacaaugccaagcucccucccuuucucucagggccaaguccuaugagaggccauggguggacagaguccaagggcaagaugggucagcagucacuugcucugcggacccugacgaaccauccugagaaucaagccagggaacugagaucucagacccaagaucuuacaggaccucuuagacaccccuucccugcuauugcugggcugggguacagaccccuccauauccugggucggaggcugccagacccucccacccauucgccuaguccugacuccuuuuagccucaccaagugggaaacggggcuggacaugccgcacccacacgcgggccccacccgccacccagaaguccccaggcauuuggacuccccagccaggcgcuguuucccauacaagcugcuguuugggucuacucggaucuaugcaggggcucccccagaccagccccugagggcuccccgacccccacgccggcucuguggcccugaagccucucaggcccgcugaauccccuccuggccuuucucggccuuccaccagccccauccuucccgguccucccagcagcggagcuccuaccgugcugguuguacucagugcuggggccgggccgggccgccugggcccgcgaggggcucagcugucgcugagcagcaggaaauaccagagggcugauccaggcgaggcggagcgagggagcggagggcggaggagggaggagagcgcggcagacgcaaaaccccggguggaccaagggcggaucggcugcuggggaggcacgcuggggacccaguccuugcccggagccugagccuccuccccggugcaggcuggggggcauaggaauccuuaaguauagacaagucgguggcaccugcgcgccagggcuggggacaccgccccacaaauagccaaaggaggggaggguggcgguaagcagcgcuaaucuugggaggggucuucuauuugagaagcauaccugggugcggugcccuuccccuuccagaacauaagaccucucucucccaaaaccaaaccccacuguccuuguccuacacaggggcucaaggggaccccuuggucaccauccaugauucccacuacacuucuuucaggaugccuuggcugagacucugacucuuggggcuggagagaugacucagguuaagagcauaugcugaucuuccagaagaucacagguccauucuccgcacccaggucaagcugcucacagccaccuguaacuccaguuccaggugaucugacaaccucucuuagcaccuacacccaugugacaucacacacacacaaauagaaauaauaauacuuuuuaaacuaauuauccugauaaccaagaccuccuaugugucuaccacccuuuaccacucuccaagaacuuucuagacuccucaauccucuuguauuuagaagacacuuuucuaauuugauaccacccauauauagaggcugaucuuagaguucuccagcugagacccucagcaugagguucuuugggguguguguguauguguaaggguccuuccuguagaguucccaagagccacccaagcaggaaguuuagccugccuccuccagccgcuggaaucagguaggacacagaaagguauagaggcuuucccagcagaaccuucuaccccaggaauaccggugugagugugggcagagccccagcugauucccacauuguuaguaggugcuggacagcagaagugcuuccaggcuaugggaaaccacugcugcuaaaagccacuggguagggcuguggcgugcaaaccuggaauagacaacuuccagucucuguagaccccuuguccacucagccuuagccaugccuccccuguuagacagaggcuagggguuccaccuggugggcaaguaccagcaucuugugcacagguaaggaacuuaggcgggcucauucucaguucaucaugggaccaucccuacccaaccccagucaccuggcgaggccuucggaugcagaacugcucagacaagaugcucagggccauggugaaacugccuucuugaggucugagggguggcucugcccuuccagcaggacugugugcagugugggccgcuucacagauggagaccagccugccugcuaggucugccccaagcucaaacaaaaagcuggguguggcugcuagaacccaguaaaucagcaguugcuagagccaguccuugagggacucaaagaagaaaacaaggucccuguccccuggggcaaggucucagcaaaauugccuucacuugcuguuugaauauggauuauaggagccagauuacuggccaaaugggggaggcuugugcaugauagcaggaagggugggcugaggaacacagucugaacgagauugccccagugccagauggucaaguggggacugaggaagugccaccugugugguucagguacaggugcauagcugcagcuaggcuucccugaagucuccauccugcuccuugcagggcuggaaaagguauucuugugaaugaaggcaggcucuaaucuuucugcugcugagcagagcacugucacgcagaaccuuguuccuucaaggucuuugucugcucuguuuuagacaggcucucacauggccucaaauucacuauguaguggaggaugagcuugaacucccgaucuuccugccuccuaccucccaagugcugggauuacagguauaugccaccacaucugguuuccuguggcauagaacccagggucuucuauauuucaggccuaugcucuaccaacugaaccauauccaagccgaguugaccuucugaaugaaccuccuuuuccuugacaaaugagcagcaugugcaugguggaagauggagaccagaggaaagagucuuggagcggggcugugcaggggucaugugggcaggggcacacugaugaguucuaaggccugggaaagccuagagcaaguuuaugcaacucuccaugccucuguuuccucacauguaaguugcaguaaugagagcagguuccggcuccagcugugcagggagggagagcuuggggcauccagaagucagggcagccaagacagcagaagcagcagguuccaggagugaggaggcuacacccuugguauucauuggauggucggggcggccaaguuggaagaagggcaugaggugaggucaaggaggcuggaaggcuuaucuugccugggugauauguggauuuuggcuuuauuucgacugaagugaacuagauagagauucugggaagagaaagaaugggcuuauuuguaugugcgcacauggaggcuacagguagaccccagggugauuccucaggcgcugcauacucggcuuuuggaggcagagucucuuauugagacuagaguuuaccaauaaggcuagacugguuggccagcaagcaccagagagcucugugcuuuaaccugcaaugcagggaauacaugugugugccaccauacuugacccuuucuuuuuaaaacuugaguucugggacugaaauucagguccuccugcuugcaaggacacuuuuuuuuuuaaaucaacugagcuguuucuccagcccauugaucuuauuacuguuuagaaaacaaacaaacaaaaaaaaccuguccauacaggggacaagaaugucagcaagagacugggauguggcucuauaguggcacaccugccuggcauugguggccaauagucccaugaaagaauggaaccagucuuguauagaagcuagagagaugccucagugauuaaaagcaccugcuacucuugcagagaauccaaauuccuaaguucgguucacacuggguagcucaaagcuuucugucacuuccacuccagggaaucugauuccaucuucuggucucacuaugcaacuguauucaugggcacaaacacacacaugcauacacacacaugcauguacacacacauguacacaugaacaugcaugcacacaauguacacaugaacaugcacacacacacacacacacacacauauacaugcacacacuaaagguaaaauaaaaucucagcaaaggagacagagggauuuggaucucugugaguucaagaccagccuagucuauacagugagcuccaggauagcuagggcuauacagcaaaacccuguuugaaacaacaacaaaacaaacaaacaaacaaagcaaaauaaauauucaaaauggagagacugagguugauaaggacucagccuguggccuucaggauagggagggagguuccccgucuaagguggggggagccacagugucuaggauggaguuagggucccagguggcuccccaccccacccacauggcuuugaccuguuugugccucaguuucccuauuuccuuugaagguaauacaaauauggauuucaagaagugcuaagucuccacugggguaaaugaggggcacauguuuucugugucagagcacuuugucaaaagauuuggggcuugaggcucaaggguaauacugagguagacuguucuuuugguaagggauuuauucagaguuacuaaugccaaaagcagacagacaaacagacagaaagcagcagcuuggugagacuccgaggagcauucaggucccagugccacaaacaaacagcacugugggguuucugaugaggcuuucaggcccacaaagagagcaguuucucuucuuacaggucucagggaaagggauuuuucaugaaauuaggcugucuuugguuucuggugggccagcacaggagagaaagggggucuuucccugccaggagugaggauaagggguggcaaggaggcaggucacauccagcuguggcacacccucuauaugggugggggaugucccaccccauagcccuaugaaggccuggggucuggcagucugagccuguaaguguccuuggagccuugugccugccuuucccuccuagaaucccgcacuuggucaucuuaggggugcagagucacugacagaaucuggguagggguuugccauuuucuuuacagaagggagaggcugcugcaggugggcguggccugaguaagaaucuggucuggguucuuucuuguuguaauuaauuuuucuaugaguugcauauacaaggacuguauuuauaccgucuccacugcucuggauucucacauuugucuucuguaacgugcacugcgcuugaccuuaucugccaaccacaaucuccucacugucaaagcugcucccuucucuccaggaguccccuucccuggaguggauucacugcagaugcugugacugagugacugagagcuuccugacaaagaggugacaaaaagcaagcaagcaagcaagcaaacaagcaagcaagcaagcaagcaagcaagaaagaaagaaagaaagaaagaaagaaagaaagaaagaaagaaagaaaagaaaggaccacacccagugccugccggaccugcuggugcucaccuauacucccaccacuggccaggccaaccugggcuacagagggagacccuguuucuaaaacaauuagaggaaaaauagaaacaagcauaaaaugccaaccaaauccaaccaugugugaauaccaugcccuuaugaggagagagagagagagagagagagagagagagagagagagagagagagagaggaagaaaggauccaacugccaacguccaucaccaucacagcacacugaggaagaaaagccacauggcccucucuuuucuccugaugggagcagagcgagcacucagcagaacucaggggcuggagaaagggcucggugauuaagacugcagcagucagaucucuggucuacagagccaguucuaggacagccaaggcuacacuuugaaacccuguuucaaaaaaccuuaaauaaauaaauaaauaaauaaauaaauaaauaaaauuuagaaaguguauacuguucucgcagaggacccagguucaguucccagcauccacagcaggcagcucccauccaccuguaucuccaggcaugagaaaacccacaaugcccaauaccaugggcgacagaggaacaucaaagauuucuccuugggucaggaccagagcaaggcuguccacagucucacugcucuucaacaacacuuggggguccaggucauuucagugggacaagaaaaggauguaaccagagcacaccccagcacugcaaaacuaagcacaacacccaaaacuucauggggcagagacuggugcucaguggcacagaucuucaguggcacagaucuugcccagcauacaaaaacccuggcaucuugcuuuauugcucuguugcugugcuaaacaccaugaccaaaacaauuuauggagggcaaggguuuguuuggcuuacaggccgcgguccaucauaaagggaggcaagagcagggccucaaggcaggaauccagaggcaggagcugagaguaggcaccacagagcaaugcaauuacuggcuugcucagucugcuuucuuauacagcccaggaucaccugaccacagugguacugcacacaguggucuggacccuccccaaucaaucauuagucagaauaaugaucccucagacuugcccgcagccaauaugauggagaaaauuccucaacugagauucucuuuucccaagugacaccaucuugggucaguuugacaaaaacccuaaccagcacaucuggccuccaucccagcacagaaaaugagaaagaggaggagaugagaaggaggagaaagaagaggaagagggggaggagaaagggguaugaggggcagcuaggcacacugggaauggagaaaugacguugccucugucugcacgaaauauaugcuuggcccagauuacggacauauggguuuguuuauuacuaaaauguaucgaguucuguuauauccacuaugaacgaaaacauuuauuuguaaccacuuuaaaaaucuuuacaaaaagacauggaaguagaagggugcagaaguaggugugggaagugaaggggaaucucauacauacacacaauaucaauaucauacaaacacaaugcaacacaauaucauacaaacauacacaaugucauacacacauaucacacauauaugcauauuaacauaugugcacaauauuaacaucauacaaauacauaauaucauacauacauacaauauugauauaaaacauacaugcaauauuaaucucauacauauacacaauaucauacaauauuaauaucauacaagcacauauaauauacacauauuaaucucauacauacacacaauauuaaucucauacauacacacaauauuaauagcaaacauacauacaauauuaauauacaaacacacaauaucauacaugcauacauuaauaucauacaaacacauaucauacauacaauauuaacaucauacauacauaauauuaacaucauacaugcaauauuagucucauaauacacacaauaucauacauacauacaauauuaauaucauacaaaauauaugucauacacacauauuaagaucauauauacacacaacauuaacaucauacauacaauaucaauaacaugcaauacacacaauauuaaucauaauacacacuuuauuaacaucauacauuacacacaauauuaauaacauacauacacacaauauuaauauacacacauauuaacaucauacauacacauaauaucauacauuacacacaauauuauuaucauacauauacacauauuaacaucauagauacacacauuauuaacaaaaaacauuuuuaagaccuaggcaaccaaaccaacccccaaagaaacccauuguuuugugcaaguaauguauauuaaugauuuuuugaacuuuuauuauaauuaguguuguuguguguguaugcugugcagagggggcacugugugguagcguguguguguguguguguguguguguguguguguguguguaggucagaagauaauuucuuccauguuuaugugaauuccauggauagaacucaggcucucaggguugcaggagagagggacaaacaaauuuaccuguuaggcuacuucaacagcccgacaauuaaaacaauuuuuuugagguagcuagacccagagagaugacuuggugguuaagacaaagcaccgcuuugaagaggaucugaacuuggucccuggcacugucacuggggcucauaacagcuuguaacuguacuuccagggcauucaaugccucuggccucuacaggcaccugcguucaagugcacaaaccuacacacacacacacacacacacacacacacacacacacacuuguaaucauaauuaaaacuaaaaguaaauauuuuuuaaaaagaauugcuaauacaguuuugaaagaaaguaguggaagggcucuugccacuugacuuaagugaaaacauccaagaaucaauucugugcaguauuaguguuggcaaaagaaacaaugcagauuaacaaaauggagcugaggccaggaguccaugggacauugguuuuggccacagacacaaagacagaaaaggcauuucaguggagaaaaggcaggcugccaaacaaaaggugcugugacaacuggccuuuucucugcagacagacaaccuggauccauucugccuucguuuagaaaagugucggccagaaccauguaaggagaauuuguguccaaccuguggcgccacugggagguggugagaccacccccccgccccccccccgccccccgcuaggagguggggcuaggacgagcccuugaaggggcucuugggaccugcaguccauuagcuccuggcaaauuggaucacaacaguauggccagaugguggagcaacagcgcccccacaugucgcugaaaggaaccccaaguacgccaagaggcuuuggccuuuggaaagcagauuggcaguuuuacauucacgccucuaggagacucagcugcuucguagcacugcacccacccaggcaaauugacaucugcacagaaacguguguguuuucuauggcuuuguucacagacgccugaggcagaagcaagcuggcaauguuucagugcgacagaagaguaccagggcauuggcagagcaaacauccgccccucccccaaaugcuuuccuccacucagcagcaugcaggaaucucauaagcucucugcagcucagaagaagcacagaaguuucuggaaaaggcagaaguguagggagagagagagggagggggagggggagacuaaaggugaggagagggagauagggaggggagagggggagagagggagagagagggggagaggaagagggagagggaggaaggggaagagggagggggagagggaggggagggggagagggggagacagaaggugaggagagggagauagggaggggagagagggagggagggggaggggggagaggaagaggaagaaggagggggagggagagagggagggggagggagaucaggggugaaaggcaagggacaagguggaccccucgagaccccagggcuggucuuagaguguccagauuauucugcaguugaacugcaguggcagcgacaccacuguggacacacagccacacacugucaaaaugacaugcgugaacuacuaccauacccucauguggcaguuagcuuuaaguguuaacuuaucacaaccuagaaucaccugggaagagaaucucaauaacagaucaucugcaugacagcuuuggggugagggugggggugugugcugugggcauuucuguggggauugucuuaauuaagccaaucaaugccacaccuuagguggcaccauucccuaaucaggagcuccuggacuauguaagacuggagaaguggcacugaguacaagagagugagcaugccugcauucauuuuccugugcucuugacuucggcugugacugcugugaccggcuguucaguugcugcuuugaccucccugguaucauggaguauaaacuggaauuguaagcugaacuaaaccucucuccuuugaauugcuucuaaauuguuaucaccacaacagaaaugaaacuugaacagcccagaaugccacacugaggaaaugauggaacgaaaugucaccgauagggaguugucuuccaaaggcacguacaugcacgggggcugugggacguguacacacaugcagaggggcccccugaauggauacaagcuaaacaguuggcaguggaaaagccccggaggccauucugccccaggucagggcugucccuguccagagcaaauuccauccugguagaucagagccuggcucucuggaugugggaagggaccacagacaucgggacaccagcagucaguggucugugguggcugucuuagggucucauggaacaggggaucuauucuccugagaauagauguggcuccuuggcauuuucagucucugacacugaggccucaagcaagaauccagcaggaccaugagugaaggaccugucagcauagagguagcuggauaguaggcguaaggggugcucucuccugggcggagcaacucuuggcucugggccuugacucuccagguauacauaaggggaugggugguauccugucauauuggaggccauguaaacuccaagacaggcugguagucuaagccccucaugucuuauccugcuagccagagaggaagaaacauaggguggccuggagugauguggguggaacuauaaggcucagaagcaggauggggagugacagaggcccuuccugagccuuugugagcccacgacucugaccucaggagagaggguccacuucauuccugagguagaggggacaugugagaagaacacuuaugaggcagaggacagagaagagaugggguaugucacuccuggcuguaugcagguaugcgaugggaaacccaaccuccaugugcguccugcaggauguucuugcucucucuuuacccuccugcagugugugugugugugugugugugugugugugugugugugugcacgcacacacgccagaucagccucaaguggcguuccucgggcacuguccaccuugcuuuugguuucuugcuauuuucaagccucuuacuggccuagaacuuucaaguuuagacuuaguuaggcuggcucaccacuaaguccuaaggauccucuugucucugccucuccaacucggagguuacaagugugugccacuaugagcagcuuaaaguuggguucugugaggacauccuuucacagugaggacuuugcaaauucccuccccaacccagaacuugggauucuuacaccuuccaccuccuacagccaaagggauaacagagucaucuggagugauggaaacaggcuauaagcaaaguggccugggguggcugccaucagccacacaccaaugcaggcugaagguguaguggauaauccaggaacucacuuuagcauauuuauuuauuguuaaagauuucuuuauuuauuauauguaaguacacuguagcugucuuaggacacccuagaagagggcaucagaucuuauuacagaugguuguaagcuaucaugugguugcugggauuugagcucaggaccuuuggaagagcagucagugcucuuagccgcugagccaucucuccaguccacuuuagcacauuuaaaugucaguuugaacagccucagguggacugugguugccaaggcacacuuugcuuugugacugggaccuugggcucaguuggggcaccaguuugcagguggcagugauccagaguugcuacuaaagaugucugauuacccaaagguacgugcaaauuugacauauucccuguagagaugcaugaauuuucccagaacuagaaaaagcaacccuaacaugcagguagaaucugcuggcacacagauacauggaaaaccagucuuggcaagcauggucaauugacuuuugauaaugguguugaaacaacucugagaguuaguuaugcaaucuucuacuagagaggaacagugucuggccacacccugagggguaucccccuguccuaccugucacacauaaauaaaacuaaaauaaacccaaaacaauuuaaaagaacucucccugggccugagugggguggggggcaugguggcccauagccacccugcaguugacaggguuccuuugaucacucuuuccaugguuaaaugauuugccgugucugucacugagcaaugcugcuggcuugcaggcccacugggcuuugagaucugcagggagcaca

SEQ ID NO: 35 - RNA, 27472 nt, Mus musculus
cuccagaaccgagugagaagccaggugcaaugaugcaaguauguaaucucaguacucguacagcaugguugggguagacacagaggagcuggccagaagcucaagggccagcuagucuggaguauguaguauaauaacaggaaacucaguaagguagaaaucaagaacuaacaugaaagcugcuucugacccaccacaugugugccauggcaugaauguuucuccaucucccucccuuucuuucccucucuugcuugcucucucacugucauacacacacaaaauaaguaaauaaaaaugcauaccuaucuaucaucuacuuaucugucuuuucuuaauauaaaaagagauuaugccuagggaauuuacagacuuguccuacugagcuauggcauaggcaucuaaucucagccauccaggagggugaggccaggcuggaggaccacaaguugaaggccugccuaaguaauuuagauuuuagucucaaaacaauaacaccacaaaauaaaaauucuaccaccaccaaaacacaauaaaaacuaaacaaaaaccaacaggcagggauuuggaagggguaccaggccagcgguagaguguguacugcacugagaagaaaaaccuaagcaaaccuguuucuagccuggagguggagaugcacaccuuugaucccggcaggaggcagaggcagucagaucucugaguucuaggccagggguuguaaagaaacccaguugccaaacaaaacaaaaaaacaggacaacaacaacaaaacccaaagcaaaaagaaaaccugucuaauuguuuuaagaauauugguaaggucucugagguuuugcaguuucuuuguaaacuauucuaauggugccugcuuugcuuuccuguaagaucacuuacuguugugauuaagaucuuaguguagcucagaacaauguaggguuauuuucugguugcaguaggacuguaaaacuaauaaggcgaucagugugucucugcagggcucaaaacccguuacugcagaauuguagauuuacugcauuggacugguuagucuguuguuuuuucuuuuuccauugagacaggguuucucuguguagaccaggcuggccucgaacucagaaaucugccugccucugccucccaagugcugggauuaaaggugugcgccaccacuguccagacagauuuuaaacucuguagagaaacuagaaguuacuuuccagaucauauccuagucuguacccuaauaguuagggcagauuguacuuucaguuaguuuguguucuguaaugcaaagagcuguuuuagugguuggguuuuguuucuuuuuuuaaacgucuagauucaggaggagucugacauguggaaaaucagagaacuagagaagcagauggaggaugcuuaccaggggaccagaaggaacacagugcccagcagcucaaggugaaguaugcuucugagagccaaaauaacucucaucuucuuagaauuacuaacuuuagcuuuaaaacagucuguuaaggguagaugcauucaguucagcaaaucaguaagccuuccuuguuaacuaaauuuagggccaagcauaacaguggcagcuguguuagcgugacuagccguucuaguccucgguggggaauugcauuuuaaauuuuauagauuccaacuuugucuaauagcuuguaacuuaagauuuucuauuggagaaucuuuuguucuuucuuccuccuuucucucucccucucccuuucccuuucucccuccccccauccuuuccuuucaucuuauaagaauuguauuugcugagcauggugugucaugucuuuggucccagcacucaggcagaggcggauagaucucuugagucagagaccagccugaccuacauagugguuuccaggccagccaagacugcaaagagagacccugucucaaaaaacaaaaacaaaauuaauuucuuuuauuuacuguguuggcaauauuuuguaugaugugugaauguauaugggugugccagugcacacuugaaagucagagcauaacuuucagggauuuguucucuuaacaacuguagguucugggaguggaacucaagucaucaggcuugccaggcaagcacauuuaccucuagccaucccuggagucuuaucauuaauucagucagucauacuguuuuuccuuuagucuauuacacuuuuaaaaauuuauuuuauucauguaaguaugcuauaugucuguugguggucagcaggggacagaagaaggcauuggaugcugucuuagucaggguuucuauuccuggacaaaacaucaugaccaagaagcaaguuggggaggaaaggauuuauucagcuuacauuuccacauugcuguucaucacugaaagaagucaggacuggaacuuaagcaggucagggagcaggagcugaugcagaggccauggagggauguucuuuacuggcuugcuuccccuggcuugcucagccugcuuucuuauagaaccaagacuaccagcccagagaugguaccaccuacaaggggaccuccccacuugaucacuaauugagaaaaugccguacaguuggaucucguggaggcauuuccccaacugaagcuccuuucucugugauaacuccagccugugucaaguugacacaaaacuagccaguacagaugcccugaaguuguaagcugccugacuuaacaugggugcugggauuugaacugacaucucccagaagagcaauaaaugcuccuaaccauuaagccauagcuccauccccaugcaucuuuuuaaaagccacacuaucuuugccagguucaugggcuuuuauauuuccuugguaauaguuugagugugaauauaaaggauuuugcagccuugacucuggaagguguaggguauauuaugaguaauuaggaauaucucuagggcuucauaggcuuuuuuuuuuuuuuuuuuuuuucuuuugagacaggguuucuuuguguagcccuguccuggaacucacucuguagaauccgccugccucugcuucucaagugcugggauuaaaggugugcaccaccacugccugguucagugcuuuuuaaggauaagagauuagguacaugagauagguuagaauccagauuucuaaagaagaaaucuaaaguuagggaacuauuagaagaaaagaauuacaagugagcgugcuuguggaguauguggacucuggugcaguacaaagcugagugugacuggugucgcaguguuacauggugcaaagguagagucucagcauguuccauguauucuguucuugcugcuccauaaagugauaucacagguugcuuauaaaucuaaaaguuugucuguuuucauuuauagucggaugagaagugaugguuuugaugaagaaagucagagagauuacuggaggucaaagaaugaaauuucuggggccuuggaagaugauuuucuuaagacuaaguccuggaacaagaaguuauaugauuaugaauccaauauaccagacagguuugugacuacaugcuugugaccccuaaugguguuuggcuuuagaauauguguuuguugaaauuaauuuuccuagggcuggagagauagcucagugguuaagagcacuuguugcucuuguaggggacccauguuugguuccuagcacauacgaggcagcuuacaacugcccauaacuccaguucaggggaucugacacccucugcugacuucugugggcaucuggcauacauguguaggcaggcaaacacucauacacaaaaauaaaaguaaaucuucaaaacagauuguucccauaaaagcuuauaaguggauguacacagcaguauuuacaauggcuaagaaauggcuaccgccauuuggaugauuguguuaaacaaaauguagguuuuccuuacaguggacuaauacuugugguaaaagggauaaguacuaauuauucgugcuuaaccucaagaaugugacaaauguuaaaggaagucugaugcaaaggcagcauguucuuuguauuauguaguauguccagaauggaaaauccagagagacagaaauacucaggcuucuucugggcuacagguucugcaccuggcaugcaaaacacuuuagaguguuccagaguagauagcguguuauaaaguaguuuggggagagaacuucacugcuaaagaaaagagauauuaauucuuuagugucugguaaagaacaguauuuccugugucugauaugauaguaguauagaaaguagagcuauuacugagcuauugugugguuuuacugugucccuuuuuucucucuguuuguguauacaguauucauguaauccaaaaacaauaugcauuguuucauaaaauacauguauuauguuaacuuacagauggggucacagugguuauaaagaguuguauccugaagaguuugaaacagacagguagguaaaugcacuuacuggaacaaaaccaaacaccucagaugacaaaauugugccaucaguaguguuccuaacauuuucaaaguauuaguuugucauugaaaauaacuagaaccuggaaugguagugcaugguuauagucccaguuauucaggagccugaggcaggauuucuagaguucaggaguuugagucuagcuugggacauaaugucuugucuccaaaacaaaggaaacaagcagaacuuaguuguaaggcaaugcugaugugacuuuccagacuuguucuguaagccuaaggguuuaaaaaacgauugugcaccaucgucugcaguaaacguguuccaagaugccccagaccuuagauauuuuauaaucuauuuuacagccugucuuccuauguuccauauuguuuuuuuaaauuauuuuuauuaauauaguaccuauuaaaaccuuugcucuguaaggaaguauccuguuucuuuuagccauauauaaauugugagaaucaugauugugcuuuggggucauuguuaaauaaaacaagcuauaucaaacaauggaucugauaacccagauggcuguaaaugacccaagaugguuagaaguagacacagggaugauucagauccuaggugggacacaguggaauagugaggauuuucaucuucuuauucaaaaugauaugcaauuaaaaucuuaccaauuauuucuggcauugacccugguuggcaggaaucugcgaaaaugaaaccaugaguaagggagccgugguguuugguauuucauauguaacucaagccugccaggucagggauuugcuuuuugacaggauuucaagauggccuugaacuccugccucuccugccucuaucuaccaaauauugggauuauagauauauaccaguaugcuuagcccaaguucggguuuuaaagaugaggaaauaaaaccuuuguaguagaugagucacacaguaacuaucagagcucucauuugcuggguauguauguauguauguauguauguauguagacggugucuuuuuguaguccuggggguguagaacuuguuauguugaggaagcuguccuuaacuuaggagguuuucuugcuuuugcuuuuuuuuguuuguuuguuuguuuguuuuguuuuuuguuuucaagacaggguuucucuauauagcccuggcuguccuggaacucacuuuuguagaccaggcuggccucugccucccaacugcugggacuaaaggcgugugccaccacacucggcuugcuucugcuuucuaagugcugggauuauaguuguguaccaccauacccaacucaaagucugacuuacaguucagauguuaauaauuuacccagagugcagaauaugaaauagaaauguacuuuuucuuuccuccguaaaaguuuugccuuuucuuuuuauuaguagugaucagcaagacauuaccaauggaaaaaaaccaucuccccagguaaaaucaucugcccgugaaucucgaaaacauaagaagucaaagaaaucccauaagaagaagcagaaaaaacggucacacaaaaaacagaagaaaaacaaaaaggaaguuacggacauaacagcagauuccucaagugaguucucagaggaaacucgagcuucuaguacuaggaaaaggaagcaaccacacaagagcaagaaaaaguccaggaaaaagucuccuaaaaucacuuucccuuuagggggagaaagugguacuucucagucagaggauucugcaucuagcaguucugaggacaucgaggaaagagauacuaagaaaaccaaacggaaaaagaaagagaagaguguccauguccccaugccugacccugagguacaggagaggacaagcaagcgcaggaacuggaagguggcuaccgacgccaggucugcugagagcucggaggaugacuaagugggagagcagcaguccugcuucccacugacucguuagggggguugccagugacuccugcagcacaggcaggcgucugaggucagaguuguccugccccagauaccuuuuuuccuauuuuggcuuguuaaucuccauccucuuuuguuaauagggaaucugguauuuuauuaagguuucuugaaaaaauuauuuuuuucaauuaaucacuuaggguagaauaccuauacagcaaauuaaagaacccagaaagcugaacucaguaaugaccugggcacaccaauugcaauguuggauuugauggaaucaagaguccaggauggaggaggaagacugaaguagugcuaaauagaaugguuugacaaggagaccgugcuauucauacaggaggcaugcugccuucagcuuuggugcuuugguucuucugcaguugggcccuauaggcauccaguuuacugagcgaggaaauaguuaaaagaacaaaccuuuucccuucaugguaaucucuacagaugacugcuaaggaaccuaggguuuucagccuaaucucccugcuggccagggucuacagcuacauuuagcauaacccaaacauaacaguaacuggauaguaaauguuuuucuaguuccauugcuguauacugccuaaaugggcuuguauuugaaauuguuugguuguccuaucuaucaaauggaaagaauuaggaaguaguuauguugccaugaugcuuucaaagagauucagggcaucagccaucuaaaugucuguuuuuuaaaaaaauuuuauuauuauuauuauuauuauuauuauuuuugcugaguuggggauugaaccgaaggccuugcauauacuaggcaagugcucuaccauugagccauacccccaguccuguuguuuuccuuguucauuucuaauucuauuaauggauuuuagauuuucccugaaaccaguugaaucaauuccaaaaugaaacacacuucucagggacauacccacuucccagucugacuuuguguuuugauuaucaagaacauauuauuucccccugcuauauacugugauccugauauuaaaagaaaccaaaauaccacuggaaaguggcugguagaacaguuggcuuuucauuaagaggaaagauaaagugacauuuaucaggguuuuuguuuuugagguugucacuuugguacugagcgaaugcaugaaaacucaagacugugggccaugguucugccacuaauugauugaguucuagagcagguuaaccucccuggccuuacucuuugcauguguaauacaaagauacuucaugguuagcaugacauacaccagcaauagaauaugauaaugcugacaucccaugaaguggcauuuuauaguaauaacuaaauuugugcucuuuauggaacauauuucuaauaaaaugcuuguucuuaaaauauaugguuggccagaugugcccuaucccuugauuaugagcaggugccgccuuuugggguacugaaacacuaaugauuuuaguacucaaaugccaauauuccaugagccuuuugggguacugaaacacuaaugauuuuaguacucaaaugccaauauuccaugauauauucuuuuccuugggucuaguggagggagagucuaguuacuaccucauaaccuucuagaagcaagugauaucuuuguuggaaguaguuuugggcaugcauucuuaaugcaguuuugugcuacaaauguacugauucuaagcacagacucgggaagauuguccugcagaauaaggcacuuccaaguuugaguuuugaccuuaccuuccucccauacaacagacauaucuuuucuccagggaaagcacauuuugccugauuuaacaccccugccccaccaccccgcacuguucuaucuuuucuuggucacauaagcaauaaaauuguuucuguucuaauccaugccuuaggcuaaggcuuugaugguuccucuaauccccuuaacagugguuuaggacuacuuuugaaaaccugucucucccauuuccacgaucagcucuggaacauguauuaguguuccugagagaugauuauguugaauccuaaauugggauuuagaagaacaagaauuggagacuucacauuuauuaacuggugugauacaaguuggaauuacugaauucccauaaauaaaauuucacuuuugaacauuugcucuguuacuuuuuaacaccaacagacuuuguaacugccugacgcuaaccugacagguuggcaggucuuucaccacuggccauucaaucugcuugguaacaagucuuuuggucuucugucauucuaagguauggccuacugcccuccuuucuguacgaucugggcaaaccgaccggugauggcaagaguagugucaaugaagcgauccacacagcuagagaggcaguuuucagugcgggagucuagccgacuuccuggcuucuccacacacuuaucccaacauaguuccaugaagugaugcaccuaagggcagagaaaaaccuuuuuuagucauuaggguaugagauaucuuaguucaucauucugugauauuuaauagcauauuguaggaucacuucaggacuacucuuucuuuacuuugucaccaguaacagccccagaucaguaaauucucauuagaacucauucuuuugcagagagaugauggggcaggucuuuaaucccagcacuugggagucagaggcagguggaucucagaguuaaggccagccuggucuacagagggaguugcaagacagccaggcuaacagagaaacccugucuucaaaccaacgauucauacuuucacaauucucaaagcaacuagcaguacuauuaaaucagaggaagucaggacauuaaccugucgguucuugauagcuaucaguacuuccaagguuaucuugauugaacgguuaaaacccuaguaggaaauacgcugucccacaccaaaugagucaacacugauagcugcagggcucaucuuucucuaauaaugaucaccauuuacaaauacaucaucacauuauccaaugcagaggcagcgggcaacaacgaacccagaucucauggugaggacgggugucuugucuccaggcaccugugcuccaaggucggaacccagagauuccgagugccauucccgaccagcgaccagcuaauaaccgcaugcuccuguggcccaaaccuuuccgcuguuuucgaacccuuuccucccacgcagcgcuugccucccgggcacugagcacuguagaucacuggggcgggaggcgcagcccggaucgaguggggccgcugugccgcaguguccagagcuccgugagugcccgggaucugcgccucacccuccuuccccuguuccuuccucauccucguaccugcgcagugaauugcgccuucugcuguucggcggccaccaggcguuguaacuccgcuucguccgcuucaccaagcucggccauugucggagucaggcgcuucgcuggggugcgcacgcgcgguggcagcgcaccgucuccugccuuccgguucacgcuucagguugccucaccguucuuuuacgcggggcgggacuuacuacauaacuguuuccggguuguagagugaccuugagcccucgaaagcgacauggcgguucucuuaaagcugggcguucucugcaguggccaaggagcucgaggugaggugucuuggccaucaaagguucuugcugcaggcugaagcaggggagaggaaggaguuagagcucgcccgcuggguggugggacgucuugagaggagggaacuugcucuugugcccucgaggcaccaccuaugcggacgcaacguugaccgcuauagccuaaaggcccaaguguuuacgugcuggcugguguccccagcucguacuuuccgcuucugcacugugguugugaccccgggcuaauaugaaaacaaacuccuauuugaguguggauggaaggaguccguuugauaauuuguucugaguggcuugcuguguagugcugucuuccucgaucuagccauguagacaagacuaaccuagagcuugccgggagccccgugacugcucccgagggcugccauaaaaaccgugcacccucacucagggcuucgauaaucauuuuaaccaggcauuuuaccuauaccaggcgccuaagaggcuaguauauaaacacgaauuaaacaguuucaacccucgaagaacuucuugugugggggcuacaggcaaaguaaagcaaaaccuguuguguuauguagacauuauugagugcagagaacguuugggguacuugcuuugaaaggacuaaccugccuuggcucugcagggaauuacauccuauaguaaccgagagcagcaaaaaccaaagugaggggcuauaaagaugcacagggugcgauaaaauggaacaaauacaguaauaucugugaaagucaaaguguaaucuagaaaggcaaaauggaacuaagccacaggacuuacuuuauucucuuuugaaaauacagucucucuguugcccagguugggaguaagaucgaaagguuugauagguuuacaaucuugguuuauuuuugcuguuacuguuguugcuuaggcugcccuggaacuuguccugucucagccuccagaguagcuggggugcaccaccugcccucacaaucuuucccuuuugagcccagcaucucaugcuugcugagcgugugcccuguugccagacuauacaagccucagccucagccuagacuuagguuaguaacaguguaguagauggaugaccuugguggagauagaggagguuccgacccaagucauggagaugagauagaugagauaagcacgcugcggcagccaggcaggugaaguccugagcuuggaagggaaagggagaagaaggcagucucaggaaguguuaaggagcugugucaguaggauuuggugauuuauagagggaacuaccuggcuggcuauugguuauuacuugaauuagcugcguggaguuauucgaucaugacuaguuggaacagacaugagguguaugaaaaacaguuccacagcugaacaguugggaaguggcagauggcuuaggccacacuuaacagaagcaagacuagaacgagcucaggccugcuuucacaggcuggugauucuagugcuuggugcuggaaaugggagggucaaaagguucaaggucauggggcaagggacaaagagcaaggcaacucucugaguuagaagcuagccuggucugcauagagaguuccaggccagccagagcaaacagugaaacccuauaaccaccuuccaccccuccaacucuaccaugcaugccuucaaaauaaauaaauaaauaaauaaagacaggagagaaaauauuaaauuaucuauuuguguauguaugcaguuagcauucugggagcucauuaaaccuuuguuuacuuugucuaguuuuuagcaguguuaggaaguaaaugcaguuguugacuguguuggcuaguuuuugccuacuugaugcaacuuagucaguuggaaagagggaacuuaacugaagaaucgcuuccaguggauuagcccuuggccaugucugugagugaguuucuugacugauguggaagggcccaggccccuguggguagcacuaucuauuguagacaguugugcccgggcugaauaauaaggcuagugagcgugagccauggagcaggccaguaagcaccgcuccccugugguuuccacuucaguuucuacuugauugcuugcccugguuucccucaacgcuggacagugagcuagaaucggaagcugaaguaaacacuuuguuccccuaaguugauuuuggucaugguauuuacauaguaacagaaagcaaacuagaacacuuuucuacagcuauuuaaauuagcugcuuaucaucccauggcuaaucucugauguggcugggugaacaucagucugucuucaccaagaggcaagauccaaagggaaacaggaaggaaggcuccaagggugcagaugaaauuuggucuugaaaagaaagaggacacuagguuaauuuucugaacuaaauuguguaucuugagggcaaagacuuuuuuguccuuauguuucuugcuguguugccaagcacagacuucaugcaguuagaaugcgauaacucggcgaguaaacguaagaaccgccagguuuuaaguagagaaagugaggccuuuuaguuauguagcuucuauguaggagucugcagauuuuccuugcuuauuuuugagacagggucucaugugaccccaugcugaucucagaccccauagguaggugaggcugaccuugaguuucugcuccugccucuccagugccugcguguauguggucaguguuggaaauaaaccccaugaaugcuuggcaagcaacugagcuacguccccaguacagauuuuuuuuuuuuuuuuuaaauaaaguuugggauggaaagauggcucuuagguuaagagcacuuauugcuuuuccagagaaccuggguucucuucccagaacacacauaguggcuauaacuauaacuccaggucuagggcagauauaacucuaguuauaaagaaggauguugcagauaccaggcaugcacaugguacgcagauauuacaugucgguaagacacucgugcauauuaaaauacauccuuuaaaguaaaaauguauucauugucaugccugcucauggucccguuaggaagcacuuacgagcccugucuuucuucccucagcucuccuacuccgaagccggguggucagacccgcuuaugugucagcauuucuccaggaccagccuacccaaggacggugugguacccagcacauucaccugucaccaagccaccacuguauguccucucugccucagcuuugucaggaguucuauuuauuauucuaagcguguugguguuuugccugcaugucuaucugugcacuugcauuucugaugcacaggguccagaagaggguguuggauucccuggaagggaguuaaagaaguugugcacugcuacugucuuggggcuuuggcuaucuuuaccugagcuaauaauauacuuggggggucuugaugucuucucaggaggacgcucauugucugcuagcuaaauaaagacccaguuuacaaaccuuugcacacagagugcaaacagagucgagaaauaccauuuauauucacagagaaccuucuggcccaacucuucaaaauguguuacauuauugucaagaaaacaacucuguagaagucuguucagugcggcuuagguacugcuguuuguuuagccaguggaaaggagugaauugugcagaacaucuaauuuugugacugaauccuggauuuauagcugaggguuuuuuuguuuuuguuuuuagguugauuaaaaccauaugggauuuuguagguaaauacuguguggcuauucacaguagacauucuaaacaugacuaaugagcuaacuguauuuuuauuaaagucuggagggagaaauuuuuuuuuugucuugacuggucugaaaauugcuuuguaguccaggguagccucaaacuugcagugaucuuccugaaaucaugguuuugaauugucauuuuguuaauuuuuuugagauagggucuuacuguagcugucccagaacucaccauguauuccagacugcaguccuccugccucagccucuuggugccgugauuaccggccuucaugccuggcugcugagauuuguaaagagucuucauuuuuauuuuuuaucuucugcuuucaguccucugugguucuuaaggcagccacuuaacugaugagugagucuagcuggagggcuuuucugccuauuaaacccuuucuguuuuugaccaguuuuuguuucuggauuccuuugcuagauuuaucagacuuguucuggagugcauggggcugaagaaaguccacugaaguaguauguauagauuuucuguaugugccuguucuggguagggccuccaucguuuugugagguuugugcagaaguucauagccucuuagaaaugaggcuuagagccugugcugguuuggcuuguggaagagccgucuucauguuucauuuguguggcacuggguuguaaagagacagaaggacuguaaccuuaaaaaguagccguaggccuuugcuccuuucacucugguugaacuguuuuuaaaacauaucacauuuccccccuaaaauaauaauaguauuauuauuuuaaaggggucacaucagggauugcuaaauuacauucauaagauaccucuugccacugaaguaaaaaacuggcucaauuucacagguacucagccugccuucuugcuuauaagcaaacgugugccugugcugugcuccagacgcagaggauacgcugucugaugugucuccagauggauuugcuguguauacugucucccacucugaaggguuugguaaucaugugauugaaguguuuguccuuucucaacucuugugauucugauucuuuuuacagcugguuccaaggcugcaucucuccacuggaccagugagaggguugucaguguucugcucuuggggcugaucccugcuggguacuugaaucccugcucugugguggacuacucucuggcugcagcccucacccugcacagucacuggcaaguaccgcaaucccucugcguugucugcuuggucuguuugcugcaagccugucucuuuauaaaggaaacauugauugaaauucucaaacuuguagaaaacuuaaaagcacacaggcuaccaucaauggccagauaagucuggguaugugggcggugcacgucugggauccuagcaguaaggggaggaggcaaaagagucacaaguucaaagucauccuuagccuuaggaagaucucauuucaaaacacgaagcaaaaugugucugcacuaaaacuuaaacgagaacaccauagcacauuacuuacauuagguaaaagcagaaaccccccauuuggccucacuagaguacggugccuuggucauaccauggaguaguacucagcugcguaagggaaugaaguucugagugggcugcaguguggacagugaaagcagaauacacgcuaaagaagaagugugacacagcuugcguggucuuaccguaugaagugacaggauaggcacagcgacagaaacgagcaagucagugagugagugggacaacagcuagugcuucccgagugugaaaacuacccaagcuuauacggauugcuaaaaaggugaauucuguggugugagguacaucuaaauaaaacugcuauaaaaauaguaaggucaggccacuccuuuagguuacguugugcugagaaccuccucgguguuuccuuaggccccugcagucugccucugcuuugcuguggguuucaccugacucgcagguuccagccacauuaauguccuuacuguuccuuagggaugccaagauccaugucacuuuuuucgguguucuucuccuucaggucacccugagcuguuuccucagacugcauacacagcuccuuauccuucuguuucacuagcaugucuguuucugcacagagggagcacccucagcauucccgacauguucuacacaugucguacgccuaguacacucuucacgagugacacucuguaaaacauuugcuguaguuaaaaaugaaaagaagauuuuuacagauagaggcacauuuaguuuccuggaaauguaaauucacaggaugagaucucuuuauuacauuauuagcaacucaauuuuuuguuuguuugcuugcuuuuugagacaagguuucucuguguagcccuggccauccuggaacucacuguagaccaggcuggucucaaacuucccucugccucccuaguguugggauuaaaggcuugaacuaccacugcugggcuauuagcaacucuauugcauuuugguuuccauuuuuuaacugugaguugcuugggcuguuaugucaaagcauagaaauaauuccaccuguggaguggcuguacaagaucccugugagagcaaacaguuguuggaguauucauagguagagacuuuguauuuugggguguuuuguauucuuuugggugagugggguacuuaacuugucugcauggccucuaacugcccuuguguuugacuuuucauuaggggccuuggacaagugguuaccgacuacguucauggggacacccugccgaaggcugccagggcaggccucuuggcacucucagcuuugaccuuugcugggcuuugcuacuucaauuaccacgaugucggcaucugcagagcgguugccaugcuguggaagcucugaccugggugcagcacuuugauugugugccuccuugccucugcuuuaccaaugccguucaccucgcagugaggggggaugaaggauaagcccauuggugggcagaaugucuucuaauuacaugguuauuuucagaauuuauuuguugaggaagagguuugaggaguuagguucgaccauucgugagucuguguuccauacuccacugagugugggcacuagcucacagccucgcggugagacugaacauuucaugagcucauguugccuuugaccaccauuucuuaaggagagccagcugauugcugucaggauaagagcaucucuucagccaggagggaggccuguucccuccugaguuagacuuugcaugaagcucgaaaguauucccuuuggaaccucccauucuuguucaggugacaccagcucuguugauggcucugcuucuagggaacauuuaaucaggagaugcucucaaugacuaauuugucuaagucuuaggaaggagguugaggaaagcuggauuuagacaaguucaauuuagggaguucuccuuguuuguggauuaaaauaugacagauugcaaacagacuacucuucaaauguaucucaauugugcagaagugagcuguccaaaaguauaagacuaagugauaaacugucuucccaccgugggaguuguuaaugagaaagaaaguguacucugaaaaaacaaaauuuuuaaauaaaauauuauauaaugaaaauacauuguacuuuuuuuuuaugugcuaguauucucuaauauuuggguuuugguuggugcuuacauguuugaaauagacucuuacaagcucauacugaucugaaauucucuguagguagaccaggauggccucaaacuuugcaaucuuucuguuucugccccucaagugcuggaguuacaguugugaaaccacaaaacucacuuguuuuguucuaguuucaaauggugccuuaguuuguugcccaggcuagcaucaaaauccugggcucaagccaucugacuagccugaguaguggccugccaggcaggcuguaguuuuauucauuaaaacaguguuaugccgggcagugguggcgcaugccugugaucccagcacuugggaggcaaaggcaggcggauuucugaguuugaggccauccugggcuacagagugaguuccaggacagccagggcuacuuagagaaacacugucucgaaaaaacaaaaaacaaacaaaaccccaacaacaacaaaaaaccaggguuaugccagguauggugguagaugccugugaucccacucucugcgagucugggggaugauugcugggaguuugaggccaacguagaccacaguaaguuccaagccagcuacagagugagacccuuacuuaacaaacccaaaaaacaauaauuaaaaguaaguacauccacaauugggaauuagaacugaguuuagcuuugugugacuuagcaaaugaguaguucacauagaaugccacgggacgaaagggcucaugaugggcagaaacgggcagcuuaagcaugaagguggagugguagggguuagaacugugcuaucauucgggugagugccaagcuuucucagucuguguucugggugcgcugacugugagccuugaugaaccacacuguacauuucacucccggaggauggccugggcggcaaggccgggaaggguuuccaugaaagggcaaccauuuguaucaguaugucaggcggcaugaucagagcucacgggcuuggaaaaggggccggagagauggcucaguggguaaagacaccugcugccaagccugacagggauucacguggugggaaggugacucccauuguucccugaucucuacagcugugcugugacacacaugaaccacacgccacuaaaaggaaaagcugauauaauaaaaaagauacaggaggacgagagggcucggcaggugagguuauuuaacugcugagcaugacagccugaauuugagccucgggacccacaggguggaggugaaaugacccacuguuuacccuacaaacugcauaagcacaugcaaugcaaacaauacauaauaaguaacuaauuacagacuaccaaggcagaguucaggugcuguggugaaagccugccagcucccuguauggguuuuguguuguuguuuuuuuaagugcuggcuuucuguggccagauucaaagugagccagcguuggccuuaagagucaguguauaggcuacacaguugguaaccaauuggaagguuaaacaugacccaaaggcaggagcuucaaagugaccacagggcuaacagcaaacuggcgacagcgaguguaaagugcagagcuccaagaagugcgggcugcagugcuuuagagacuccuuccccaccacagagcuaaagcgugagauggauuaaauggugacagugccauaggcacuccagaguuccagccacagagugacuggcccucaacugacuacacagugagccaaaaaaagaauucuuaagcacuuacuuuuuguuuguuuguuuguuugagacaggguuucucuguguagcccuggcuguccuggaacucacucuguagaccaggcuggccucgaacucagaaauccaccugccucugccuccugagugcugggauuaaaggcgugcgccacuuaucuuguaugugcucagaugcagggaggaacacacuccugugaaggucggaaggcacccugcaggagucagcucuuuucaccgugugaguuuuggggacccaacucaggucaacaggcucagaaucaagcaccucacccgcugagccaucucccugucccgaagccagaucuuuuuuuuuuuucuuuaagcuuuuaaaauugaaaauagauucuucucucauagacuacauccuaaccgcaguuuccccucccuccccuucuccuagcucuccucuagauccagucccccuccauuuucucccuccaagggaggcuagccagacggacaaaacacgcuacaauaagacaaagcaaaaauccuaguggaggcugggacaaggcauuccaauagaaggaaaagagucucaagaacaggcaaaagugucagagauacacccguuccuacuguuaagaggcucacaaaaacaccaaccuaauagccauaauguguacacagaggaucugaugcaguuauuucuucuauguguguaugcaugcacgugugugcgugcagaaguguacacacacacacacacacacacacacacacacacacacacacacacacacacacacacacacacacuaaaugcagugcccauggagaccagaagagggcaccagauuaucucuggaacuggggcugcagaagguugagucuggaaccaaccuggguccucugguacaggagcaagugcucuuaaccacugggccauccagccucccaaguaguauuaggauggauuuucuccuugguuggccugaaaggaugggauauugcuuucaugccagaggcacauugucacucugggcugcggagaagguaauaauuacaaggaauaaaggccgagggcaccaauucucuuuuugguguguucuucagaguagauacagucuaaguauagcuuguacuuuuacucuacuaaguguggcuuuucuaccuccgcuucuauuuccucggaccucucucucucucucucucucccucucucucucucugucucuuucucucucccuuucucucucucacucucauguccucgagcuccguucugcuuuaaaauaguuuuaucuaugagagaaggaacuugagagagguaucacugugagcaccagucaggaugcuaaagaggacaugcacagaggagccugagucuuggaugacgucacugcacugccacgccauugccacaccuaucugcaucugcggaugccagucagcgcuuccgcuuccgugcagucuuguguaauagagcugcucuuccagaguaggugauuguaggagguuccccagugggucucaccauccguggaccugguccuuuuguuuacaccucuagcuugaaucuauuuucugucauaaguaauagugugaucaauggccuuggaucugugucuuugucuaguggugaacaugguuuuucuucuuuguguucaaccucuguauuuguggaacucauucagauuuaucuuguugcuguguaucuguguuuagggguuaggaggaauauguuugugcccauguagagaccagaggaggaugcugggucuuuuucuuggcugcucuccaccuuauuuuuugaggcaggguuucucacugaauuugacuuagcauuuuggcuaggcuagcugcccagugagcucauaggaucgcuccugucagugcaguggcuacugguaugcacugcccucucuagcaguuauauggaggcuggggauuugaacuuggguccucuuacuguaccagugaguggucuuauccacugagucacauuuuuagccccuaauuuugcuuuuugaaauuucuguuuugaaacuggucuugcuacacaguccaggcuggcucugagcucagcuguguggcccagcgugacaucagacucccuucggcccacucaccucagucucuugcaugcaacuccacccuuuauuuuauguuuuuuuucuguuuguuagaguucaugucuucagauguugugaauaagggacaggauagauuggagggauggcucagugguuaagcgcacuugcugcucuuguggacacucuggauucaaucccaagcacacacaugacagcuuauaacccucuauaucuccaguuccagggggaaaccagacacucuuuuggucuuuuuggggugcuacacacacaugguacacagacauacuugcugacaaaacauccauacguauaacauguuaaaaaacauuuccagcuccuuuucugguuugacuguucuucuaaagagaugggugugagcugggcaguguuggcacacaucuuuagucccagcauucaggaagcagaggcuggcggaucucugaguucauugccaaccuugucuacagagugaguuccaggacugccaggacuacacagaaaaacccugucuugcaaaaaccaaacaaacagaagagagggagagaugggugugacugaugguuugcuacuugagcuucgacucaccucuguugguagcccuuggugccgagucccucucccucagacugacugucacucccacauagagucugcgcugcucuuugcccuccgggcucuuacuguagaguuuugugcgauucacuuaaacuuuguuuuuccccagucacuuaggagcucaaagaauucaauaggucuguguuuagguccuuuuguuucaucuaauaaauuuauucaauaaaacucuuguggcauugccauugguggauagcaaugcacccguggauagcccuguucuaagcccauuggaggagccccagguaaaaccaguguaucacagagcaaaaacaaaagggaggagacacaaaagugaggugggaaugugcuuucuucacugugcugugcacacaugcacacacacagacacacacacgcaugugcgcgcacacacacacaccaugaacacacacaugcaugcacacaacgugcacaaacacucacuugaacacccaagcuccccucccccccacauacacacaccacgaaugcacauacacgcaugcuugcaccacacuugggagccucagcaggauguggcgacacaugccucaauccuagcaguugggagacagacacaagaagagugaguuugagaccagccugaacuacauagugagacccugugucaacaaaaccaaaacaaaaacaugaagcagaggaggaggaagcuuuucucuggcugucacagaauuuuagcaucauucaaagugaaaauggguucucauggcauuaaguguuauacuguguuccaggaaauaaacaucucaaauagagaagugagucagagcccgagaagcuuaugaaaaaauguuagucacagggagagcagagcuaccuaaugugaacacagcuuucuuuucaggccauuucugcugacauuggggauccccacgccuguugcuuaauuuggcagcugcaggcaaugagcagaggacucagcaauuguaggggccaggagcugcaccguucugcugggaacuuuccucuuugugcugaaaaccaauaugaauuaccgggaguguuguaauggcuacuauaagggaaaaauuauaaaaggacccagaaacacggaaaaauugcgggggaugggggggugaauuuaauucuaauuuggaggagacuuggaaugaauuaguucugugcucuuaaacaaagggacagagaguugugacagcguucucuauaguagcagaacuuacaaaugaauccuccccucuauauauguaugggauuuauugaaugaauuacaggcuguggucuaauuaaucaaacuaugaacaggaaguccaagaauucagaaguuucuuaguccacaaggcuggaugucucugcuggucuucagcacucuggaaucccuuagaaguaggcucuaaugccagugaaggaauggauuugcuaguaaggcaaggacgaacaggcaaagagcgaaagugucuuuccauacccuucuauuggcuuccagcagaagguauggcccagauuaaagguggaucuucccacugcaagaucugauuuaaagacaccuaucuuccugccccaagaucuggaucaaaauuguguuuuccuaccucaaaggucuggacuagaaguggguguucacccacucaaaucaagcaauaaaucucucacagguguacccuccauuucugaauuguaguucauuuccagauguagcuaaguugacaacaaagaaugaccacuacaccguccauuucuaaaguuuaauuuaugcuggguggacaugguuguacaugucugugccugcaggcugaggcaggaggaucuccuggccuagguaaugaguuccaagucagccuggguuuuuaaugagauguugguugucucaaaaaaaaaaaaaaaaaaaaaaaagaaagaaagaaagaaagaaaccaaccaaacaagaaaacaaaaugaaaaucagaaguugggguuguggcucaguagguaaaauauuugucuugcaagugugagacuggaguuuggaucugcagaaccaugcagcuaccuguaauuccagcuuuagaaggaugucugggaacuucagaacagguugguuaauaagaugagccauacuggcaagcucuggguuugauugagggagccugccucagugaauaagggggaagagcuuuggaggacgguuccuuuuuauuuuuuuuuaaacuuauuuaugguuauauguaaguacacuguagcugucuucagacacaccagaagaaggugucagaucucauuaugggugguuuugagccaccaugugguugcugggauuugaacucaguaucuucagaagaguagucagugcucuuaaccacugagccaucucaccagucccucuggaggaugguuccuaauguuggcuucaggccuccacauacaugugcacacauaugcauaugcaaacacacauaagaacaccacacauaaacacaaaaaacggaaaaagggaggcaucauuucuuuuuuguaauugugaggaggauuaaacuuuacuuucaaaauggggugggaggugcucauguuucuucaggaauucuucuuuguccagcagcauaggccagcauaggccagugggauguucuaugaguugagaagaagaaaucugacguuugaugaggauguaggcuucaaguucaagggucagaaugugagcauuggaaacacaaagauuuuuuuucugauaagccaggcauggugguucacaccuucaauuccagcauccaggaggcagaaguuggcagaucacugugaguucaaggcuagccuggucuacauaagccaggcauggugguucacaccuucaauuccagcauccaggaggcagaaguuggcagaucacugugaguucaaggccagccaagucuacauagugaaacccugacucaaaaaaaaaaaaaaaaaaaaaaaaaagcaaacaaacaaaaaacaaaaaaacccaaguccuaauuauuuauaaguguaauugaaugccuggaaaggcggagguuuaagaguacacugcuucuugacuuaagucgaggcuuugaaccaccuccagcaguuacuaguuuaaguaagucagagugaggauggcagaucaugccuauaacccuaggaucugggagacagagucaagagaaucaggaguucaagguuaucuucaguuguguagagaguuugaggucagccgagagagagagagagagagagagagagagagagagagagagagagagaggcagagacagagagagacagagacagagacagagacagacagagagagagagauuggagcaagaguucuugaguuccugaccugacuucccuccuggauugggaucuggaauuguaaacaagggccaccccaccguguuguuuugugggagugagagcugcaucacaguaacugaacgaaacuagaacaacuuaguaaacuuaggcugagccauggacggucaguaaugaagaccucuuaacugaggauuaguuaacgauuccucuaagaagcaugagcguguggcuaagauguguuucauuaucuuauuuuuauuugagugaauggagggcccauauuuguguggggcucaguucuccccuuccaucacgugguuccuagggauggagcucagccugaggccuaagggcaagggccuuuacccacuggguccucucuccuugaccaaagacuuucgccuuaauguuucccuuuauuguuauuuuaugugcagggguguuuuggauggauggauggaugucugugcaccacaugugugcaguacccagggacacuaggagaugauuucagauccccugcaacuggagcugccauguggguucgggcacuugaacccaggccccauggaagagcagccagaguucuuaacagcugagccaucucuccagucccaagauuuuguuuuuaauuguacuuccccuacacacuggcaggcuaugauccaaaaagaacaacagcuuuggaaaaagaaagacugauaucuuugagucuuucaggagacuugccugacuuccgauucaguuccuuguuuuacuagaaagcuuugucuccuucaucccauguuuguuuguuuuuguuuuuuuggcuuuuuuguuuuuuuguuuuuuuagauugcccccuuccucuuggguaguucaaugauaacuuccugcaugagauaaaguuauggccuuuaugcaaacauaaaaugaacgaaugcacagugggcugggcauggugggagcaugcccguagugaacuugggagacugagguagcaggaccagagguucagaacuggguaagggaggugacuucguggcuaaggugcuugcugccaagccugaugaccugcauucaaccuccagaaccuacaugguggaaggaggggcaauuuacucuuaaaaguuggccucugaccuccacccgugaaucacgcugaacaugcaaugauagucgcauuugugugcguguacacacacgaacauacuacugcuaccaaauccuacuaauaaaaggcuuaaugacuacuuagaaaagugaggaaacucuacucugucuuacaugugaccuucaggcucuuuuuccuuaagcaacuugugcacacuucccuaagcuuggccugcccauggagacugaguugagaacuugauuuguggccaucuguguaguaaaugacacguggcuuggcaaauagcacuuauuucauaggggcaaguuugaucccuugccuagguucaacuuucuaugucaaggugccaggagagaaggguggugccuuuccagguacuuacuggaagacuugggugugcaguguuaucaaaguggaaggggcgugcuggccagguggggacaaagugucggcucugcacauugugugcagccugugcugcuggugaccucgcugcucuugggccagaagauauagguauucuguucucuauaguaaaucuuuaacugcgcaagaaucuaaggcuaccugccacugauaaaggacaagcaaagccuaagugacagaugucaccuucugccccucaucgcagacauucacuguggacacucaagacugaagagcucuaucuaggggcuugcaaacuuuuaaguuacacuuucuucugugugcauugucugugucugugucugugucugugucugugucugugucugugucugugucugugucugugucugugucugugucugugucugugugucuguauguguuugcucacccaaacuuuggguucuuggaaaagaccuggggcuuauuuaucuaagaagcuggacccaguggcacaaggguguccagccugccuuuggauccuagcugcugcugcugcccagcuagcaaaggaugcugacaaaauaaccacgggaccggaacuuauuagcaccaucccccauucuauuguggggacccccaagaauccacucagucaguggcuguccaacaccagauugguacacuuucaggcucuacuguuuuaauucccuuugcauaagagauaacccaucaucugcccuaaacucagccaccccgcucucu

SEQ ID NO: 36 - RNA, 58980 nt, Mus musculus
ugggauccugcugcauacauugaagguaaacccuucaaauggaccgugaaaauuaacauugcaggccuuauaaauaagcacagaacucaggugaaggaagucugcagcggggaaacuccaagccaugagaguugcuuggguagaccaagcagagcagagcaagaugaguaagacugcuucaaaccuugggggccaacccacuacuucaguguguccaaaaugugaggcacagcaccaaaagagguuauucuggggucucaagauuuaaugauauugccucucucguauuugggacugauuaagaaucaguuaacccuuuuccuccuauuaagaugagccuuuauccuaagccugucugguugucuaguuuagaagcaagugacauuuaauuccacagacucucagagaggggaaauuugccugaugaguguauuaugacauagauaaaaaaaaaaugaguuaagaccagugcuguugaaauagaguggauuuauuuuggauaaaaggacaugaacuggggccugcuaaggcaaaugcuaugguaagaauauguccaccgaaguucauguuuuggaagcuuaauuccccaggucgaccgugucaagagggagauuucugagagucaauuagagugugagagcuccacccucccucauauguguaaguguggucucuuaccacuggguuuucugccauagcaugacacagcagaagacuguuaaaaaaaaaaaaaaagaaaagugccuuuggguagcaagauggcucaaauggacaagggauaugugcuucccaccaaaccugaagaugcaaguucggacucuggagcccaagaggugggaagacuuugauauuaguagcuuaggcuaauuggucuuacucucuuuuuaaaacucaugaccuucuaugguguccuucaucuauccagcaguuaacuuuuguaugaguccauuuucaguuacuauaaugagaaccugagacuagauacucuauguggaaaaauagauuuguuuagcuuacaguuuuauagacugaaggccacagguaugggggagccaaucgugaauuauauucauaguggcaggugugugugugugugugugugugugugugugugugugagagagagagagagagagagagagagagagagagagacugguaaagaacugcuucaccucuuccuaagagucauuucacuaauguucucuccauugggaacagacccaaaccuuucugaacuuugacuuccucaaacuacggcucucacacugcccaacucucauugauaaaagaugcaaguaggaccucccguguguagcauuccucuaaauucccaacagcccagacacgggagugugucagucuuucuucuccuagagucaugagaagucacagcacacacaggaaagccucuaacacuggagagagcuugugauguuacgugaaguuaccaaacccucacggaggcucaagaggagucgcuauucaacguuaaguuccuauguaugguuguuuccuagguuuguuacaucuaggagaacagccagucauucuaucuauauuuaacacugggcagcaaagccugcaggaagggaaugcaaagagaccaguuuugucccuggagcuugauggcugaagugacagagagacaggaaacuuugaggaaggagaagcauuuaggaugaacuaaacaugcugaugaacaaagaggagagcuuuggcacaccagggacauggucuggaagcacacaguucccauggccaagacacagggacaaguuagagaguuaaaaagaaauuacaguuggaaucgaaagccgguaccagagcaaggacgacaaagagugccaggugcgccaucccggauccugccaucgguaccaugcugaguccucugcccuuugccugucaagcacaucugugugagccagcaguuguaauucccugggaauuuuuuguuccuugccacuuuuaaguuagccugccaaaaaaaaaaaaaaaaaaaaaaaucccacuugagaaacagcaauuuugaaaauuuugcaagagauguaugcuuaacuguaaaagacauugggaaacagagggacaggcauaaagcaaacaaaacaucauucugaaugcuagcauucuaaccauuggugcggcugacauuuucgcucccguuuaguuucuguuccuaccugaguuuucccgccuaacacaauucaagugcuaacuacccuaugauagaagaauuccuuugaaaauacaguauuauaucgagaacacauggucuguuugccaguuuuccugauguugagcagauugguugcuccuauuuauuuuguguuaaaucaauuugccacuugcuguggcauacaccuuuaguccuugcaugacggaggcagaucucauagaucuuugaguucaaggccagccaaggcuauauagugagacucugucuccaaaaaaaguuuccuuguugauggacaagaacgcucccucccccaguuuauauugugcauucuucuaagcacuuuggggacaaaaauucauuuaauccuuacacuagugcaugggugacaauaucaacucauauugcuguuuuacagaugagcaaguuacaagaaacguuaggcagcucagacaaaagagcaauaccccaaacaccaaaccgaacaaauaacaaauaaaaagcaggagaacuuuucccagaacuaaguguccuugcaaaaacuggguucagaacaguaaauaucaagguuacauuagguaauuacuccagaaaaaaaaaauggcacuuuuugcuuuucuacaaagacucugauguucagguggaaaaugagucuuaacaggugguuaagaaauaaguaaccagugguuauuuccgugaggcuuugaguaagaacagugaaugcccugagagguguggcagcagacuugcucccccuaccccuccaugcagggacuaaaagcaccaugaaaaccuagaggcaggguacaagcuaguguugcuucuuuuagcuagugaguggcaucauacagucccaauccugugggcucugcuuuuaaucccuggggcugucagugauuaguuagcaagcuaagcaucuuaccaggacuggcuucuuccuccuucacaaacugaauuguucagcaaacauggugacgggcagaguggccauuguugguucuuuggcagaagaaaagccuaaaauuguauuccuguauccuuugguccacaaugaucuuacugcuggcucuuccuaaaacacugaaugggccgggcagugguggcgcacgccuuugaucccagcacaagggaggcagagacagguggauuucugaguucaaggccagccuggucugcaaagugaguuccaggacagccagggcuauacagagaaacccugucucgaaaaaccaaaacaaacaaacaaacaaacaaacaaaaccacugaaugacuaggaaggaagaccucuaggacagagggaacucaauccuuacaagaacgaauccuguucagaucauauggucagaaccucagugugguaagcuaacagccuuagacucugcagucuccaggccagcaguucugguaagagugugggacaggaucggggugggaggugaggcagucuuuguaugcuuccugaaggcuuaucgaaccauuuccggaagagagcugccaaaaacaaacaaacgaacaaacaaaaacaaaacaaaaccccauaaagacaggaaacagagggguguguuuaaaaagcuaggacccuauaaaugguugguccuuggagguggcaguuuaaaauuaaaaacaagaguggucaacucacugccaccacugccaccacugccacccgggguaggugggugaagacacccagaggcucgccggcagccacaccaugugguucgggucaucggagaacaacgggaggccugccugcuuuguggcucacuucccugcaguggaaguugcuaugaagggcaaguauauggugggcagaugggagagaaucagaauaguuugagcaucaugaagagagaugcaacuggagaggaguagucuguugugauagccuguuucaccugccacccuagguuaugaccaagucccugccaugucgagguccaugcccaugcaauagcagguggcuaggugcagagagguggaaggcaucucugccacgcccacaccaccucaaggcagcacaguagagcuagcuagaccuccuggccagcugaagcuuugggggagcuauccugggcaaugcuggagcgcucacccuggagguguacgugugggagagcuggcgugcugaccaacucagcugccaucaggccuggauccagggcgcugaguuaguccaucuaccucaucuauggacugcuggagcaugugaaggggccaguccuucagauccguaacugcaagaucuccaugacacagggcaacaacaggauaagugagaggagucccggugaagaucugguaucgauaguguaguagaagccagagaccuuggaaccaaggccagugauucauugcaaggaacacuugcaaguaaagcuguauggacaaaguguaugcugugugacaugacauaccacagcuuucacaagaacauuuuuuuauguuuuauuuuuguuuauuuuuuguuuucuuggggagaggguugcaaagacaaagaggguagauaugaugauguaggaagaugagaaggacuggggugcaugaugugaaacucacucacaaagaaucaauacaaaguuguuguuuuguuuuugguuuuguuuuaauucccaaauggaccauagacuauaaggugguggccaaaagcagaugaaaugguucuugucuuucuguucuuauuuauuuauuuauuuauuuauugccccaauuucaagaacuggugggucugugucuauagauaccaaaaagaaaacaagaagagagaguuuggaauuuagugugaggguuucacaauugugccuuccuccuccuacuugggaauguucccuuuugacauaauaacaaaucuguugauguuugcaaagguuuagccauggaucuugcuucuggaggaaaacucagacgaggauuuaguaaaucuucuaaaacaaaugaacuccuagagacuaggugaguacaaggccacauacacagaugccagagcaggguccagugagugaagcucugagagaaggggccuagcgcaagcaagccugagagggccugaccacgucuuccuuugaagcugcuagcugagcuugugguuuauaaggaccccuagauuuucuuuuguacauguguauuaaaguauguguacaguguguaugugugaaguguuccugugaugugaaagccaaaggacaagcccaggucucacucuucgggcaccaguugacucuucucacucuccggacaccaguugacucuucucuucugaagcaguguuucucaccgcuagaaugcaaguaauuaggcugguggcuauugaacaccagggaaccaccuaguuuuguccccuuaucccugagauuauaaacgcacuucaccauuccuggcuucuuuuuuuuuuaaguauagguaccgaagauuaaaaucauagccucaugccugagaauugagcaguucacugagcuaguucuaugauccuguuuaugucuuggcuguaucagaaagggaauacucccucccuuuaaucuggaagccucugagucugccauuuuuuacaaauaagcuucccuuaaaaagauuccuugugcucacauccauagcugccuacgucuucauccuagauagcucugcauaaugagucuacugugauauaaguugacggucugaaggcuguccuagagacuaagugggcaccauguuucccaggauuucaacgguuaccuaacaguuuccauguggaaaccaagguaacguucaaguccuuucucuuucuaucuucagaauggcuuccuggagcucugcugucuggguguguagucacccagaaauaccaccacagauggccagaaauggcugcucuugucuggcaugguuaagaacaagugacauuagcuuucaacuuuaucaguccuuuugacauuucucaagagucauuaaauuuaucagcuuaaaucaugaugucugauuuaaagauugaaaauuugcuugaaguauccuuaauacauuuaagaaugacaauguguucuggauauuuauauccuuuuaugaacuagucauuagagaaccuuaguugucugaugggaacaugggcuuucaaccuacuuuauucuauguaaaaaccgugacauccuuuucuauuugaaaaugugcaccuauuaaacuaugguuaguaauuauuccuacuuuauguuuaaugcuaugacuuuuuuaguuuauuuaaugugcaugaggugguuguaaauuauauguaguauguacaggcacuacaugcaugccuugugcccagcagaagucagaagagagugucagaucgccuguaacuggaguuacagacauuugugagcaaucaucugggcacugggaaccaaacccggguccucuccaagagcagcaaguacucucaacuacuaggccaucucuccagugcccccauucucagcccacacauucuuguguacaccauauagaacugucugagauaggagagucuaccaaagucuuuaugccccccuaaauaugugcuuauuuguauguacauaaauguuuguguacucauuguauaguaggcagggauccaaauuguagaucuggcugccucugccucccaagggcugggacugaaaauguauaccaccauguucagccccaaauuauauuucuuggaguggagggaaaagauugaagauacauucucuugcugugaaaaauggcuuuaaggcagugguucucaaccuucuuaacucugccacccauuaauacaguuccucauguuguggugacccccaaccauaaaauuauuuuuuguugcuacuucagaacuguaauuuugcuaguguuaugaauuguaauauaaauaucuauuuuccgaugguugcuugagacagguggagcucugugccacauuugucuaccauagucaaaccugaagcccccuagucuuguuuuuaucauugcucuguuuacagaguugugcuuggugcugagucaacucuuccuucuuuuuggacucggaagggucaggaaacauccuuuuguaggcauuuacacuugguucauacuuuuuaguucaagaacauuuucauaaucaggggacuuaacuaggaaaacuaaacaugucagcaagaagaaucucaggcuacucccacugccggugcagcauucugaaaugccaaugauuuagaccaugggaaccaaaugccauuguuucacauacaggaaaaucaaguguuuuuugcaauggaccacagacugcaguagccuauguaaagguauuuguggaagcaucuguaaccagaccuuggcugagguuagcuauuguuuggggagacugccuuuccacccagaggaagagggacugugggaacuaagauaucucagagcagugaauuugaucccgugaggcuaucuugcugcuucauugucuacucuaggucaggucaacugugucuuaugggcccuggucucauagaugguuccauagugcaagguuuccccauuacugucacuggcuucaacccagccccaccuugggcuuguugacaagauuuucaauauacaagugaacuuccuguuuguuaucucacaguuucauauagagccaacacacacacauacacacacaaaacaaaacaacaacaacaaacccuguuguaccuaaaggguaaaauguuuuuugaagaaaucccaauagggaacaagcuugcuaagaggcaugggaagucaauuguaaacacuauugugcaucugaaucaugacaguccaggauaugguggcuagaccuaugcaucagaaauaaaucaugugacaucauaagacucaguccugaaaaugugaccugaguuuauagauuuuuuuucuuuagucauaauuuauugaaaagagguaaaguucccuugggugcugaaaaguccuuuuagaagaagaaauggccaggagggguguaagggaccugagaaggguuucuagcucaaugggagugaaauccauguugaugccacuggugucgcuaaaugaaaagacagaaagauugccagaugcuuagcauuuauuauauguagguauauaugccagggaauacagucucaaaaacgaaauacagagucuaaaaaggauaggagauaaauucuggggaauacagucucaaaaacgaaauauggagucuucaaagguuaggagauauaugcuggggaauacagucucaaaaacgaaauacagagucaucaaagguuaggagauauauacugggcaauacagucucaaaaacgaaauauggagucuucaaagguuaggagauauaugcuagggaauacagucucaaaaacaaaauguagugucuucaaagguuagaagauauaugcuggggaauacagucucaaaaaugaaauacagagucgucaaagguuaggagauauaugcugaggaauacagucucaaaaagaaaauggagauucuucaaagguuaggagauaugugcuggggaauacagucucaaaaacgaaauauggagucuucaaagguuaggagauauaugcuggggaauauagucucaaaaaaaugcagugucuucaaaagucgggagauaugugcuggggaauacagucccaaaaacaaaugcagugucuucaaaggucaggagauauaugcuggggaauacagucucaaaaacaaaguacagagucaucaaagguuaggagauauaugcugggaaauacagucucaaaaacaaaauggagauucuucaaagguuaggagauauaugcuggggaauacagucucaaaaacaaaguacagagucaucaaagguuaggagauauaugcuggggaauacacucucaaaaacaaaguacagagucaucaaagguuaggagauauaugcuggggaauacagucucaaaaacaaaguacauagucaucaaagguuaggagauauaugcuggggaauacagucucaaaaacaaaguacagagucaucaaagguuaggagauauaugcuggggaauacacucucaaaaacaaaguacagagucaucaaagguuaggagauauaugcuggggaauacagucucaaaaacaaaguggagauuauucaaagguuaggagauacacguuggggaauacagucucaaaaaugaaauacagagucuucaaagguuaggagauauaugcuggggaauacaaucucaaaaacaaaauacagagucaucaaagauuaggagauauaugcuguugaauuccaucucaaaaacaaaaugcagggucuucaaaggucaggagauauaugcuggggaauacagucucaaaaacgaaauacagaguugucaaaggucaggagauauaugcugggaaagacagucucaaaaacgaaauacagagucuacaaagguuaggagauaaauccuggggaauacagucucaaaaaugaaauacagagucuucaaagguuaggagauauaugcugggggauacagucucaagaaggaaauacagagucuucaaagguuagguuuuacacuuucaaaaucgauuaacaagguaucaagggagauuacaaguacgguuacauugcaaaacacaauccucuugggauacaaacuaacaaugacuuaaauugaucaucuacagauacacuuuucuauuggugauuacaaacaauacuucagaacuuaagcagcuuaaguaguagguuaagcuaggcaaagaaaauucuuaucuaauauacuuaugcuuuuuuuaaauuccaguacauuuucuuaaauuccuguuaaaaaacauaaugaguaucacaguccacaaaacacuuuugauugauucuucuuucaauuaguuggccacuugacuugguuacacagugauuucuuucuucugucagauaugacugacaaccaguuuugucuuuaagauaaaugaagucguaacucacauuggaacaacaucacaugaaaaauauugaacaguacauuuaaauucacuuuaaaaaauggagacaucaauagcgucacacucuauaaagcuacacaaugggcaacaagaagaagaaacuacagaguaagcuaacaagaagaggaacuaaacuguccauuucuuauagacgagucccugaaaagaaacacacagccuaguuauaaacgccauacaaagauuauccccuucucuuaaaaacaccuuccaaguuggagaauuccaaacuuuaccaucauccccuuccuaggcuacacacaguuacauagcuaacaucacuacaacagcuuacacucaacacgauauuuacaaaauagcagcucauguuuuggaucuuaucacguaaucacgugauuauaagauaaugaggauaauaugaggguaauaauaugaggguaauaauacaaggguaauaauaggauaauaugauaauauuugcaguuugauuacagaaugcacacacgcucacuaaauuugguaggaagcaugaauacuaaggguauauauuggcacaacgcaugcaguuagagaauucuuuuucucaagcuacuuaugacaaauaagcuaaaaccccauuccuguuuuccaaugcuucuccucaaacuguaacugauguuuaaaacaucucccacaagagaagcacccucuuaaaaaccaauuuaucuaaaugcgugauggaaauggggcaggauagcaguguuggagccagcugugaaaauauggggaguuggggguagggggggcuggcccagauucacagcacucacugcuauuugggcuucuucuggcuguggcucuuccgcuuccucuuccucuuccucuucuucugccugugccucugguucugcuccuuccucugcuccuuccucugccucuucuucugccucuuccuguucuuccucuggcucugguucuggcucuggcucuggcuccgguuccgguuccggcucuggcucuggcucuggcucuggcucuggcucuggcucuggcucaggaucaggcugcugcugagguugcaguugcggcagcagcugugguagcugcagcugcaguggcugcagcugcaucuggggcugcaucuggggcuggaucugcaacugaaacuguggcugcaucuguggcugugguaguggcuguggcacuggcaguggcuguggcaguggcagcggugguggcggcggcaguggcgguggcugcugcugcgccagacagguuauccuauggggcaguggcuccccaggccccacagggauggugcuauucacaaagccauucuggggaguaggaggggggagcugccaaaaccccaauagggaggaaaucuccagagaggcaggaauggcuauauucacagcaucuaccagcagcucuuuggacagggugacuuucccaaaccccuccauaggcaucucaaaacauggguugaacuugagaggcgccugaggcucuugcagaggaaauuccucaaagaaacccacguugcaaaaggccuugccaucugcuuugacgggcaugccuacaaauggggcauaugagguaggaacaggauuauacuuaugcuccugaagaauaauugggggaggagaggugggaacuacgccagggugcagagugaaagacggcucuggcauuggcagcauuggcugcauuggcugcauuggcugcauuggcagcauuggcugcauuggcagcauuggcugcauuggcugcauuggcugcauuggcugcauuggcagcauuggcugcauaggcuccaaaggcugcaucggcuccaaaggcugcaucggcuccagaggcuccaaaggcucuaaaggcugcaucggcuccaaaggcugcauuggcuccaaaggcugcaucggcuccaaaggcugcaaaggcuccaaagacugcaucggcuccaaaggcuccaaaggcuccaaaggcuccaaaggcuccaagggcggcauggguuggggagcuucuucuggggcagcaagcacuagaccaugaaccucggguggcaagccaccaucaagcccguucucgggagccgcuccuagcuggaaaggaggcaugggaucaaccuuuaucuggaacgaaguugaaggcgcaaugaguuggaaauugcucugguaaucuccugccugcauauucucuugcaucagcuccugggagugggucuucuuggugugacgagugagguggucuuugcgcccaaaucucugggcacagaacugacacaggaaguccuugcauccuguguggaccaccagguggcgacgcacaucuuuccggguguagaagcaucuaucacaguggucgcacugguauuucuucucccugggugccugguuggccuuuucuuccgcgugagacuugaggugguccagcaggaccucggugcuccccagcuccagggugcacaccccacaggugagaucgccauugcucgccgagugcagggccaggugccucuuguagcccagcauggugugguacuucuugccgcaaucgucacacgcguaggagaucuuguugggaucgugggucuggaggugguucuucaggugguccuuccgguugaaugucuucucacagugaguacacuggugaaucuucuguggcgaguguguggccaugugucuggaaucagaaaggaggaggcacaguuugcaagagaauucuuuuaugaaggaaggaaagacagaggcaacacuaucaagauguuaccuguuacuuucucuaggucuuagugacauuuucacuuauaaacuacuuuuucuguauuuucccuauggacacaacacuuuaccauuuaaaaagcuaagaauuacuaaaaggcagauucaacuuuaugccuauaagaaagacugaauuucccuguuaucaauagauuuauuuaaaaacaugguuaugaaauauauuuuucagaaagggguuaaauagguauaugauacuuuccagaaguuucugaacuacccaguuugaccaaauuugcauaaaacuccucagugccacguuagguuggcgcccaucacagcucuuaggcauucucuacugauugagauuaguuuaguuuuuaagccaguccugccucuauauucaucuguuagguaccauaugggauggcauagccacccaaagccccuuuggaguacauuuuaaacccauucagcagguaguucccaucaugcuucagggugcucauuccgaggaagacauccuuagaauccagucugcucugucaaaucagcuauucuaacccuugguugucucuuccuaguagcuguuuaauguacugggacccacauucccuuucugguuaagcaaggcaccuauuucaugucaaucucugcuuauaaaauggaacucagguggcaaugguugggcacuggaugcuaugcugcccuuuaagaugaacccagccugcccucuuaguuccuugaaaguggauagccucuggccagggaagacagcagggcugggacaaggaacagugggucuuggauaauguccacugcuuccugcuuuuggccuacuuuccaccuugauaaaacaaaucauuucuccccaaccacuaccucuucaacagcgcuuaaagcacccauuugaauucccauugucuuucuaacuaacucuauuuacuacaauaaucuuuugccccucugugcuuucuccccaggccucccauaggacccugagguggccccacugaagccacagcuacccucaguguuuaaaucaggauggccucguguacacaaaaugagucugauacuaaccagggagccccugacacaaucagugcccgugguugggcccuugaugcuguuacuaugacaacuagaaaagggccuacaacugaagacauuugaaauguaaguacagaagcauuuucagucuuauuuuaaacaucaacuuauauuacauuaucagugaugguguuguucuuaaggucaggagcauaauuuauauuuuccuuuuaucucuuuuaaguacuuuccugugaaguaccccgagauggaaugauaauguagggcuucuaccacucagacuggaagcuggguugcugauucucccaccuaugcauuugaaugugagucgucagcaaagugaagcuugugggaucauuuugugacgauuagacacaagcaauuccaagagaaguacacagacagcguucacugucaguuaggcuguagucugaucgugugguuugucaaugcugugguauuaccaaaauccauuguggacagaauguacaucuuaccuaauaguagugaguacauaacacuagagaaauaauucauaucauauaccaacucucuuuuauaggauucaugugaaaaaucacugcuuugguagauuguggagucucugaaagucuaagaaauauacauacacaaagucuaaacacacaagugaauuccaggugccauggucaucaauggcauaccggacacuccagucaucacugacaauagggcuuuaaagagugccuaaaaggcuaaaugcacccacacucugccuucuuuccccuucagcgagagcccugaaggccugaagagacacuuaaaggcccaaguaaaagcgcacccccuucuaaagcaucucaccucaucagcuuauacuuggagacgaaggcuuugccacacucagccuucgagcacuugaaugggcgcucccuggagugggaauaauugugaauggugaacuucuccagggugacgaaggacuugccacauuuuugacagcggaauggagccauggccuuugguucucacacuuucuucuucagaugugcugaggaacugcugugccauuuaagcccagacagaaagaagguggggagucacuacagccugacuccagaaaggcagcgcuacagccuagcagccaggagagauccagagcacaauagcuggguaucugcagagagaagaggaacagauuucucacaucagcuauuggaaaacuguauccccccaccagcaccagcaucagcaccaccguauucaagccugcaaucaguauauucuuuuaagagguucagaugggccuggcaacccauccucccuuucuugcuucccgccccucuggagccucugugcucugguggcucaugaaacacucuccuaacaagaacugcuaccuccauagacucaaaaucaucaacuuuauaguuuucagaucagugugagacucaguugacucaaggggugugggggaggggagggacacaagccucccucuuagugcguuauugguucacaaugaccaccccuuauucaaaccaugagcuuuugcucuucauacacuguaagcauaaaagagguuguuuccaacaccuguuuaaacucuccgaggauggaaagacuucauuuggauacaucucagugaauuuguuuguaagaucacuaugcaugaggcccaauacaaacaagaauauggggacauggagucuaguugcacugauguugugcaccuauaaacccauaaaguacaaaacucuccauuccaccucauagcuaaauuagccaguagggagaauucuguaaucccaucacugauuugccaauucagauauauaggcuguuugcaauuuuuuuaucuaaggaaauuaauucucugcaagucuugcuuuaggagaugaacaguaugcccaacagaacuuucuacaguggagaugugauaugaucaauugcccuccccccaacacacacacacacacacacacacacacacacacacacacacacuacaaguauccugcugggaagccacaauuaucuuaagucagacuucagcagccacaggcagcuaguagcuacuguaggggugacagaggcagacucuuagauuccaugucaagagaugagggaaaggcuagguuucucuugcacgugacuaugcuacugacuaaaccucggguguucugcugaaacacagggcuuucguucagcuguuuuauuagcacagggggaggggagcaagguuccccaguucauauuccaguucuacugcaaaucccagcaucuugauuuauauaaucacauaguauacaugaaugggcugcggggaacaaucaacugaaacaacaauaacauaaucuucccauuugugauuauaaucugaaggaagaaaaucacaaaauauauaguauuuauggaauaaaggccaagugccaugguguagcuaaugguuccuagauauugagcuauguacacaucugagcaguaacaugcugucuaccucuguauaugccuccaauaacucaaaguagaaggagccagcauggaccagagacgugcagaaagaagauaagaagcgacaaaaagaacaauugucauuucucugcagaugcaacccuugacugagucacugcuuaucaauacaccauggauaaaacagaaaaacaguauuuucuccauucuuacagcugucccuugacacuacagcuugccagccccauucucuugucacuucuucccuugauugcaaauauccaacaauugugacuucauccccaccauuuccccugggccuuccaggacugggugcaaucagagacagaugaagcuaggauuuacucaagacugaggcagauuuccuccaacuucaaguucuuuagacagaaaaagcuccacauaaaacaaaaucucucaaaugccuuauacuuagcuuauguccuucaagagcagccuuuccuagaacuuugucauugcuuuuucuauguuguguuaaauauacccagcguaacacaaaaggcaagacucacccucaaacauggagcuaauaaaccauaccaaugagaacauucuuaaucucuuuggguagucuuuuagcgauucucaguuucuaguauugauauucuacucaacauccuugcauauagauauacaugggaauguagaauacccaaauuagcacuguuuuccugacauagucaaaacguccacuaagaaaaggcuagucauguaaauauauaugcuaccucucaaccaacccuuaccuaauucauacuagcuguauacugcuaauucuauucccccauuaaaguuugaugugcuuaaaauagacugucuacuaucuagaaaaccaucaacaauugcaacagagucgaaggacaaugguccugaagagagucaaucuguccugucucuggacauacaaacugcauuagaaucucacacacacauaguacuacuauuucaacaccuguugcccuggaaagauaguaagucuuccuccccagccccggcccaaagucucaggauuucauuuucaguguccccccauucuaaaaauacugagugagugauagagaucugccaaagaccuugagccaucugcuucauucugcucauggugauuauuuuagggaugggaggagaucaggcuagaauaagaaacauauauauauauauauauauauauauauauauauauauauauauauauauauauauauauauauuuuacacacacaggguaacagccaggaagacuguccucccugggggguagagguaugcaacuguaaagcaagaggucagagcacagauggagacccaggacuuccccagugcuacaaaacacaaucaucuaauggggaacaacuguuuuacagcauucucaaaauaaaccaggacuucugccuccuguuuccauuguccccaguaacacaaagugaggcccacaagugaggaaaugggauuuccauuuuggucuuccaagauggauauucuaaguggcuugggucuuuggggguggggguaggguugcuuuugagcacuacuaugcuacggcuuagaggauaaaagguucugagccaugauuucucucucacauuuuuaagggguucuaaauucaaaaagaguuuaaagggcaucccgagguaagaaacaagagagaaccccuucugggagcggucaucccacuuaaaugcuuacaaugaacuaucuccuaauccgugugcuacguaucauuugccuaugcuucaucagaugaaaacggaagguucuaugacaauguuucuuggacaauuuaagcagcaaacaaucuauacaaguugaucucaaguguguguacaggugauaauuuaauagguccugucccagaauucaggcugcucaccaguggcaaggguucauuuguaagccuauuuuagucuucuguuaaguauauaacgcuuacuacuaagauguuagugcuaaaauccccugacauuugagcugacacaucacuuaaaagacacuugccugcgaugaacucguaaauuggcucuacaaggccugucacucugccaugucuacagaccucucucccauggccacccaaaggcaaccaaggccaaagaucaguccacuggguuauuuccuuaaugugcaacauucucuuguagcaaauguguuuccaguccuggaacguggacaauccucuaucugcccugcagacuccuguuuccuucucucccccagauggagucauaaagauggagucccacacugugggguuuacucagcagguuggcagacacuccccaccuacaucugucuggaaaucuuucacuuaaauucacauacauuggugggaacagcuccacuaucaccccugggacagucuccccacagccagcugaauaaucagguuugcugccuguggacucuuuucaacugucauuaauuguuaagccagugacuagaguucuuacucucuuagaaagggggcccauacuaagaaagccaaagggaaguuuuucaaucuaauauucaagguuaaaaugcagggauuaauagaacugauugaaccaagcuucaggacaccaaguacagaccagaccuauacauuuucaaaggaacaacuguuuucaguucacaaacacggugacuaugaucaauucaagauggggacugacuucacgaaaguuacucugccuacucuugaaacucuacuaaggacaaagucacaaggguccaaauguguuacuggaggcccauguugaugucccuucccuaaacaacaaggcuuccaauugguuuucuuuugcuuuugguuuuuaugaaccaccacucacuguaaaggucuaagagagagugauggguagggccagaaauauauagaccaguuagguuucugcccugccucuaaagacagaauuggcuccaauaccacugggcgagcaggcuacuuagauuaguaacugggccagugcaaagagcacaugguguuaguaaggaaaggguccagagaaaaacccugcaaagaacaggaguuaaucuuucugguuuaggucucagauucuuuuuucuuaauggggcucgggacaccaaggagacugaaguacuaaguugcuggugucgucugccucacuauggaagagaugggacacaucucaacucuccuuggguggucugggauucugucucaaagcucaucacaugagcacacuaacucaucaauguuucucuucccugggguaaacugaugaaguucaccagcccugggguccacacaaguuuguuuucuuugaggcaggcagaagccagacuaugccuuccccuuagcuaucuauuuagggcuguagagaaggaagcaggccuaugggaagaugaagaucccagagccccaaagacagaagucucuucccauaaauuccccagcccugacauugcaggauuaggcuauaguaagaaaaaucagcaaaugagaauuaagucucaauuuacaaaaacuuauuaaaaugcaucuaaguaacuugugcacaguggaaguauaaaggagacccaaacagcuuaaaaaugaccaucuuugguugucccauccacuggcaaaguauaaacuuuuuacagaagggauuuuucuuuguuaugguuuguuuaacccucgugugcuaauccuggauuugaauuuguacaaauggguaccuggguguaugugcacacagguuaagaaaccagaaagcagagcaugagaagaaaacaggagaugggggugggcagaaagaagagaauauaauggaauugcauggcaggagaugcaggaggggcugccggaugcaugggguggggggcaggaggaaggagaagggaggggggagaggggaggaagacacacuaacuaguaagaacaaaaguacacauaaaaaugucacagugacuacuuuauaugcugccuuuacaaacuaauaaaaguuuuuaucuagagggcugaagauaccaucaacccacuaaucacggaguuuauacccaggaagagagaaaggaggaagagggaacaauagcuggagaaggcuggcaaaaccaccucagcuggaaugggaaguauaggaaccucaaagugccacagaggaaggagcugugcaggcacagcugggguggggugggggggggggugucagggggcagagcguagggccuaucaccacacaaguguccucugucacagguuuguacucccucccccaacaccaucaccaacccccuucuccuccuacagaguggacuugggagguggguaggggaaagaagggucuggagugacuccauucugacagucucacaggcuucugagggaugagagggagaugggagaagagaacccaugaaaggcuaguuaucuuugcagacccuuguucugccacucggcauccaucacacguggaagaaaaggacaacugucaucucaaggggagcccaacggauaggcccacccagaaacuacaaauguugagucccagacuggcucggaagcugggaugguucaucuuuguuuuaagaugacuauuucuugguggacacuggguagcccugugugagaugaguggcggagaggcagccugacaagccagacaaaagccuuugcaauuaggagcacauauucuaacgucaaagucagggguggagacugcuccuuugugacagaugagaacauauuccccacuccacccucccuguaaaucccugcuggcuggccuuuagaccucuguagggccaccauucuauagcugauaggcgaucgcuucccuugcgauucucagaauagggcaugggcaaccagaacucuaauuagcagcauguccuuuugucccaauaaaaccaucguucggggacagaaaagaaagccuggguccuuucuaggaagugaggggguacagguuaauacugagaaaaacaaaagccaucuggguuacaaugaggagaggaagcuagaucuaugaguuaagacuugcaggaagagacuuauaaucuauacuguccagaggggauucucaaggcuuggguggguuggguagccucacacagugauuucacaagauaaacaggaaagggccaagaauguggacaccuacacgucugucagauggccuggaugaucugagggucuaauuuuugaugcugagaaucuauagagccugaguucugcuagcuucugaguagaccguuuauacacaagguagacaaaaggcaggggcuaugugcugucagcagagagagggacagagaauggugacauggaacccagguuuuagccuaucuggaggcaugaggugagagaaugaggggagagagagagaagguacagauuaaacuggaggcccuucaggcauaucagagcagacucagggagcaguaaguggucuuuggaggucagggccuggcagcagcagacugccuaacagagaggccaucagucaccgcucccuccuauagggaagcucccagugacucuuuccacagugaguccaggacuaaaaucaccacagcacacauuugacaggcacuuaaaaaaugacaaccugugugcuauuauuauuuuuuuuuaaagcucaaucaauggauggcuauccagaaccuagacucugugauuugaaaaagugaacuuucuguaucugcaaagcaaacuguucguguagaaaaaugaaugugaaaugcaauaguauuucauuaucgcgccuuuacaguucuugucugauucguuuguuguuguuguuuuuuuuuuaacgcuaguaaacauguuauuggguuucugcuugucuuuuuuaacuguuauguaaagaaaggaggggacauuucuaagcuuccacaugaggggaggaauauaagggaaugagggagaaugcuuaaaaggaaagaaacacuaauuaggcagcucucucucucucucucucucucucucucucucugccuuaaaucgccccaccccaucccccauucauagcuuuagguccuuuguguaacagaccauuacaaucauacgcacagcacuguucaaugggagaggaaugugaacucucuaaguagacguccuggcaauccacauguguggucccucccccaacacaguggggccccaucugcccuucugagcuccaagccuccuacagggcaggcagccagcuuacaauaaccccaacuucccauugaggcauacaggcagccccuuccggggaccuauagccgccuccaagccucucugcccuuccccagguuggugcccauccuggaugggccuguccccuuugacccccuuaagacaggugucuccuaagcccuuuucuuucuuuagccugugagcucucgccugaaugcuaggcagacacauuccagaucccccuguuaucuguccucugaagucacauguacucuaaacagaagacacaagucaaagauuccucuucucuagccuccucaaacaaguucuccgggccuuuguccauucuugacagauaauggcugacccuuuugguaugaacuuucuugaaguaccuuggaccuccaucacaucccugcauuccugaguuugccaugugcuuccaagcaacuuuguuuuuugaggcuguguaucccuggcuggcuuggaacucuguaggcuuuguacucauggauuccaauugcucucugccugccaagggcugggauuaaacacaugugcaccaccacgccugacccaagcacuucuuaugaagcauguacagagaagaauaauucuuaaacuuccguaccuucugugagagcaggaaagccagcugugaggcagauauuauggaguucuguagaagucugaagacucaaaccugugagaagagaccuuggacaucgucagagaaugaagcuagaauauucucccaugauucuaccucccagaccuucuuucgugagcauaugcccccuuucugcccaggugugguauaaaagagguucccuacugcaccucaauagauggucuuuauuuaaaguauauccuuuguccuacaugcaacuggauuagaacucugaagcuucccuuagcuuucugacagugggggaaaaaaaugaaauugcuuacacaagauauucaaaacagcacucggaggaaaugguguuucuuuuaaaacaacaauauuaaaaugccauaaagcagguaugcaaaucuaggcaguaacagcacuugaaacaaaauuaugaauggaaagaaagcagcaacugggugacaugcauuugacaguuuugugcaagcauauagauuuagcaaauuugcagugcagaaaaggcagacaucucuaaguugaauauguagauaaguggguacuaaaaugacugcauuagaauuagcaggaaaggucuuuuguuuguuuuuuguuuguuuuguuuuguuuuguuaauagcagauuccaaggccacuucacaaaucagcacagacugaaacaacgugaugggagcauggaaaaauguuuuccccuaguguucaagugccuggauuucauaccaaccauggaccacugaacgcugacacauacuuagaaaccuacacuaucccuguucaucaaugcaucugaccacuuggccucuuucaacugaacacuauucugccaaacugauuuucuugcagguagagaggaugccucaggguuuuuuuaaccacuaugaagacaacugauuuugagagccaguucuaucucaucuaaugguuuagucacaggaccaccuguucacuuaaucugaucaaagaggcugugucuguuuguuuaguauagaaacauccuuuuaaaugcagcuuucuuuagacaaguuuaaacaaacaaacaaacaaacaaaacaauuaaauacaguccagaaaaaaacuggaggugaccauguacuugucugaaccuguuuguuuucugucugguccucguucugcguguguaaacagaccgugugcauggguucaucuaauuucaaaauucucuacaacaacuaugaucauuuaauugggugguccccagaagccuggguuaacucuuauuuuuuucaagagauuucaaacacaugaaagcgaaagaauaaaauuagucugaaugacucuucauugagucugcccaacuccccaguagacaauaccaauuuauggauucagagaggaggggcucacuucuccugcccaggaaggggcuuaagggacaugagguucgcaagccaggcaguagaguagcuuggcuccauugucaaaauauucaaaucaucccaaagagaaagccauucuuuucugccuccaacaaugccuggcagcagcggacacacaagagcuuacucuugugguacacagugugaacggcccugaaagagggcugccuagcagggaagagucaagcuacucagccuuucccaccugcccacccagcacugccucacauacacaagcuucaacagugcuggggcgagggggugggugggggcaccuagagcaggccagacagggcccccuuggaggacagucccaugcuucaugcaacagugugauauagcagcaaugagaccaacaagaaaaagaaaacgcaucccucugccuuugacaggaugcuacuugcagacugcuuuucaggccuuagauuucaaaagcugagaaagaaugguuuucaagugucaacugaagaaggagaaggaggaggaggacgacgacaacaacgaugacggcaacaacaagaacaacaacaacaagcagcagcaacagcagcaggagaugaaaaugacccugugaaauuaagcuaugccaaagcggugucucggaguuccagaagagcaagaaaaaucacauuuuuuuucuaagaagggaguuuggcaugugguaaauagaaucacauuaauuaguuuaaaugaauuuuuaaugccacucacggagaacacaaguggaagcuuuaucaaccuagcguguaugauuucuaggauguccgucugccugugaaguaaguguguuuccaguuuacaaugugccugacgcucaguuaaugaacugcauuugcuugcugucugaagugaacauucacagaaacucaaggugaaucaagagguuucuugcauuucggcuugcccacuuugagauacuccuggucugaucuaagcaaaugcuugaaaccuuuagucuaagaaucugcacgagaaugaauuagacagugucagaugucgccguaaacuguucuaaguuuuagcaagauuccucuugcuuaaggaugugugggguuugcuuaggaaagucaaucgagcagguuuuuauuuuuugaaaaccaugaccugauauggaacggggcccacugacuugaaaacuuacagacaaauaaagucuucucacagagauggaucauaaaccaugagagucuaucuucgaggagaccuaggagagacaauauucucuuccaaaggauguuauuuuaaaaagaggcaggcugaccaagggccacaugaaauuuuaguagauuugggggccucauuucuggccucugcacucuuauuucauaucaucuuuacauuccccauucaugaaacuuaagguuucaaagaguuccuaaguucacaugccucccaaaccuucaacccugaacuuucuuaaaauccugaauaaaaacuccuuccuuccugcuguucccccuccuggcuccgccaucuucuaaguagaggcuuccccgacccuccugguggguccuguccagcgcuguaacaccacuggauaguuacaaccaccaacucuuggaugcucaccagaccauggcaauguuaaguccuuagcacccugggcaaucacaggaguggcccuguguuccuguccccuuacuuauugacaaauggaggcuuguaaguaggcuaacuugccugguaacuagcaagcagcucaacugggugugaauccgggguguguggucugacaggaaguggaaguccuuaugcucuaaccuccuggccucuacagagucaggaauucuguccugacuuuagauuuuuuuuuguuuugcuuuuuuuuugucccccccccccccccacacacacacaccugaucaggcugcguagaucaagcggugucugucucucaaaucgguuuucuuuuuuuacgguugccuauuuauuguucgagugccuuucuuauggcucuaaaucagcaugguggguaacagguggaagguuucuaaucuuucauauuuucuuccagcugaaggcagacaagacuuaaagucucuuuguuaacauuuaaacccaccagagaaauucggcaggacuuggaguuaacuccagaaggaaggacagauaggaggauuuaaaaacaaaacaaaacaaaaaaacccucuuuccuccuacucuauguaacccaguuuggaaaggaaaaggcagucuguccgugcagcaagggggcccugccuacaagggcugggcuaggauucccugaccaggcagcuguaugggagcaccccuucgagggagggaagccaaccuccacuaggucuccagcccccacuuccagcccugugagcucagcccagacagcuacaaacccucaagucauaccgugauauauauggagggcagagggucaguucuccucaccuuucaggugccaugaaaaucucuagauccaaggaaacacucugccaguguaagcaaggcaccuaaaaccaaucuagagggcauuccuucagcugccuuccuggggacuguacucuagcucgguggcuacggggaguaacugucucuuugaccuuggacagggagaaucagauugaugggugaagccucgguaaggaaccaaacaucuuccuuagaagugugccucucuacccuagcuaggacaucugggacugaaaccaaucugucaaaaacaaacaacaaaggccaccuggguuuggagagggaagcuuaggcauuggaggugcuggaccuccaguguuuaguacccuggagcagauagagcaggagaucagagacaggggguugguguuagcguauacucacaagauuaacuccucugacuccuaugcaaauaccuagggagggaaaggcacacaggguuauuuuaagcccuuaucuuaaguucuaaauugccaaaaccaaacaaacaaaaacggaaaggaagccuacuuggaagaggcaagauguaggccagagcaguugcaggccaagaucuaggaaaccguguuuccuaaccuagguaggccucccagucaacaagcugggacagggggcggccagcugauuucccuaaaaugaaaaugaugagaccugagguacuucggcuguggcugcacgucugagaccuauagaacagguuuauggaacagugaccguucacagagcagaguuggcuaagacaguccugguggguagccaccuaccuucccaucugugguacagaaaaccuuggggggaaacaaugggaaaaaugcuaaagaaaggaccaggccacuauuuugguccagaaagaacuuucccauggcuuccuugaaacaucaaccagccuggcgaacuagaagccaggcgucaggacuauggaagggccauugccacaugcuggugccugagguucacacuggucucuguucuuagccuggcuccccuuccuucuaaaucacaauggcccugucagcgucacuuuuucuaacaggccaagguauccaucccugucgccggccuguuuggaaucccucaauagucucguuaguuucugucaauugcaaccaagagaccugccuaaucagaaccacugaagguucuuagucuggaaagcaguguguucaggcuugugucacagaaagagaccacacacagcaggcacugacuacucccuuggauucaucacugcuauacauuacaacagguaaacaguaauugccaguggggguaaggggggguuaccaccuccaccaacgaaaaacugcccauggaaaacuuaauggagccuuucugcagcuccucuguaacaccaucuacagaguuucuaaucuucucugaauuacaaccagcagcucuccugcacacugggaacucaauagacgggccaaaugagaagcauuuaaagaaaacagcagaaaaugacagggauuuuaauguggcuccaauuuacauggugauugugugugugcuucaugaaucacuuuuaauuccugcuacugagacaaaaggagagaauuuuaccuugguaagugcuacauaaugggccaauuauguuauucuuucaauauaguauguuuguuaugaugcaaacacccaucauuuccaguauuguuuuaaauacugguagggaaaagagcuacguuggcuaauuuuaauaauuuucaauauucuucucccuuuugcuuuaaaccaauaauggagaagggaaauagucuuaaagauuuauuuauuuauaauguguaugaagguuugccugaaauguauauaaauguaccauaugugagccuaguacccacagagguuagaagacagcgucagauguacuggucauuguaagcugccauaugggugcugggaacugagcccugauccucuggguugaacaguaaacauucauuacugcugaguacaucuuaccagccccagcaaguaauuuuuuuuccaauuuuuuauuaggcauuuucuucauuuacauuucaauguaauaugguacuguuuucuuuaaaugcuaucccgaaagucccccauacccuucuccuccugaccccccgcucuccuacccacccacucccacuucuuggcccugguguuccccuguacuggggcauauaaaguuugcaagaccaaggggccucucuucccaaugauagcugacuaggccaucuucugcuacauaugcagcuagagacacgagcucuggggguuacugguuaguucauauuguuguuccaccuauaggguugcagaccccuuuagcucuuuggguacuuucucuagcuccuccacugguggcccuguguuccacccaauagcugacugugagcauccacaucuguguuugccaggcacuggcauaaccucacaagagacagcuauaucaggguccuuucagcaaaaucuugugggcguaugcaaugguguaugcauuuggagcccagcaaguaauuuuaaugauauucuuuagauaguguuuuuaaugcaguaucauauuuagugacugaaaacaauuacaaacgggcuuggaaaaaauuggucuuucacaugucaccaggccacucaaagaacaccgugcauguuaugacaacuccuucuucuguguaagagguggauggcuuuagugugggcuucaacucagaaaaacaaggacagacgcaagacugaccagggagagcugaguggguaggcgacugacagcuuagugaaggcauguuuacugugcagaggacagaggagauccagaugacauugaagacagaggucacaucaggagugacagcaaccuuagagggauauguaauuaaaaaagccagaagaggcaccgcuggggaacugaaaugcuauguguggguagguaaggaacacaugagcucaggaaugucucugucacaugucacccugucacaucccagccaggggucaguccugaaguguucucagguucagacaggcaauaagcagcacacugaagaacaguuaugggaucagaucccaugccuccugcauucugccuagccccccuccucccaggcuuccugggcugggaaacagugacaaugaucuaccuaguuagagugcaagccccuuggcagagaguugaugugagaauaauucagcaauugggugugauuuaggguccuaugaaaucaaaguggcugcacaggauaaaauucuuccucaguuuccacuuggggguagauaggcagcaaugccagugagaggagggggggagguuuuauucuguauuaucagcauaucauagaauuaaaucaucucaacugcagcuuuaucugucucaagugauaauuucagucaagggaaagucuacagaacucuuaauuaaaagccuggucaucuucuuagggaaaauaucuacacaugacacucacuaagaaucuuuuagaaaggaacgauaucagagguuggccccaaaagggacauugcccuaugcuuuuaaaugccuccucuagaggggcugauggaggcucgcaaacuuaugaaggcaaaaaaaaaaaaaaaaaguguuugauaauacgccauaaaggaacagcaacagcauugaucagguucaauagaccaaucagguuuuccuaaaauguagcauuugcaguggaagccugguuaaguaguuacauucauaggauguacagagagccaucaauccccauucauccagccacauuuacugagccaagaacuuugcugggcuugaagauauaaaaaugaauaggacacagcugcuuuaccucuagcuaaaagaauacaccuaaacaaagagcucugggggacguguuaagugcugugguugagguaugcacaaagggcuggggccaaaggagggagccauaaauucuuucugggaaaucaagcaucaggccagugagggaagagagcuaagaaagggugggguauuuccuugccauaaaccagagcuccuacuuuaccauguucugaaaaggaagguaguuaauuuuaagauuuacaaacuauuguuacuccaggagcuaucuccguccacugucugucgcauuuguuuccgacacacucugcggacauucucagcaguucugggacuagaaaaaaaaaaaaaacuccaugauguguaaucauuguaucccugcaauaaucacaagacagaauggguccccgccaugaacuuagaucucaaguucaaagauguuuugaaacaaacaaaugaaaaacaaacuuugaaggagccagccaugccauuaaugcuucuucuugguggaaagaaaggaggggaucaccugauuauaucaugguucgcauuugucuuucugucuggguuuuaaaaagagaagggcacguugaauggccggcuacuugccgucauucauuaugcauaccauauuccuacuuauagcauaguugggacaaaacccccauuguucauuacacacuagccccaaacuugagucauucuaauguaagcaugagaaacucccggcuccuuuggggugaauuuccaaauuccucuguguuaaauugaggucuaauuuuuccugugccugguuuucacaagaagguccauuccaccccaugcgcucccuuucagcugucaauaaacagaggcagugaauuccccacagcuuuacaaagcuaguuaggcagacccauucacuccuucaggaaaacagcgcauugauuucagccaguucccagggugcagcaggaacaaagagaucaaaggcccaccucucucucccucuaaagcuuucauuaaggcccagcccagacaaacugcgacaggucuccuugagaccaggagagggccgggcagaccaccucaugguucaauucaaauucaucuguuuccuacauuccagugacaguccagaaugcuaaccgugacaaaacgauacaaucggcuggcauaauauacugcucacuaguucauccaaggucagggggagaagagaggccuggaggaaaguccuagguuucuagauccugcugggccucaauggcucccugacauuccauaaauaaacuucuucucucucgcucucccuuucuccuuccaugguaucuuuacgaauggugauccacuuaaccgucugaaauuucuuuucuccacugaacccaaacucucuggaaaguuucuucccaaccuaacaguuguauaggugugguggaaggucccccgaccagccccuuaucaauccacuccuguguuccagcaaagccccuacacuguacaaguuccugguuacuucaagugaaaaguguaauuucuaacuucuagacguucccgaaggcaccguccccagggaaggccacacagcucagagaagaguauaguuuguauaaauucuguuugcuaaacagaaauaggaacaggggcgaaacaguuaccuuuuuuuuccccuuuaacuuggggaaucuagcuggguagccagguccuaaauaguggucucugugugaaggaguguuugcacguuugugggagugaagagggcuagccaggggcagggcgaaccaacagagucugaaagaaaauauguuuucccaaggggggguuaccucuauuaaacaaacauaauuaaaaggguuucuaaauuugcccuugaauucagaacugcuccuuugaggcgaccuucaccaaacccuguaaugaaauguguucgugucugucacucauccugaguaaacaggagagauggcuuaccuuucaaaauuccuaaaccgaagagaaaauaaacaauauuggaacuaaagguauggaaaacccacuucuugaugcagaacacacccuucccacaugcccaguuccaagcuucaguacuguccuagggcucaccacagauuuccugagcccugaauucacugauucuugucuaucuuuaacuacuacagagguaccacagagaguagucaacagcccucugugaaaggcuuccacuuauuuucaagguuagacaggaaugagcuuuaaaaaggccaaaguggcgauugugauagcacacgcugguaaucucagcauggcccucagacgcucacaguguugggucacgaguucaaggccaacccuaggcucaauaacgagagccucucucagaaaacuaaagaaggagaaaaagagacaaaaggggaagggaagaagaugauaaaggcagggaggggagacaggugccugugacaaagacaagugacuguuuuaucaagaauguuaagcuaaaucuguccauugacguacuuuagguuaagggguuacacuaacaucucuguuuuccuagucuucugaaauggagacaaaaauaucugucaggaauuucuuuacaagguacugugaaauuagcaugccuccaaagcuugcucaugacaggaagcuggucuuaugaucggcgucacauaauugcaggucacucugacucaaacaagguucucuggaaacucauuaagcuccucuacaucaaauuauuuuucagaaguacucaugaaauuuacuacuuuaagaaagccuguggccagggucaaacacacucaugggcucacuuaccaaucuuucagaagcauuugcaaagaacugcgauauuacaacuugauccuccucuuacaacugacugaggcauuaugaacguguuucucagagaggagaaaaugggcucuagcaaggugaagagacuugccagugucauacagcaggaggauggaaacuccaaguguucagucuucagaucucacacugcucccauuauacacagacgcucuguaccauggauauaauuauccacugaaguccucuuuccccaacuacacugaauaagcaaucauguuacuacccucaaaauaauccaucuccuagcauuagggauccacugaaaaaggaccuuaaaaauaccaaucuaugcuccaaauaaggaaaauaguuuaccccaggucauaagauauuccuuugggauaagugaaggcaagauccugggaaaggggauuaaaaaaaaaaggaggggaaacaaaagaaauaaauaaauaugaacuuacgaagccgauggcacgcugaagcaaucaagcaggaacaaccugaaagcaaacaaagaguacucauugacacaacaguauucacacaacaguugggcgugugccuuggaugacaguaaucuugagacuguuggagauccgaggucacuuuuaagacagccuugacuuaauuucccccagcaucaagauuuugcaaaacuguauauuauguuacagauaaaaugcuguuaauacaauccagagucuuuuucgaugucuccaguuuuauuggauguguccauugacuuguauacauuuaucacaggcucauaucaccaccaaagucgagauauagagcgaguccaccaccucaagcccccccauaacucccaauaacucccaccaucaagcucaugccugcuucaacauuaaacaugaguccaccaauuaagaaagaaaagacaccucucagacuuaagagacugcuaccaagcugugcauuaaagcaugauuaaagaauucucuuuguaugcauugggauaaguuuuaaagucucuuucuucucauggcuauuucaggauaaacaacuuauuuuaaaaccaaacauggacaugaucucuuuuuuuuuuauuagauauugucuucacuuacauuucaaaugcuaucccaaaagcccccuauacccuccccccacccugcuccccuacccacucacucccacuucuuggccauggcauucccagguacuaaggcauauaaaguuugcaauaccaaggggccucuucccaaugauggccgaauaggcuaucuucugcuacauaggacaugaucucuuaauuugcauuccauauuuucaacguagcucuaacaagaaacuuuuagauauuuaccauaggaucaaguaggucuuuuccauauuacuuuaauuaguauacauauaccacugaguggcccaagaggaaacuaagacacugggagggugaauaaguuauauacaauuauacuagcaguauuugggaucagacaauuggcguccaggcgcaaaugucccucaagauaaucaauauuaaugacaucaaaauauguugugcuaucaccacaaagcccccaauuauugcuagauuucaccuuaauauagagaaacugaauaggaaaaauguccccgaacaaugauacgaguguuuuguucuauucugucuuguuuuguuuuugugagacaaacucacguucuauaacccaaaguggccuggaauccucaauuauguucagucucucaaguauaugcagcacauuaaccagacuggaacgguaauuuacaaaaugaaaauuguucuguauucaaacaugaaaugauggaaaauggucaaaacaaaaaaccagaggauggagcacacaacaaaaagaccccuaauuagaacaacaaaccaaucacauagccacgcugacccuugaaaaaugcucauucaucuagcaaaagagaagaugagaagugaaauuuucagucacagacaaaaagcuucaaaauuaggcucuuuagccaauagauacaucuaacagccuaaagguaauauccaaauaaugauaauaauuuaguaggauacuuaucaggacaaaauuucuguagguuuuauuaucuuaaugauacagcauuauuacugaagaauagcagcuauuuucucuugcaaaacaaagcaacauauuuauguauaacuguggcaggucggccaacucaagaauacuugagaggcauguagccaguaagccacuaauauccuguuccagauacucaggguaugcuuuguuuacagauguucccuuaauggucuagggucaggagguggccgagggaggcggccucauuauuagcauagguggcugugcauauaaguuauacauaaaagcaaggggguggagugaguuucacuuccauaggaaguugccuauucuuguuccucauuguaagggauggcgucaacucuaccuuagccacauuuuaaucuaucaguaguucuaaaaugcuuauauuuuauuccauuucuagaagccauuauuaguucaucuauuuuaacuagacuuuauaguaccucuagguuacucaugugcacuuucuucacugugggaacacauauauacacugaacacuuucacucugccaaccugcucucaccaagacuccagagacuggagcuucauaaugcucccccauacuguggucauuccauacauuucuucucuuccagcugccauucccaucccuaaagcuuggacacauguccaucaacacccuugccucauggaucacugagaaaacaaaagcuauugcagaaggcaucuuaccuucccaacucuaaauauacagacuucccuccagccacaggacaacaucuuccuagaaccagaagccauuccccaccucucugucuagauauuucucuauguuuccaaguccucccuauccaguaagacacauauccccacuauucaauauacucugguauaucccaacuuuaaaagcaaacacaccuugaccuaauagcucccuacagcucugcucuacaucugcccuuucucugagaaacuucuggaagguugccacugccuugcuuccuacucgcuucccaaguuggcucuucuucguaacaccuuaucagaggauaauuauuaaugcaaucauuuuaaaagucaggaggcugccgauuaagagagauuauaaggcugugagugaaaaaugccuguuuggagauacucaggagcccugguccuucccaaagcacucaggacaucagacuaaggacuucaagaaccuacaccuccuuccucucuuacaucauccuccaugcagaaaacccacagacuuacaccuuagauaaucacuacucuucauuauuuuuauuugagagaggaauuacccguaugucuacauuagcuauuuguguaacuuaauuuucuuugacaaccugaagaauuggugguucuaucuccuugauaaaauucagucuuggcugaaaggaaauaaaaauccuucccagcaccaccuuaguagagcaggcacuugaccuugaucaccuggauucagggacccugcgcuuuguaauagcuccuuucucuuaguugcccccauuagauggcaaugugauaagggcgccauucugccuuauaugacccagucccauuaccuccaagagauaagagaauuuagaguugauguaaauucauuacaaagccugaaaaacuguuuuaucuaucacaacggggacuaugagaauuuacauugucaagauaagagccucaguucaggaucaaagaauguagcuccccuggggcucgcucaaagcugacuuagcauuacagagcuuggcacuggccuguaggucaccccacaccuuacucccauuuguccaggcacaaagagaacugugcuuccucagaacugccacagggccugggugaauaugaccugccucugauccacucuucuugcuggaccuucuccagcuacacaaucucacugaagagagaagucccgggaucuaugggagauacuaaccacucucgacuauaugaaugccagguucauaaaagcauggauucugucucacaggcaugggcuggggugggggugggggguguugaggcaaggccaucacuaguucaaggccagcuuucaguugauagagaaugucuagaagauugugaagagcauaaguucaagaaaaugaagacacgugauaggggaaggauuaaauaaagacuaagcuccuaaaagaagccagggagacccagacagcuucauugaagucuaagaggaaccacagauaugagacaggaaaacugcggcauccauccgaggaccauaccgcaaauggaaaaaaaaaaagaaaagaaaagaaaaaagaaaaagagaaagaaagaaaagaaaagaaaugaaggguaugcuucuuugcacacaugacugccugaaaacgcaauauauaaauaaauaccuaagaagccauccacguuuggaagacuauugugcugccacagacaaaggccucucaggcugaaguguuaaaaugacccuugggcccuugcauuuccacuuguaggaagugaguuaaaaaaugguucauccccaagugagguaauuucucuaacccuaccucccacccaugacuaagaacaggaagaugcucaaaacaaugcccagagggacucggggcccaggaagacacacuuugcuuccuuugggguauccugucucaaacuugcugcacuuuagccaaugcacuguugagucuaaacuuagguuuauauaaacaaaaccgcaggcuagguuugaaucugcauuacuuuuauaauugcaaagagauaucaggagucccuaauuuuccuguauaucacggauuucaaagccuaacgcugaauggcguaucacuauguucuacaaggcauccucaagggcuacaagcaucguccaugggcuuuuaggaagcaguucucuagacugcagcuugaaaugucucuuuagagcgcaacaaggcauuacgcuaaaagcaugcgagcaaggcaggcauacuucacagaaggccggccaaauggucagcucuccgccuuacacagcucucagcaucucaaccaggagccauaauagugguguuguaaacaaacaaacaaaaacccugacuuuacgccuguuaagauacacaauggggaaugagagacagcauuguaaacacguaagcagcuugucuccauuucaacauuuuccaccugucgauggcucagguacaaacagaacaaguccaucacaucuuuuuguacaaccccagcuaagacuacaucuagagaccccacugguccagaaggguuggguccuauuucagagguccccaugcuuccugcugcugugacccuuuaauguaguucccaaagaaccacccaagcaggccccaauucccuugucaucuacuaggcccaggugaugcuucugguggcuaggcagcugcaugucaccauuccaaagcaagugacaaauauugggauauuggcagaaaccaaacacaaaaaguuaaauaaaaaaaaaaaaaaaaaagauagcucaaauauuuguugaaagucagcaagacaaagauagaaaaacccagaaaguaggggaaacugggcuaaagguggugugugcgguagaguaccugcauuuucaaggucuuggguuugaaaucucagcuauacaaaaacaaguagaagauugaaacaaugaaauauggagugaggugagguuuuucccguuugucugagcccaaugaagaacacugaaaacuuauccauuaggaacaauaaaaauuagaagggaaaucuaaagaaagccugaacugguuaguccacacaaucagcguggucucaaaggucagaguccaagcagcacacugacaaggaagagagaggcaccucuccaugccugcuuuacuguaaauauuucuacucagccauuucauuuauuuagccagguauuuuuagcaccaaggcaauacagccuggacaagcaaaagcuuucaaaucggucaaaccagucuugcaacuuacuaacuauaagguguugggcaaguuucuugcucucuuugcugaguuucuucccaauuggaaacagaauuaauucuacuuaccuugcaaaaccaagcccaauuaucauggguauuuaauagugggagccauuuggcaaucgugucuuauacgguaaguaccaugcagggcguuuggacagaaucucuaagaaccugaccagcuggaacugacauuuagauuuaaaagaaaaaaggaugaugaaaccuaacaauuuaagcauggaucacaaauaauaggguucugaucuagcgagaaggauuauuacauagccucagaacaggaccuagaaaguuuggguugcaaauuagugggggugaauauacuaaacauaggggaaauggcaaagggaagaacacauccauuagcccaguagaauccucuggaauuggugugagguggcgaccaccugaccugagggacucagucuaagaagcagcagauacagagagaccagcaaagacagcugggggugaacaaggagggaccacggccaggccaggaacaaagaaccucuuuucacaaggacugggauucaagaaugucauagcaaguggucauuccucaugaugugaagggcaggaaacuguacagcaagggaaauuauacaggacaaccagggccuaaagcuguggggcugaugagaaugaaaaaacuaggaggugguuacaaagcuaaauuuuaucaauuaacuagauuagugagucuuccuaaauugguacagguaugcucaucuuccagucaucacuauaauacugacugaccucuaaguccucacggacauggauguauucaaacaagcaaaauacauugucuggcaugaaggugcucaaaauauuguuggugaaugaauauaugguagaaauucuaaacacaaaauuaagaaaucucaauguauggcuaauguaauacaagcuaaacucauuuucccuuucuguaguggggauuugccacaaaacaggcaaguguugaauuugugcaugcaaaagcuagcuauauuucuaucuuaucaaagacucagauaaaaaucacucuagaaagucuggaagguugcccugucaguugcuaaggucuugugcaauacucuuuuaggaaucuaucauucauuguguucuuugcuguagucaaagaacaauugcuuuaugauucauaaguaucacacuagaaaguauauuaaauuccaaucauagauacaugcccaaaguuuaauuaacaugagcugauuugaugacuaagcaauaauuagaacaaaguaaucuauuagauucuaaaaaagucaaaggagaaaauagauugaaugugaccuagagaagaggaacugucauaacccucaccaguauucucaccaacuucacaggagagagucccacuuuccguauuuuauggaugggaaaauuaagaagcugagaagcuaagcaauugcucaagauuuuacugugccacaaagggauggagcuaggaaagccacugggcucugcaauuuaguagauuagagagugggcuuuauaacaucaguaucguucgugaguccgcagcacugagcaccagugaggcacagcacuuccauuuaauucagacacaagauaagaacauccacagccacuauggcuaaggcuugcugcccuagccagugaaaaaacacaaaggaacagaacagcacaugaccauuaggaaaaauaacgaguaagugccauuucugagaauguauaggacuauuuacaguggaggaacuggcuacuuuuagaaacacggaaacaaagggaaauauacauugugagauuauaaggauccagaggguaccuaacaaagugugcauguguccucuuuaaaggaccagucagggacauuuuuaaaaagucaggcggggugaauggaaugacuaguaaguuacagauacauccauucuuuuaaaauuagccuauaaguucaaaacuaucucuauuuuuaaaaaaccccaagaggguccuucauggagaacuggcacuaaaauucuuguagaauuuauauaaaauucaucaccuuaucacaccaaaaaaagcaaguaugaugacaucaguauguagagaaggcacuggacaaguuugagguuggguacacauuuacagaaucaccacggagcuggcuuagaaacagugagagaucagccaaaaggggaaccccuagauacuggcuucuaaucccugugcucaaggaaacagaaccagaaccugaaacacagucaguucuaaggugacagagggacauaugcaugaguucacagcauugucaaaguaccuccaaagaguuccuucaaaauguuaacuacuuugguggcuuuaacauauaucuguaaauuauuuuaaauucuucucaucucuugaauuuggacucucuucuaacaacgagaauggauagcagggaugugguauaauaaugaaaaacauaacugaaaccaugguuucugccuaaccaaacaacuacacgguuugguaaacaucacuaguugauguggauacuguguggccccagagaagauacaaauugggaggguaaauaccuugugauauuugacacccaaaucuaggccauuuacauaauugugaaaguacacaaaucuaaauuaaaagguagucauaacaguaggaaaauuacaguuaagaagugacagaagaauaauuuuaugguauguaaguagaggacguacacuacaugaauuauauuaaaggguugcagcauuaggaaugccaauguuaauuuacuuuuguaaauguauaguagaucuauaagacauuaacacaggaaaguggguggagaguauauaggaauacucuacuaucuuggcaaaucuaaaaauuuuauaauauuauauauaauucuauaauuuuuaauuuaauguuuaaauuuacuuuuccaaucuguuugcuuuuucuugccuuacuguaugggcaagaaccuccaaaacucauuuaacagauauuuuaaggcuagacaccuuuauaaaauuauuuuucucuuuacauguagaauaauuaugcauuuaggaaauccuuccaaaaauauaggcuacucaaauaaugagugauuuggcaagacaaugagacuuaauaguguguaaguccucuacauaguaaccuacaaauaacaauaagaagacaauaauaacaauaauaaucaaagaauuuaugaaacggauaugcagucuauauucauuauuaugucaaugaacaauuuccaaaaauuauuugguaaauccagugcaauaaucauaaauaaaacugugaaagacucuuaaaauggacauccacaagcucacucuaaaguuuauacgcaaaugcaaagaauuucauugaaaguuaugaaaaaaauccaaggguggaaagacagaccaguggguaaagugcuugcuuacagccaugaggacuuuagaaccccaguacccacauuaaaaagugaggccugucaccuuaguacuguggaaggagagacaggccaaugggcagggcuugcuggcagucaguccagcaaacggugaguuccagguucacugauccugucucaaauaccaagauggagacauaugcugaccucuggccuucauauuugcccacauaaggaaguguaccugcauauaacacacacacacacacacacacacacacacacacacacggggaggggaaauuagagaagccacaagaccuugccaagggcuuuaggucuagaaaaguagccuagugguggaaugaaugcuugucaaauaagcacaaggcucccuuuuuaaugccuagugcaagaaaacaaaaacaaaaacaacucacuguaaaccacguuaagaucgccugauacuaacuugagaauugaaaagcaaucuaaguggaagagaacaaguucagaaauagacccaauugcaugaucuuucguuuuucuacaaagauucugucaucauucaauaaaaaauggauuauuugcaauuaauuuagauaguagugacuugcccacauggaaaaaaucaucuugauccugaccuaacacauacaggaggaucaaauagcaaugaucacaaguccacugugaggacuaaaaaaaaaaaagaaauucagaccuucucauagaggccacagacaaaugagauuguaaaaucauauaugggcaagacucauagaaacacuauuacccugcuccccacccacaaaacacccugauaaacuggacuucauagaaguaauacugcuuaucaauuuaggcaccacuaaaauuaggcuguguauguaacucgguaacaaaacaauuuccuagcccguaccaggcccuaaacucaagcuuuaacuuacaugugggcacacacacacacacacacacacgcacacguacacaaacacaaacacauacaggcacacacauacacaaacacacacagacacacacagaugggaauaugagagcaugugaggcaaaugacaaacuaaauuccagaggcaaaaaaauauuuauugacaggccagauggcacacaccuuuaaucuuagcacucuggaggcagaggcagguggaccuccgugaguucaaagccagcuaauuuaauuuacauggggaguuggcagcaucccagaucuacacagggaaaccuugucucaaaaaauaacaauuuguaagcagguacccggugagucgcccuuccagacuguauuaggaauuaaaaugaacaaaauuuuuaaauuggcaagauauguaagcaggcacuucuucacagagaaucugugaugucccagcccccagaggcaggggugggaguuuaaaguuggccuggaauacauacuaaguucuaggccagcaagcacuacccaguaugaccuguccuucccccccccccaaaaaaaaguaaaugccacucauuauaaauaugacaaugcaacaaaccuacagaaauaaauucaacuucuugggcugugcagauuguaugucccuuagcauuugauauuuuuaaaaauuguaauaugcauaagauauuuuggagugggaccuaagugugcauauaaaaugcacuuuauuuguuuguuuauuuacuuccuuauuuguagggcuggguauugaacccugagccucaggggugcuauguaagaauguacugaguuguauagcccccucagcuaggggucauauaugcuugauguauaucauaucuauauacuauucuuauuuacuugcauuugacugaaacuuaccauuuaagcccaggugugggauuuuccacuuguggaauauugguacccaaaagcuucaaagauucaaaaagacuaggcuuuaagauuagggacauucaaucuguaacuaagagacauaucuccaccaaugaguuccaaaaacaucaggggauggagauauaccucggcaguuaagagcaaacagugcucuuuuucacagccuaccccgcccaguucccaguaccuacugguccuucagcuccagggcgaucccagcaucuccagcuuccgcagguaccugcacuuaccuuuguggaacgcggcaaauauauacacacauuugcauaauugaaagaaaguaaauucauuuuuuuaaaacaaagaaaaagcauuauagcaauuuaacuuguaacaguccaauauggaaaacaagucaaauguucauaaaaaaaaaauguaaaauggauaaaguguuugcaauguauacuggagcaaaugaacuucccccuagcagccagaaaguaaauaccuuaggcuuugugggucugaugguuccauagagaaacgggcuuuggcacuguuccaauaaagguugcuguaugaaaauauggaaugggcuagaauuggcuaauaagccacaguuugccagucccguguauaaagggaaaacaagcaaaguuuugaugaaguauuagauggcucucaacaacacaaugugaacccaaaaaaguacauuuuucaaguucauggugacuggagucaggacaguugagugggagggugguccucacugggaaggggcagggaugcaaaggguuugugaccacaucuggcuagccucacaggcauuuccaugaggacauugcaucaggccacacccuuucgucuuugcccuuuccgcgguuuguauuuggagcuuguagcucaauuuagagaaaggagcaaguuugauggcuagcauguggauccaaagaaauaacauacagaauucaacauggauaaaaauauaaaugccagaauaaaaacgugugggaaauuuuaauguuuaauuuaacuguggcuccuagaaaaaagugggagcucaggggagaaugaaaucaaggguaaaacuucccaggcuugaaaaagaaaccuuagguaaaagucucaagccacacuuacgcacacaauacauauauuacuguccccagaaagccucugauuucguguccuucaucaugauacaagcagcaauuaagacacuaaagccacucucaaaagcaaacaagauacaugugcuaauugcagugcaaaucaagauucacuaacaagaggggaauuugccaagcccuccacguuggaacuagaguauaccucucaaacagggaaagacaaaaaaaauuccauaaugaaaacaucuuuaauucuuaaacagaaccacacaguaccuauaaagcaacaguguauaaaaaacuguaauauuuucagaugacaaauggguacagagccuagaagcaagcccaaaccaauccgagcagugcccauggcagagggggugcaccaagucccuggcacagagucuucccaaguuaaaaaaaaauaaucaaaucaaaucaaauguuguuuaucuuguacuaucuccaccacauaagcaaagcauacacaucuacccccacaaguacaugcguuccugaacugcuggcaagauacaaacuggaaacacuuuaaaaaucauuguggaaucaauuucauuaacagccaaguuuuucauaaaaaaaaaaaaaucaagacacacaucacaaagaugaaugucuguuuauuaucugaaaguuucuucaaccaugaccuguauccagaacaauguuucccaagagaacugucugcaguguuagaaauguccuggucuguaauguagaagcguguaacauaauaaaauauaaaguuauacguggagcacaagaaauauggccuggagccauggaauaacugaaguugaaauaaacacagcaugccagcguuuuacagccuggagugagggguuacaaaauccaugugguuuguuaccucugcaguuuuuacauuuuuaauaacaaaaucucaucugagcuuaauggcuaaauaaaauauguccaaccaacaccaaaguuacuuuuuaaaaguguacacugaaugauuucaauuuucuuaaguuuuuaaaaaauauauuaaaauguuuaauauauaggaaccuaugauggauuuaaugaauagcaaugugcccaccagaaaaauaaugaaauaagauguuaaugcuguuacguuaccuagguaacucucccugaucuuuaugacgcaauggaaaauaugagauuucaagccuuguauuugggcuucuucccuuucuuuaauauacugaugauggggugggguaauagaucuacauguaucauugauaguuauuaauccugaaacauggcucaggucacuguccaguggucaggggaugaggcaguucccagaaucacggggauucuuaguguucacucacaccuucugaccccuccuccuccuccagggaggccaccacggacuugacguuccuagcauucauuuacauuuuucccuuuaugacuuuuaauaacucugugggucccuaaacaauagccuugccugccagguucugaauuuuacauaggugaaaucaugcaauauucaguaagguguuuucauuucuuccccucaacacugagaggagucuguacagaaacacaaaacuggcuuauuugcuccuauacugugcucccuuuuaugacugguacauaauuuauguuucccagucaggcggacaugaaggcgucgaccagcuuugugguacuacacaguaaggccuguuugcuguaccuguucucuggugcauaugaaaauuuaucuagggcaguggcuuuuaaacuuuuuuugaccauagcucagaguaagaaaugacauuuuugaagaacauuacauacauuuguguguauagacggggggggggggggggcacauaaaacaaagaccccucugacuugagacacagucugacacuuuaaaauucucaguuugugguuuucaauuucuuaucacuaucuccuuaaaugauuucacaacuuccaaauacgggcuucauguuuggaacaaugcgcugcuccguguaguuugaggaacgggacagcgaggucggaaaaugcaucugucaagugucgucaacucugauuuuuuuauuuaaaugaacgugcucauuuauuaguauaaauuuuucccacuguaucagagcaaaaaccgcaaaacaacacauuuuaucuuuucauacgucacuaaaauacuaaucacuuaccacacgccaaggaagcaggcacagacuccaacccagaccuauggauuaaaacgcagagagaaggggaaagaaugggggggggggcgcuucggggagcagcaccucggcgaggccccagagagcuaacagccgcugccuuggagggcgagguuagcugaagauuccuagaagaagaaucuacucugggacauuucuauuuuuaauuuuuacucgauuccuaaaacaccaaaguagcacauuuguugcgaggggggauucccaacauuuuuggagccuuuuuuucgguacaaagccaaaacccuuacuagcgagcgaccuuaaaguugauguggagacuggagaaaaguacacaaguugcgcucugaauucucccaggaauucuuaggaguccagcauuuucaaguaacuuuaagagcacaagcgacaucgcucaguuauuguuaaagcauccgaauaagucuauuuuccccaaaggaacacaaaucaccucuucccgacuuuuuagccuguuagcgauuuccaagugucgccagguuguaaagaccgccacuuaagugccgcauagcacacgggcaggacacgggugaaagcuagcgcggcacgagugcccauuuggaucgacccggagccuuuugcugcaucucuggcugcaacuggggcacccagguucagaguuuaucaccucggagcccgaagggcccgggaccccguggucugcgcucagcgcggcaacccaucccgucgcggcacggcuaugccacgcaauggccccgguugucacuacuuaccuacccuagccggacucaggcgucgccgucagaucuccgaucccggauccgcgauccgcaggcaggcgcagccuaagcagccaugacggcgcccaggagaugcccgcuugcucuccagucccgauagccgcgagcccggugcccgcggccgcaacuccccgagcguucucccgccugccaggcgagugagguuggagaacgccccagccccggcuaaaucaaggcucggggcggucccagcccaagcugagugacaaaucgcagaugccgugggcuuugccgcgcaacacgccagccaaggggauggcugcauggacgaggcugcgggcggggcagcccgagaggagcugcucccccccccuccagugucacgugugaggaggaggccccguuggggcuccgggggucggugggggaggacagccacgcagcccagcggugacucaucggcuguaugcgcaaagccaaggucuccuaggugccgcguuggcgcagguagccucaacucagucugaaaaucugcguugaauauugauuccuccauccccacagagaugauccacccucggccacaucgcaaaccagaaacugggcagagaugugguguugguucggggggaugcuuuguaagccagaggccaaggaauuuggcaugggcaaugguaccacggcuggugugggcuacagagggcucuaacagcuuugagggucguaccccaugacagccccuguagaaaccuuauucucccuguugacgagcaaaaaaaaaaaacaagacagcuuggaagcaauuuuuguggccaaaggcucgcaguacccaauacuuuaaaggcauuuaaaauauguuauaguguuuugaguuuuaagaaagagacugaagcuaaucccaagcauuuguuuucguccuuguuaagacacagcuacuuaaaggggggaucugugaacauacaguggaaaaaguaaggaacggggcuuccggacguuucaguuucgccaucuccugagugagaaugaggcgguuaaucugcgugcacucuuucuccuauccuaacccagacucaacuucccaccgcuguuuauauugccuucgguguauuaguagcuaaaugugcgaucuuaacuccagauuuaacgaaugugauggucacaguaagccuuuccuagauuacguuuaucuaguaagagaagcuggcuguguuuucccuuagccauuuucuuaaguauaaaguaacuuccacguuagagggaaaauaggcuuuuaucuuuacauguagauaaacaaaaccuugguacuuugaacccaaguuuugcaaaaccucacagaacacaaaaucaguuucuucauagauuaaaaaaaaaaaaaaaaaaaaaaaacaccaacuaggggucucauguaguccaggcuggccuuguacucacuguguacccagacuagccuugaacuccuaauccuuuugccucucuaaaaugcuggcaguacauacuugcaacacuaugcccaacugccuuacuaaugaaagaucuccaugagaaggccugaauccuauauaagcuuuucucagaggucacucgguuuuucugcucgaaugcccaaagaauuauuuaucagggaccaaacagccugcucucccaaccccuacccccaucccacauauagcaugauuuuuaauuuuugaguuacauucuuuaaagaauauaauauuccauucauguuauaucugaaacagcuuccguuugaggccuuaguguuguuuuuguagacuauuuuuuuuccccguugaauucuuuagguuucaaggcauggaggccuggaaggaagcgugcacauggaaacagcuaagauuaggaauacagcuuguuuaggcaacucagcccucgcugguaaagcccagacuccucgacugaaccaggcccuccccgugaacucggacuggaguugucagcagaauguaggaccccaggagguggacugaauagcagaauuaaguguuccaguuccuggacacuucauaaagaugguccugacugacuuccaauguggcagauuuuugagacuucucaaggcuuagacuaauaguuuuuuucaacgugucuccaaggggcaggaagaugggauggauauaagcauauuguacacacaugacauuugaauacaucuuagcucugcuaucaauucucaaauuggacacuguaagaaugccguuugggacagguuaugagaaucuguaaucccagcacucagaaggcaaaaacaggaggguggaaaaguucaaggccgaucuauacuugagacagccacagugagacccuguuugaaaaaagaaaagaaaaauaagagaagagguuuuuuuguuuuguuuuuuuauucuuuccuugguuauuuuauaugcuguuuucuuucccuuggguggucuaauuuugacuuucucaugcuucccuaaaauaugcuuauacaggaaucucucauuaaugauaagucauaggaaaccccuuuuuuucuguuaagcuauuuucagaguuuuuucuaaaugugaacggguuucccuguuagcugugucagcuaagcuuucccucagaaacacacauccccaaaggguuuuaggacacagguuguaaauaaauccucacaagguagaaaccagggaagaagauggugaaucacuaagaugggugggguugggguacugcacagcuccugccggauggcuucugugcuacauggcugcuagaagugucaucaaaucuauauguaaaaaaauaaauaaaaacugaaacaaaagcaacaacaccugacauuuucucaagaaacccucucaguuuugaaacaccacagaugugaaaagcaccucucgugguaaaacugaaccauggcggucuccccacagcagucucuccgacaggcagaaacccuguaaccaguugugcuuuuucuaaguacuuccgagugccauuucauuccacggacucuuugcugaauucuuaaaaugucuuuaucggucaggcaugguggcucaugacuaugacccuagcaacuuaagaggcagaagcaagaagauuagguauucgaggaauucaaagucuuccuugguuacaagggaguucaaggccauacugggcuacaugagacucuagcagggggaaaaaguuauacauaggggugugugugugugugugugugugugugugcauauauguguguguuuuccuuaucaaauaaaaaucaagacaauugaugccgauuuacacucugguaacgugucagaacucuucacuaucaggacuguuuuuauaggggcuagcagcuaugaacuuucuaauauuuacaccaugugaacagacaguugauacaaaauaugaacacaauaaccaaauaauaggcgacaguaucauuuuucagucauguagaaaagacauugagcaaaaucugacauucauucuugaaaacaaaccguagaacuauaggggaccuuccuuggccugcuaauggguggacucguuuccuauaguugucacaauacauuaccacaaauggcugcuucaaaacaagaaucuuacuuucucacaacucgagaagcaaggagucggccguuuaaaaguaucagcaaagaucacgugcacccucuaguggccuuugaggagaauucauccuugccucuagcaaguuuugguagcuguucuuuggcucaaugguuacacugucccuaucccugccuccaucuccagggagucuucuugacugguggcuccauugugguccuuuuaggacacuugucauuccaucguaauaagguuucaccugaauuacuuuaacacaaguauauuaucugauauuuccuuauggaaucuucucaaaacuagaccuauggauucccuggccaucauucauauacacacauauauacauacauacauacauacauacauacauacauacauacauacauacauacauacacacacacauacauacacacauacauacacacauacauacacacauauguguguguguguguguguguguuuguaucuccacaggucccaaggauuaggacauggacaugggugugucugggaagguguggaacuugcuuuguagaucagguuggcagcaaacucauagagaucugccugcuucugccugccucugccuccugagugcugggauuuaagggaugugucaccaccaccaccaccugguaagaguggugucuuuuaauccuccacagcagguaaaauccagcucuaaccuguguagaacuguaaugaacggauuguaacuuuuauaggaaaauaacauagaggagggaaaaucaccuuaaaauaauagguauggguauuccuuaggaggaagaggaagaagaagaagagaaggaagagagggugaaggaggaaguagagaggaagaguaaagagggaggaggaagaggaaggaaaaagaugaaaaaaaaugaagaaggcaagauauuugggaggcugaaguuuugguuuuaaggcuuaacacaaaacuauaaaaaccaagacaagaaggcacuagcagcauggaaaaaaagaaacagaauauugaauccagaaacuguuuuguuuuguuugagucagggucucauacauuccauguuagccuugaacuugauaaugucucagaaaaugauccugaacuauuuauacgcuugccucugccucccgagggcucgggugacugacaggaccaucacucucagauuaaaaccuguugauuuuuggcagaaggauaaucaauuggaaagagagauaguggugugggaaccgucugcuuuugugugugugugggggggggagcccuucugcuuauauuuaaaauaagauaaugaaaccaaaguaggucacagaucaacauaaaacacaagcaauacauaauuuccaaaacugcuuuacucauuguaauagccacuagucucuuuagcacauuaacugugucuaguccagacugagaugaacuaccugugaagauuaaacuucaguuuucaaggacucuagcuuuaaaaaugauaugcagugucucaucaauaauuccauaucaugacuggcaagauggcucagcagauaaaggcuuaugacaugcaaacuugacgaccucuggucuauucccaguuugaaagugggaacugacuccacaaaguugcccucugaccuccacaggcauguugugacaccugcgugucccugacacauaacauugugaaaaguaauuuuauacugacuucauguuaaaaugauguucuagguauauuacuuugaauaaaauagaugacuugaguuugcugaaagacgucguucucccuauuuuccuguggcuccuggaaaaucugauacuuaugacucacuuccggcaacucugaacuagaagaaaaccgugggggcaggaggcuguuuggaagguuauacaaaacaaagauucugaaagaauaaaucaguaagcaguuuuacugaaaauaaaaucuucccuucuucaaaagagaccauugaagaagauuagaauuccaaaaugagcuacgaaaaaugaacaagucuuccuacaucaagauuacaaacacacaaacacacacucaugcacacacacccucaugaacacacacacacucaggaacauauaaaagaccuaucuuauacugggagaaaagacaacaauacagaccacugaugugggacucaaauauuugagugacucaugggguucaacguauaauuaagaauagaauaaaaaugaucgaucaaaaugugugaaaagaagaggaccaaagagggcauagaucuuaacuagcaguagugcaagagauauuuaaaauccuuuccccagugcaaaguaaagcuaaaucaaaguaaaacuauaugcccaccaguacagcuauggaggaggggaggagacugacagagcuaaguuccuuucuuuguguuucuucugaaacucaaggaguacaaacuagccucuaacucaggugaugcuccugucuggggguaagaugcauaaaccacaugucugacuguaaaauuaccuuaugaagcuaaacauguguuugccuuauaauccaggacccugacucuuauuuagcuaagggaaaagauacugugucuauaaaacuacuuacacacaaguguucagguuaguuccaaacuagaagcucaaaugucagcaauaaaacgcacugcuguucuaaacaguccuaaaggaauaaauaaaacggcauucuguaugcaagaaauuacaugggaaaguaacauacugcaugucuuggcuucucuuacuguuucugcgauaaaauauuuugacaaaaucagcuuaguuggaaauagguuuauuucagcucacaguucacaguugcaguuccucauggcuggucauauuugcaccugcaauuacaaaaauuuuuaaaaauuauuuuaaaaauuaaaaaaacaaagaaacagaugaaugcaugcuuccuguuuuucugcucccccuuuccacauacaguacaagaucccaugccuaagaaaugcucccaccaaaaaugagccaggcuucccacaucgguugauaugaucaagaucacucacacauacacacacacacacacuugcgcucacacacaugcacacaagcauaugccagcuagccuggucuacauaguaagguuccagccacaagagaaacccugucucaaaaagugugagguacaaaaggaugacauaccacgcuguccucaccuccauauacauacacaugcuuaugcacauagacacacccaagugcacauauauacacaugcacacauagaaauaauuuugagaaauggguagaggacugguagguaaacugagggcccaacaaaacaguauuggggaggaaagaaacugugagggcugaaaaaccaucagcuaaaucuuuggacuucagaggaagccaaccccagggugaaaaaacaaaacagaaaucuggaguuugcacaagcuaaauugaggaagacccuucuuacagacccagaaugaaaggccuaagauagagaacugccaagcacccaaagcugacugugaacuacuaggguaaacuaaauggaauauuugcagucuauauagucuagucuauauauccuugcaaaaaacagaauuacggggucaccaaaagggggaagaguaauuuuuacugggaagagacuuacuagaaucugccuuaaaaagaacuuaaaauuaguaccauuucuacuuugagguguacauagcaaggauaagaaaggcaucuauuucuuacaaguaauauaauuacaggugaaacaaagaaagagagaaggaaaagaaggaaagagagagaagaaagaaagaaagaaagaaagaaagaaagaaagaaagaaagaaagaaagaagagaagagaagagaagagaaaagaaaagaaaagaaaagaaaagaaaagaaaagaaaagaaaagaaaagaaaaaaaagaaaagaaauccuuccuauguggaacacacauccaaaggcuaugaaaucaauguguggaagagucaucuguacuccaugcucacagcagcucuauguccaacaacuagguuauggaaucaagcuaaaagaugaguggauuaaugcuucuuugagggugacugagaacugcacuagucaaugguaaaauacaucuuuaacgacuuaagccaggcagggugguggugaugcaugccauuaaucccagcauucagaagacagaggcaggcaaaucucagugaguucgaggccaaccuggucuacagagagaguucugggauagccaggguuacacacagaaacccugucucaaaaaaaccaaaaaaacaaaaaacaguggggagagggagagggagagagauggauuuaagccagguaguacacaacuuuagucccaguacuugguacauggaucgcugugaguucaagaccagccuggucuacagaucaagguagcauaugucuaaauggaauagccuuccaccuuuaaagagaacacugaggauuuuguuaaguguauaggcugggcacaaagaagcaaguacuacaugaccucaccuacaugcacaacaugagaaaucagacucaugggagaaaaaggauuauaaccaggguauaggacugaagaucuauggauuaaagguuacaggauuuuaguuauauagcaccagauaacaauaaaagaaaaucauuaaaagaggacuggggcuguaguucagcuaguagagaccagcuuugcaugcuugcaagcaugaagaagcccuggcuuucauccucagcaucguguaauccaagcauggcauuguacaccuguugcauguaauaaauaaaaaaucauccacgcuaucgccggcuuggcaccggccggcugucuccgucuguucccagcccagcacacagcccgagaccaucugucucccuuagccaaagccucucccgagcucugauagcucucuugguccccacaggcagcugugggugugcucucgccagccuucacgccacucaaugccuuuccccuggagcuccuugcccaaucuucucgucccaaagccuggcugaauucugccucugcuaaguucuuucccuuuagcccaccugagucgccaccaaaugaaaaacaccaggcaacccuuguuuagaaucaacagauaacacagucgcugggcacggaaucuaucauccuaaauuuaucaacuauucaauguuagaaaucuuccugauggacucugccaccagaccuaacaauccacggccuacauccuguccaccuugcucccaccguccaaaaguaggugccugucuccugccuucccucuucuucucucggaccgaaggcccgccuccuccucaccuccuccucacccaguauuugguuucuugucgucuuuauuaauuaggagaaaauucugcuacacacaccuauaaacgcaguccuuaggaagcgaaggcaggaggaucagaaguucaugguugucuuugucuacauagugaguucaaggccagucuggaauacaugagacccucucaaacaaauaauaaaaguauuaauaaguuuuggguuggagagauggcucagcgcuuaagagcacugacugcucuuccagagguccugaguucaauucccagcaaccauauggugcucacaaccaucuguaacggggauccaaugcccucuucuggugugucugaagacagcaacaauguauucacauacaugaaauaaauaaaucaaucuuaaaaaaaaagauaauaaguuuuaagcucucucacuauaaagcaauggcaagucuggggaagacaagguauauaaaauagcuugggguagccauuccacaggauguguguauaucauguuucacccaacauauacaauuucaagugucgauuauacaaacagaacaauggaaaucaaaauggaucccuacuacucuaacccggauuuaaauuaucccaguaacaaacuuuuuaaaaagcaucauccauaauaucaaauuaacaauuuacacauaccuccuaaaucaagaugcugaaggaaguaccucacacccauaacaguccugcaagaaaacauagucucaauauuuaaaugauggaguaauuagcaaaccaaaauugaaguacauaaaaaaguuuagacuuaaaaaaacaucauuuacaaugagaacaagucugcgauuccagaguaaaugagauucacaacacuaaacuaacacucaauauccaaacaacuucuggguugcuuguuuuacugcucuuucaucaccaaaacacuaaauagauuugagugugcacuguccauugaguacuggguugaguuuccugaggacacauaacggcucugcgguaauccaggagaaugucacugucccuagguaagauacgccgagggauucgagacaaucacaaaucuaauuuaccuguucaaugaaauaaauaagcaugcauacaucaugcaaggaaggagcagagagcuauacuguacuauucuuucggcuucuuacuuagaaagauuuccagaccacagaaucccuccggucagaugugcacaucuaauuaggaugcuccuuaauucaggcuguucagaauuucccagaggccccgggacaaaugcagacauaauuccca

SEQ ID NO: 37 - RNA, 55785 nt, Mus musculus
aacucuuuuaggcuuauuuagacccuuuuuacacauaggcucauuucucuacauacaugaaaguguuuauuucauucauggagaagaugcuuagaguuccauagauggucaugggcagaagaaaaucaaacacaagaaaccuggccccagagucugaugcaugcaaaaauccuaggaaguuuaaccaaucuauauggguucaguucuuaggacagugacggcaauguguccuuucaauagugaugccgcuuaggcaguagugaggcaagcauuuagcuugagauacagaauagaaggaaagagaaagaaaggacuaacagaaucuucauucccuccacuaaauacaucucugggaagggacuuuauuugaaugaagauuucucuuacaaauuuguagaaaugcagacauuuccacaauuuccuggccuguauaugcucuguguaguauaauuccaagaaggaagaggaggaggaagaggaggaggaggaggaggaggaggaggaggaggaaggaaaagaggaggaggaggaggaggaggaggaaggaaaagaggaggaggaggaagaggacgaggaagagaaauauugguuaaaggcauguccaaacacgauacacuuguugauuuccauaauuauauacuaaaauaaaaagaaaaauuaguuaucagguugggcuuugaacccauguuaucuuacauaugcuaggcaacuacucugucucugagcgcuauccacaggccagguuuuauagaaucuucuauugcauauuuuccaugcuuagccucaaaucagucuauacacgagacuaauuguuuucuuugagugcuaucaaaggagcaggccuuuggauuuaggccuuauuuccagagcacaggucaguucaucuaugaauagguaugguagggguccaggauauuaucuuccaguuaauaucuagcuuuuaccucuuuccauucaaguuuauacucauucuaauacuuguagucacaaaaacaguuucaccugggaaaugucugcauuuccacaaauucauaagagaaaucuucauucaaauaaagucccuucccagagauggauuuaguggagggaaugaagauucuguuaguccuuucuuucucuuuccuucuauucuguaucucaagcuaaaugcuugccucacuacugccuaagcggcaucacuauugaaaggacacauugccgucacuguccuaagaacugaacccauauagauugguuaaacuuccuaggauuuuugcaugcaucaagaacuuaagccaacacacucauucuuuuuuguuauuauucuucucuauuuaacauucucacucaagacaauacaagcacagcucucacucuucugcaaacagcugcauggcacaaucaguaggagagaaaaaaaacaccuggagaauaauggacaucuuacacauuuuacacauuagcucuuuaccuuuauaacugaucaacacaagcuuccacugggauuauuauuuuuuuaauuauuuuauuuauuuacaauccaacuguuguuuccccucccauucuccccucccucaguuccucaucccauuucuccucccccuugcucucccucuccacucucccaggccucccuccucccugggaccucaaaucucuugaggguuaggugugucuucucgaacuaaggccagaccaggcacuccucugcuguauaugugucauggccauggacuggccucggugugaugccuggucugguggcucauuguguaagacaucucaaggguccgaguuaguugaggcuacuggucuuccuauggggucaccuuccuccuguagugguacuuuuuaaaugugacuaacauuugcaaucaguuaauguccagaacaaguccuccacaauguaagagaaguugagccaauagaugaagacaaaagcaaggacagucucccgaaaccaagaauuuugucuccagacuguaacauaaaaauuuugagucucugggagcucccagaaguccagguuauuugagacugcuggucuuccuauggggugacccuccucuucugcuucuuccaucuuuuccuuuauuuaacaauagaggucuccaacuucaauccaauaguuagauguaaguauugcuuuuuuaaaaaacaaacuuccuacaaagccugacaugauaguuccugcaaacauucaacuuuacuaagcagccucaggucgggcauguuuauaauaucgcuaagguauuauugccaagacuaaagauagggccugcaauuguaguucaaacucuucacuguuuuccuacacuggaccaacuggguggauauggccugcugagauaaugguuuucuuguguuauuaugcccuucaugugccuuugauaaaacaucuagcuucucuacaguagcuggagcaucucaaucacuaauugaauauuugcugaagaaaugaaugaccacuuggacaagggccucaugguggacuuucaggguccuucuggaguguggcucuguacucacguaucucuuuaacauuguaagcauugaacacucauggcaacgcuugaacauucaagggauccugaaagagguccacuuuuuuuaaaaaaagcaucuauuuaccuuccauucaauuacauaucaucuuuagcuuuccugcauuuaagguuuuauuagugcuguucugucugccucaauaaaacuauuuucuuccuugcaggucaaauuuacucuuuuuaaucccucgggauucaauucacauauuaccugauccuccauaaacaguuaucuaacuacccaaguguaaaaugaucuccaccuucucccugacaguuauuguuaaucacaucguauuucucccccaccucaggaacugggcuuuaucuguagauuuucugguuugauauuacuaagaugcuguuauguaaauaaguaguuuucucuucuugugcugcauaaauccuuugaugccauggccuuugugcuguucuucguaucccuugugcccuucacaggccugaaauugcuguuuauuuucucccguggcuguucuuagucaguguuuacucauugacugauggauagguuacuagucauuuucuccccuguaugucuugccuagauuucuccggcuauucaauaaauguugauuuguuuucaaggcacagacugauugauuacuaguguagaaagaaaccuaaauauuuugccagacacugacaaaagagauguccuuaagcaccgaugagucauacaauuaagugguggcauaaggccuugcagugaaaggcugugucuuuauaccuuuucuuacacacuguuuacaucagucccgggcuacucuguuuuagugucacggaucaaaguaaagaugcuuaacaagcaacaugugaaggcuuauaacuuccacaaauguaucuuggcaucuccaaagaccgcauuugaagcauaaagaaagcuguguaguuaguaaagcaaaguagaauauucuauucgacccaggcuuuccuaacugcaauccuaaagaagaaauucuuccaacuggaacaugacgguggugcuuugaguuuuguuuguccugaaaaguuguugggcuacagagguacgcaguuuucauuuuugaacuuggauaucuaaagaaaacguaucaaagcaaugcccauagagccacagcagcagaagaacgaccaaguguauaugugcuauugagggaagggucagacagggcuuuuagugucuuauuauuugccuucacccagaaagcggcacaauggcuucccacaucuuaaauguugaauguccauggaacagaagagugaagcuaaacuugugcgaggugaaaguguaaugaaggcgaugauuguggguuggagauguaaaggaagaagagagccaaagcaagaauucucugcacacauuugguuugccuguaaccuaucuccagcuuuccugcaucccacucuacccaugauccuuugcugagaaagaauucugucuuuguugcuaaggucuacagcgaugaaauccccucaaauccugacuucauuuuggagaaccagaaccuaaacguaaaacagucucaucagguuuccgaagauagucaccggcuuccagaccucuuagaaaauaaaagggugucuggaggcauugcugggcucugguacucgucagaacuguaguguucagggugugacuuaacucauuuggauaugauuuuggugaggagugaguagacuuugacagcagugcaacugcaacuguacuugcuggugggcugucggugggaaucacggugugaguggcuuuugcaacaucugugguauucacucugaaccagaauauuucacauaucuaaauucccaugguuucagaaaauccaacccucacauugcagcccgggguaggggagcuuaagcuaucucuacaaagcaccgucuccugccuccgagucacuuuuuuuuuuuuuuuuuaagauuuauuauuuuauguaugugaguacgcagcugcucuuuucagacacaccagacgagggcaucagaucccauuacagaugguugugagccaccauguaguugcugggaauugaacucaggacuucuggaagagcagucagugcucuuaaccacugagaucucuccagccccccugaaucacucuuuacguuacagugcagacacuugagacccauggacgguguccugacuuugcuuuuacuuaacuguauaugacugugugaugauccuauguuuuugcaccuaaaaaaaaaugaaaaaaaaagaaccauauacuugauauaacacuuauauauaacagcuguucauaaaugaagcuugauaaaugugaagaaacuuaaaaguugucauuaaauuaaaaaaaaaacauuacauagggaaagcauuugucucuauauauccuuaaacaagguuuacgaacuauuaaaacuuuuuaaauauugggugauuacaaugaugauuaaagugccugugugugagugugugugugugugugugugugugugugugugugugugugugugaguguguguguguguguguguguguguguguguguguguguguaauaugugguugaggcauugacucuuuacuuccuccuuuaccuggcuuccagagguucaacgcugauugacaggcuaggagcuguaaguaccuuugucuucuaagcugucucuugggucccgguauugaacuugugugcaguuuugaaaaugagaaggcaucguaucuuagagauuuaacaguaacucuuccugugugugugcucauucuccuuaugaugaagcacagcuauguaaccuggauucagaauuagaaucucugggagcugccuugugcuuugggucuuacuuagcuucaugggcagggagaggucacugguucucaauuuuuauauuuucaaaacaggaggagcaacucuucuuggcuaguucaauuguaaacuauauaacacaccagaaaauaauggaaaguaauauuuauggcgcacuuauacugaaaguaaguugaaauaaauuuguucuauacauugucugcuuucaagcuccaucuaagacuaaccacugaguuacguuuucuauguauuccacaggugcagagacugaagcuuggggagguuaggggaguugcuuuaauuccuaaaccugucaucaaagggaagaacccagauaugaacuuuaaaccuaacagccccaccaguaaaaauucaaacuaauuuauaugcaucuuuuguuuccucuugccaacuuuauucuacuuuucuuuccuauuucuuugcuuucaucuccugucuuauucuacauuaggcaaugacugcugccacaauuuguccugacucacuagagugaaguucaguguugcuaagaaacaaaucaucgauuaagaaagacaaugacuauaguaacuguguuagagggacuauguguguuuucugggagugaggcaaugagcaaggaguuaucgcaugucagaagaaacuuauaaauacaagcaacauucagaggagaaagucaauuagugccagaagaaagggcauguuccuuacaccaaugucagcgaacacuuggacucaacagaaucacucagcaugcuucgacucugcaagaauggaguguguggagggagagguuaaaagacaggcaguuagacuugggaaagaagucaaaauaagucuagcuacauccucccccucccucagauucccucucaagaauuuaauuccuuccagcuccauaaaaauaaaaaaauauuuccugucaaagcaugcacuuagguggguaaaggaaggauagggggaaucuccuccuuuuucauagaugguggcuucaaguccccaccugaucagagccuggaggccugagcagaaaaaugcgagucagaaccugggaaggcaaacagagcaacccacagcauccagagauggaauuauaaaaucuccaaaaacuuucuucacugccugaauaaacauguuacucaauuugcacuuucuucuccucccccugccuauuuacugaaauuuaaaaagagccacagaaaguccuaauuacauaagggacccaucuauaaaaauuauuauuuuuuucuuuacuuacaaacuaaaucuuauuguaaucagugucuaguuucuauguguuuuauucaacaacagcagcaaagaauagacaguaaggaaguuuuugaagccguagguaaugaaaauaauaaacaacauauuuuccagauuaaauucuggcuuugucccagaacaccauagaaaugcauucaaaaugcacagagaacuccagagcacuugaacuucagagcccaggaguaauucuauggaagucuaauuagucuucucugcagaccacauuuaaaaaagcuuuaggauuaaugccauuccauuuuccagacccacacaucuccaaagcaagggggaaaaaagucauuucagaaggauaauaaauacuacuuacaaacaagacuggaaaggguggagacuggaaugggguuggggguggggagacaaauucuucaguuacaaucuuuuagaaaaaaaaaaaaaagacaaauuucaaaucaaguugcuccacuagacuacaaaagcaguuuggaaugcugggcggaugcaaagggauaaagcaaauguggagggggagggagaagggggccgauaaaguuucuggcuacaauacaagagacguaucauuaccauaugaucuaaugugggugucagcuggaugcgcucacgcagugaaaccuuaguucuuaacugugcuauggaguagaagcaggagguuuucaacccagugacagucacagggcagcaccacccccuccuccuucuuuccacaccugcaaacccuuuugccugggcugcauaguuaguguuaauuacaucgcagcuuugagggcuccuguggcaaauacccggauuaaaagguauggcuuucaauaauuguccugaacucugcuacaggcuaauaaagcuucugucaaguggagggcagaagaaaauaucuggugagaaaaaggaacgagaaggaagcugugcuaaacuuuuaguaaucuuuagacaacguuagaaaugaauugcuugaaaacagaaguuaaguacucgguaaaacaaacaaacaaaaaggcaaaacuguuugaaugcauugguuuugugcucuugcuucuguucuugcaaauaugcuuauuaaaaacuuguaaccuaacaccaugacuugucuauauugguaguuuuguguuuguacugaugaaaugcuuugcucuuuauaaacugucagcagaaaagcauucguaacuagcauauugcuugugccuaaauuagguauuuaaggguuucuucucgugcuguguucuugcauacuucacaaucuuuaaaacaucagcaagacaagucucuggcuguagaaauauaaugccuacuucugcaacaccagaaaugaauaggaauuauuaccagaaaggugaaaaggaacacaggaaauauuuaugauguuaaagaucugagauaauacagcugcagagcucuuugguuauaaauguuucugucaauauuuucgaugcaaauuaaccuuucuuaugaggugcauucacuaugaggugaggguggggguugauucucauuuuaacuuaaagcagaguaagcagaggaccacugguuacgugugccccagugugugacuccagugaucucugugccuguggcuuuuucuuccugcagcugcuuauuuuagcagaccucuccaaaagaaacauagguuuuauuguaguucuuguuuguggacaaauguauuuuuauugcuuguauuuuaauuauuccuauuguuacugaaguuuuaaauucaccuuaaaaugagggauuuacagauucacuucauacauacguguuaaguuuuaacucugaaacaccuaacaacaguauaaguauguuuauacaaaaguuaaccuggaugaaauagcuaaguaaauaaagaaagauuguuuuggggccagacagauuacuuuuggugagacauuucggaacuuaaacaacucuuuuuaguggaaaaauggcuuuacaaauauuugagaggaacaguuucuacaagauauaguguugcuucagucacaaccuguucguuuguaaauuguuuuuuguuguucuaguugccauuuauaacaaaaggaaaaaaaaacaaacaaacaaaaaaacaaaacaaacaaacaaaaaaaaaaacacugaagaaauguugaggaccagugacucuuaagauuucucuuaaguuaauugcucuaaacacgcuggaucuuugaguaguauaaaaaauauuuuaaaagaaauuucaugggagaacuggaagaaaauuuauaagcauuuuuuuaggauaacagaguucaaaaacaugcauauaugcaugcacacuugcacauauacacacauacacacaugagagagaaagagagagagagaggguauuaaugaagugguaugcagucuggcuguaucaggcuuuagucuaaaggaagauugagcagagaauuuguccuauuuuaacaagguaaacacauauaaagaaagaugguguuccucagagccugggcucaacauuuccuuuuuaggguugauagggaagucaccaggcaugucugcuuuggagcguagaugacaaagagacaucuccagaaaugcuccuuauucuuauuaaaucugagauuacguuguuucauuucuuuucuucuccuaaaauuacaaggcauuaaauaugcaaguccagcaaacuugugguaaaccauaaacauucuauuuuaaugugaagcagucuucuccuuuacugcaauccaaauaaacaucccuaaacaauaaccucccuuuaagagcagcugagugggauuggguuacuagaggacacuugcccuugaacuuggggagguuggaugaaucacaaucuuuaugauuuuuuuuuaaauugagaaaucacaauuauguauggaguauucuguuuuagacauacugcaguauuagauguaaauuaaaaaugaauguguggaguuuuuuuuuuuuuuaacuuguguguguguguauuuccuaguguuuuuggaaaaagcuucaaggcuauacauucuguguauuguuauauggaaacauaguagcgaguaaauccaacauauuugcagagaugcagcucuucuugagaucacgagucugaaagugaugccuucaaugguugaggaugacuucuaagagcugaagagggaucuuaagccauguccguucaaaaaauagguggcuugaucucuuuugauuguucauuuugaguuaucuuuaauuaauauccaaauaacuagaaauuugcugugaauauacaauuugggcucuaagacaucagacuuguuugguuucuuggagccagcagaaugcacuguguuauuaauaaacugaugguagcugagucacuuguguucaaaauauugugcaaggcaugggugaagaacaaggaauacuaaggcacgcccugagggagaacauccacuaauguugggguaaacacagaaagcccauuauaacaugauaaguucauuaaaagaggucagaauaucgugcuucagaucacagaagcgguaacgagcagcacccugcucagaggagaagugaggggagacaggggcaggagacccagaaucucacguaaccuuuaaacuucuucagaagguagguaaucaaaauggcaaagcugucuaagugugggggguugaaguaaagaaaaugucuggguugaagugggagagagaaaaugcagagaauuguaucuuuaaguaccaauugauaccaaauaaugucuggcuucucaaccaacuuaggaaccaugguuaucauugacaggucagaagaugucaaaaaauugugucaguagaucuguacagaagaaccuuaaauuuuauacgauggcuugggcagcaacaugguggaagaugauuugaaauaauagaaauauuuagagcagaaacaaguuggagucuuuuacaacaauuuuauggggugguagaugagaccaaaggaaacacaggaggaucuggagaugaauagggcuuaaggagaugucucuggaagaaguuggagauuucuuacuacaaaggcacaguuuuauuugacugucauaugacagcacugagccaacaugguaauacaaccaugauuucuuauucaaggacacccugacagugaucuggcauaucgucuuaauccauaccccaagaugagacacacuauuucauacuguuugaauugcuacuggcaaggaaaugguuuacuuaugucuguaaucaccuuuaccuccuuuuaaagaccuuuugcugaaugcuugacuucuucauggcaaauguuauuuucuauacuuuuucucugugcucucacucugcuaugauauauuauguaucaaauugcacauaaaucaaguggcauccuugcucagaaacccuucucuuuguuucccugguccccaggucgugaaaauacaugagauaaucaugaaggcaacucucaucuucuuccuucuggcacaagucucuugggcuggaccauuugaacagagaggcuuauuugacuucaugcuagaagaugaggcuucuggcauaaucccuuaugacccugacaauccccugauaucuaugugccccuaccgaugccagugucaucuucgaguggugcaguguucugaucuggguaagugugucuggccaaagguaugccucuucuucauggaacugaguucucuugagugcuuggcccuuugaggucucaucucugcaauuccagaaguaagagacacacccccuaaagaggaguagggcaaauagucaaggagaaaaagaauuaacuuugaggcuaggacacuuuaggcuuuccacgcuacacugccccaccucucacccuuuucaaucaggucuacaaagguuuguagugaaucacuuuaaaaaaaaacuuaaugacuugaauagauccccuuuuugcaaaguaaaaugucuaccaauacaucaucuauauuguguuuccagggggauguuuauucuuucccauuuucauuuuuguuucuuuuucuaaauuuuugauuugguuuccuaaaguguuagauacuaugaaaacuuggaaagucccuuuacucuuuacagguuccaggcaacagagauuaaacgugacuaacuugcaaaaugcauaguuaucagaagcaaaaugagauggauugugcaacaaaaaauuaucuucaagaugcacaggcauucccugcauucucuggucuggguucccauguagcuuuggcagccgauuauggucuuuagaacuauucaacaggaauauuuauaacuaaagcacaauguaaauaucugauauaaucucauguucugaaacuucagcucaauacacuaaagagagcuggcuuaucuguuugaaaguaaaaauuggccuggaauuccaaaagccacaugauuagaagauaaaucuucagaaaguuuggaggcccagcaguugagccaaagguuaaugcauuggcuucccauggcagcugcuuucccuucuucucuuuacuugucuauuuucuuaucgcaaaaaaaaaaaaaaaaaaaaaaaaaaaaaaaccaugaucacaggacuaguguuuuugcugugugucuugcuuauagaagaaauaccacagcauaagaaggugcuucacagagaagccccauaguuauucagggcaauuugcuaggcauauuuugcagaaaaaugaucaguaauauuaaccagggaaauaugcucuacagaggagcacagacaaacguagaaguaaacuguucagcaucaacaaccaagaaacacuuaucuuacuuuucaauguugacacuuuaaaacuucagugaggguauacacggaggcuuucaggaggcuagagguaguuucucugguugcucagugaucugguaaguauauucuucccuaugaugggucaguggcacuccagauguaggaauauacauuauuaucuguuuccuuagaacuaccauuuucauagguuuuaaugagacaaaacagaugcaauguucaaacuuuugucaguauugacuauauuguauuuaauauaaguaauuuucuauuuaaaugcuugacuguguguuuuccucuauggcugaaguucucaaccuuccaaacacugugacccuuuaauauaguuccucauguuguuuauggugaccccacagugauaaaauuauuucuuguugccaauuuguaacuguaauuuugcuacucuuaugaauuguaauguaaauacuucuagagguagaagguuguuaaaggaguugggacccagagguugagagccacugcucuaaggguuauuugugccaguguuaaaccacaaugauucuuaaacauauuuucaaugagaguaaaugaaaaaugagaagcuggagcucagccauuuguuuauaaggagaugugaaagcuucuggaagauuccccgggacguuuggcuccaguuaucuccacuguagcaucauuuccugguuaucuagagcacagagggcugagaaaguacacaugaauuugccaaguacuucugcauguuuuguuaaaauuuaguuugagguuuaaaccagaauucagugugagacccauaguuccauucuaucuuuaucagauaaagaacuauuuuggaaaacugaucagcaaauguagucuuuaucaaauuauggaguccaguuguuaccaaaaggaaaggacaacucauuccuuuuauauuugcuauuaacggauaugugauuuuauauacauugcauauauuacauguagcaugaaauauuuugauacauauguacaucgaguuaugcuuuaauuuguuaaacauaccuauuaucucagacauuuagcacuuacccaugaagauaaucuuuccaaagccuuuccucuagcauucugaaacauuugguacacugaacuaaucuagcguugccugauuguguaauauaccacagaacaacauucucuaacugaacuuaguaaccucacaacuucucuaaccauucauuaguuaacacauacuagaacauauuuuguguuaaauuacaaaacuuucauccagaaaauggaacaauagaugugagaaacaacgggagaauauuuuuuugacuauacagcuaugaguuuuuuucuuuuuuuuuuuuucagaagaaauaaugaacuccaaaaauccacuaacaaaaaaauuaacuauauauuuaggagagagagagagagagagagagagagggagagagagagagagagagagagagagagagagagagagagacugagacugugccaagaaaggcaaucuuggguacuccagacaacuccagcuuagcagcacagaaugcuauucauaagaauaagucuuuggggauccaguccagacuagacuuccaugaccuuugauccuguuaauauuugguuaccaaugcauaagggaccauaacugagagcaaacuuucugaucccuugccaaauucuguguuuuaggucauaaaauaaaugauaauguuugaaagcucccuucuuugacaggcauucaucaaugguaacaguuacuuuuucaaaaugaaaaauagaccuaaauacacauuucucagaacugacccauuaacgcgugaaauaaaaauacaucaaaggucauucaucauuggggaaacgcuuaucgaaacuauaucacuggacagcaguaaaaaugacuuuaucaggaauacuaaaguagccaauucuuagaagggugucuaaaaaagggaguccuugaacucugugggcaagaauuaaaauaaaaauagcccucauagaaaaugauauggauaguccucagaauauuaaaaguagcacauuaccaucuagauguucuacuccuggguaagugucagagagguaccuucauacccauaggcgauggaaaaccauucacagccaauaaccgcuaacaggaaguaugcagaugaaugcagcucauuccuuuccaaauguugucuaaccuagaucuugaucagauauucaguucugugugcuugguaucuuggaggaagauaauuucucuugcuuauagauuuuuggcucaguuauuguugauggggccagggaucaccaaggagcaugauuugguaauaacuuugaucucacugcuagaauacauaugagcccugaaaagucaaauacacacaaucauugucuuaaguuuaauuuuuaaaaacuaagcacauaaugacugauauuugaaaaguaucucuaugccuuuaaaauaauuuaaaagagcuuugucuauauggaugaauauccuugaacugaaaccugcuuuguccucuccuauauggaacuugauauuuuaaaaaggcuuuucucauuuaauagguggauauguauauuauauugcuagacaagaacuuaaaaugcauauaaacauucuuacaagaguaacguuuauauucgggauacuaguucguagauaagcaucucaaccgcaaggcaauuaaugacauguguucuaucuuccuugaaaaugauugucucauagguacauggcucaugaagcugacaaaggcagguauggaggcaaaauccaauauucucagcuacucagcagacugaugaggguugcaagcucaagguccauuugggcuacagggagagagagagagagagagagagagagagagagagagagagagagagagaaucagagcgacacauagagagaaacugagaaagauugaggaagagacagagaaagaaagaaauggagaggagagagacagaaacacagagagagguagagagaaaugaaaaagacagagacagaggucaaaggucauccuagauaaguaaggaccucuuaucaaaauaaaagguaaagaccuuuuauugcugcaauaaucuaucaccuccuuuauaagcauugaagauuagcuuuaguuugaacuguuaguguuuagucaucacaaugauucguaccuccaagguauuuccaacucaguguuuugaauaagaacagagagucucaaguguuugaacuuggcacucaaucaucucuaauucauagcuugauuuauuuuuaauucaagucacucugaagcuaaaaguugucuuagcauaucugauauuuuauugauuuacaaaaaaacuggaguuuuuaaauagaauuuuuaaaaauguuuauuuaauguccuaauuaagcagaauuaaguugauuaagggcagaucuggguauaaucauuuuguugggaagcaucugcuaacugaaugaaggcuuucuaugcacacauggaccuuuguagguaaacucucugaagaugcugaacuucguggaacaaagaugcacacaacaguagccauuacucacaagaaaaacuagcucaagguuaagauguuuacauaaaaaaaaauuaguguuuguuauaccugcaaaauaaaauuuaguuuccauuuaguuaauaauuguaauguaaagaagagaaaaacagagagauguagauucuaaucaucagcaaaaaaaauguagcuuaaauugucuauauuuauacaaaucauaauaggaauugagacuggcucuaccugugauagauaauuaauuuguaauacgauuuacugauuucucauaaaggguaucuucuaaaagguaucauuuaaauaugcuuucagggaaacuuauaauuugugaccauaaugaaaaagacaaaaaaauuauuauuaaaauuaaaauaauaagaauuauguaacuaucucaacuuacacauggaaauucaccaccaucgguaacuccagauccaagagagauccaauauucacuggauggcacuccaucaucacuaggcacacaugugguauaaaaacaaacaugcaggcaaaaagucacauacauacaaauaaaaucauucuuaaaguguuuuaauaagaugaacuuuuaauuuacugaagaacuucaacuaguucauugaacuacauuaauuauuauauucacccucucucaaaauagcuuuuagguaauuuccagaaguuucauguaacacauaaauauauaauaaaauaaauaauaaaaauuaaauaaaauauucaugaguaaacucuaaaaauaacaacagcuuauuguguauauuaccaauuacucuguaaauauugguguguuuauuccauuccuaguuaauauuuauuauaauccauguuguacauauauugcacaguugcagggagaugguaguaucaccagugacuaaauuuagggucuuacauguuuacacucuuacaguaagcagugaacuggguccacucuccaguuuuaagauuuccuucagucuucuuuaaauuguaguuccacaaauuuuccuucauguuccuuccaagccauuuauucaaaaaguugaggccccaacuuuaugauaucaucuugacucauuucaagugaaaguguagaucuauuaaucaaauucaaaauuaauuuguauauagguuuuggucaauaucucuccaugaauguauauuuguuuucccaucuagcagcuuauaguuuauccuucuccaagauaaguauauacuauggaaaaaaguuguuaacccagaccccagggccauguaaaacagagagaacaaacaaucuuuuucagccacacaugugacuaaagaugccuuaaaaauaugucacagucaaagaagaggcaacaauucacaggugaagacaaaggacauggcauauuugauggggagauucauuugauaauugaaaacuuaggacuaaaugaagaaaguuuugucauaauacacuggaggaaaaagaaaaccuuaauauaaaaaauuaggaugcagagagauuuuauaacacaacauagcagaaaaacauuucaagagcaugcucaugaauucuucagugcaugauuacaaggcagcuuuauuuuuuuaauuuaauuuauuuugcuuucuuuacuuuacaucucaaucacugcuccuucccugucaacccuuccacaauauuuccucauccccuucuucuacuccucugagcagguggggauaccucuagauauccccugauuccuagaacuucaaguauaagcacuuccucucccauugaggccagacaaggcaucccagcuagaagaacauaucccauguauagacaacagcuuuugguauaugccacauuccaguuguucaggacccacaugaagaccaagcugcacauaugcggcauaugaguguggaggccuagguccuauguguauguucuuugguuggugguucaaaaucugacaacuccaagaguccagguugguugacucuguuggucuuccuguggaguuccuauccccuugggggucugcaauccauccuccuauucuuucauaaacguccuuaagcuccauccacuguuugacuggguuucugcaucugucugagucagcugcuggguggagccucucagagaagaacuugcuccugccucaagcauaacagaguaucauuauaauaguguuagggguuggcgcuugcccaugggaugggccucaagaugggaaaguugauuggucauucccucagucucugcuccuucccccaagccugcauuuccuguagacagggaugaaguuuggguuaaaaauuuggcagcuugauguuuuauugcuaaugugccagaaagaaacuugugcaugaagcauccagaaaaccuucagaauggaaagcaaaacaaaacaacaacauaaaccacuucuauuuauccugcauuugcaggugaacaagcaaagacucuacgaagaugagaauguaggccaugagccugugguuucuaagaaguguggguucaaggcccugucgggcagauuaguauuuguagaggaagaaccuugagugagcucuaaaggguaauagagucagagcaaugggugaaugugauuucucacaaaacauucaugauaugaaccaaagugaauuucuaggaaugaggguguucaagaugagguggugcucaggaugggguggugcucaggaugguguggugcucaggaugagguggugcucaggaugggguggugcucaggaugagguggugcucaggaugggguggugcucagaaugaggugaugcucaggauggggugguggugcucaggaugggguggugcucaggaugggguggugcucaggaugggguggugcucaggauggggugguggugcucaggaugggguggugcucaggaugggguggugcucaggaugagguggugcucaggaugggguggugcucaggaugagguggugcucaggguggggugguggugcucaggaugggauggugcucaggaugggguggugcucaggaugggguggugcucaggaugggguggugcucacauguaugaauagcaaagccgauguuucaauggugaggacucauaccaucuugguuauuggucuaguuuagcuaggaucuaugauggaaguuuuacuucucuggucuuguuuagucaggauaaaaaaaaaaaaagaggguugacuuagauuacaaauuaccucccuccccucccccuuuauuucugagacacauuuucuuuuagacaagaacucaguauguaacacuggcugaaaacaaaucuaucacgaauacaguugaaauaaagcuuaacaaaauaaugcaaccuuccagcaccaauuaagucaguuuuaaaaggaguuauauuuaaaaguaaauagaaagauaauaaacaaacaaacaaacaaauaaauaaauaaaagcagagaaugugugugagagagagauugagagaccaagagagagacugagagagaaaaauagagagauuuuuacaucaaaaguauucagauuaacuuaucuacuuuucuuauuugaauguagucugcuaagcaaccucauuuagcugacauuaagggcucuuucccuuugugauguucuaagaacucauauuauggguaaucuacccauuguacuuuaccuagaucuuugaagauacuaauuuacagugggacauuuuaucuagauauaaaauguauagaauuagggggaggaaucuggugugagaacauuuuuuuuuuuggcugggggacauauaaauaaaccugacgcaugaaauauuauguugcaagccuagagggucaucuuuuagucauguucauuauuccuaaugaggauuuuguuuaugccauuaaacccuuccuaaaagucaccagguaaaggaaguuaccaugcugccuuacauuucugcuucaaucaagagcuuucacagcaagguuuuauaaauuauuauaguacuguugggaagggaauaguauaacauaacuuuaauugaaauaaucacuauaguuauguaauucaaaguagucaugaugaacuucaguguaugagguucaccaaaugaguaugaauccauuaguacuucagagcaaauauguaagcauuauaauuugaucacugaaauggaccuccaagagcuaauuugcaagagucacaagucugagaggguauuuuucuuuuaugcuccaucuccagauauaacacauguaacuuagcuuaagcaauuucugucauaaaguucaagggugacaacaugaacaaaagggugagccuuccagagacagaguccuuuccuuacgugcaugggauuuuuuucacacaaucuugacauuguucaaauguuaagacaggcucuagaguuuuaucucauaauuauacaaaaguaagcauaagaggaaauuaaaucucugacagaaagcagaaaacaagcacuaaugagacacaggacuacauuccaaaggaaaggaaaucaugucuuuuugugguuggaucacacuaauuaucacagauuuggcaaaaggcuacauccucuaauugcaggcaauuagcaaauugacauuuuugaaaauggcugugauuacgguuguggaguacccuccugucacccucccacaagguagcuguucuauagucuacuucccagugcugaacacacgucaaucuuucauuucuaugggaaccacgccuguaaugaguucaguguuuauagaacauaugaugucaguugagcaucacaugcauuagauacugaacuuuacuaagacacuggucauugcuaugaacaauauuuccuacuacuauaauuggagaggcagucucuggacaagaccaacaacaauaacaacaacaacaaaaaagaccucuuagaaauaagugauuuucaaauguauguaauuaucauggaagaaauggaagagauuugaaauuugauagccaugugguuucugaguacaugcucauuaaaggcucagaacuggaaagcuaucuucccaacauaguuguuauuauacucuguugugauuguaguucuaaugaaaaacuauagugaauuguauuuuucaugaguuauacucccaugugaguaaagucuguuugcuuccgcugcauaugcagccuccagucaaugaaacaaaguauuuuccaaggagucagaacucuuuaguauuucaagcuuuauaguuauggaaaacuuguuucuauucaaaauuuuaaauuuuaaauuuuuguuaagauaucugaaaguagagggauugucacacuaugugagaguagaauuuccaaguuguuaaauuuuuugaaaaaguauauguguguguguuuauguguguaagcagaggguguauauaugcacaccuauuuauaugaaucuguauugauauaaauauagauauagauauaagugcccaugaagccaaagaaggacuggagucauugcaguuggauuugcaggcaguuguggccucuuguuguagcuuauagaaaucaaacgcagacccacugcagaaacagcacacauuuguaaacacugugucucugaacucaaauauccaguuuuuauuuuaccucccuucaucccucaaaauaaaaaugaaaauauguauuauaauugguuaaaugaguagugaaucguauuuuugaccauaaaggucauaacuugguuguuaugugucuauauugacguacugaaaaucuacauuccaaaauuaaggcuucaugaaguuaguuucacagaacuuaugccaccaaauuuauccuauucaaccauagaccucuugguuauaaaauggcaauuaaaacugauauugucacggcacucuaauucaaaugaaaagaauuacucucccaaaagcuucaauuuucaauguaugaaaagggcccuguuuacaaguucaaaugacuuuaaguuuucauguaaauccaugucaguguuagauuuauaaaaguugaugcaaacuuugguuggagcccacguauuuauaggguauuuauguagguaguacagguuacaauucuagccaauauuuacaaacauuuguuaaggcuuaacauguagccaaagauuagagccucaucguaagaagagcaaaaauuuccgcugugaggaccaacaaauauauaggaaacauuuuuaguuuggaaacuaaacuaaggaaaaaaaauucuugacuugguugggaaagaugaaacaaacaguuucagcuacaauugauguaaaucuuggggaaaauacauaacagacaagcuggcaccuuaauucccuuguguauugguuaggguuuuacuguugugaacaggcaccaugaccaaggcaagucuuauaaaaacaaaauuuacuuggggcuggcuuacagguucagagguucagucuauuaucaucaaggggggagcauggcaauauccaggcaggcauggcacgggcagagcugagauuucuaugucuucauucaaaggcugcuaguggaagauugacuuccaggcaacuagggugaggaacuuaagcccacacccacagugacacaccuacuccaaccaggucacaccuauuccaacaagaccacaccuccaaauggugccacuuccuggcccaagaauaugcaaacuaucacaccuuguaaacacauaauuuuuauauguuggagaugguuauaauccaaguauuuaguaggcuuaggcagaagaauugcagaaggaaggguagccuacaaaauuagauauuguaucaaaaacuaaaaaacaacaacacuguuuuaugaugccgucuuugggaauuucuucucagagguuaugccuucuuguuuccccuuugcuagguuuggacaaagugcccugggauuuuccacccgacacaaccuugcuagaccugcaaaacaacaaaauuacagagaucaaagaaggggccuucaagaaccugaaggacuugcauguaagaaucauuuuaucuuauuauuuguucuaagaccagacucuaaugguauuuucaaaagaaaccuacaguuagaucaaaacaggcugcgguaaugaaauaguacauaacugugcgcuuaucugauucucuuccuggcaaggacagauaagcagaguaccauauuaaguagccacuaacaaaaaaucaccaccaauauuucuacauauaauccaugugucaucacuauuuacuuaaaacaucuuuauacuuuaaucuuugucaauguuuccaugaauaaauacauguacugucacaaauagagggcauuuugauuauagaauaaaacacagaacuacuuaauucuaguguuauuuuaugcuuuuguuucuuuuguugugauuuauucucuaagagagguauggauggccuuggaaauucucuugguaucaacagaauaaggaauaaccaccauuuuauucguguguguguguguguuuaacuuaugucuacucuauguucaauaggauauucaagaauacauuggaaagggaagauacuuucagauggguuucauaagaacauuucauaaaggccuuguucauaaagcagcuagaaaaugaggcauugugaggcacucaaaucugaagguagcaggagguaggagaauuauggggcagaacacuagaaggucuuacuucaucaucuacauuacuuaaucuuagaguguggucaaggcacuaggcugaggcagaguucagcuuccucagacauagaguaguagguaccccaaacaaaaaaacauaaacauccuugucuugggaaaugugacaugacugagucaaauugugucaagcuuucugaagcaaaccuuugaaguaugacuacagagagcacuggaaucucuacaaaauauaucuuuuauuuuucaguuggauuccugugggagaaguaugauaccuuucaaaauaccaguaaacauuuaauauaggcaagccaggcaucaacaucuaaaguacacuguacuaugaaaaccucaaccucuauacucuacuguggggccauucucugaguucugaguaugauccuugacaaagcccauugagauggccuuaaagaacauucagagauggaugauaaugggagaaaguaacugagugucauguauguugacauaaucaauagagauaucaaugccuacauugaaugaaaggugacauaucuuauuugaaagucacaaugagaaagaaugacuacagucacuucucucaacagugagacaacacaauucuuuuuuuuuuucauuuuuuauuagauauuuucuucauuuacauuucaaauacuaucccggaaguccccuauacccucucccugcccugcucccacuucuuggcccugguguuccccuguacuggggcauauaaaauuugcaagaccaaggggccucuccugccauugauggccgacuagaccaucuucugcuacauaugcagcuagagacacgagcucuagguguacugauuaguucauauuguuguuccaccuguaggguugcagaccccuucagcuccuuggauacuuucucuagcuccuccauugggggcccuguguuccauccaauagaugauuuugagcauccacuucuguauuugccaggcacuggccuagccucacaugagacagcuauaucaggguccuuucagcaaaaucuugcuggcauaugcuauagugagacaacacaauucuuguauuggggagaaauaucagagaagcacauuuguauuccauauuaaaaccuaauuuaaagagaauuuacagaaaauagaacuucuagugauauggccccaacuguggucguaaugguucguaaacauuuuauuuuaacgaugaaugucauaguaauauaauucugaggccuagggcacuuauucacguuuauuuauuaugcucauugaugaaauaauugaggaaauggauauuaaaaucagaaauauauaauaaaauacaucuauaaaauguaccagccugauguuacauaguagaauaggggauguagauauaaaagcaauaaugaaaugcaaaauggaauaggcuggucugaaaacauuacaaaguuaauauagucaaaaugagauuucguagugaauuucuugacagcugagaagauggucguaaugcauauccauagacaauauacuagauuuguacaagaaaucaacuguuuuucucaaucuauagauucuauauggaugaugcuaacuaauguguaaugugaaagaauuaaaauuaacauugcaaccauucaaaaaacucuguaucagucagauaagguaguaguauaugugaaaaagguaaugucaauuugucaguaugucccaacauaaacaacauacauguaaguugugaguguugagagaaaaaucgaaugccaguguauacucaauuaacagguuuuuuuguuuuguuuuguuuuuguuuguuuuuguuuuguuuuuguuuuuuuaagcggcucaaaggauuagcaggguauugaaaagcaaaaaggaaaggggguucacuguguaagagaaaaggaaaggcaggagagagagagagagagagagagagagagagagagagagagagagagagagagagagagagagagagagagaauaaaaugucacaaagacugagugaaaguuaaagguaugccugaaugaggaaaugaccugagccugagccaggcgcuuuuuggagugcucugcagcacugcuccuaagaugccugagucccacaccccgccuggcucauggcuuucaucaaagcuucguggcagaguuguuggcaaaaucagcaauauuugucucugacucucuaagucgcugcuaaaacaauuuuagaaaagugaaaauaaagaacgaguaccauuuaaaugaacugauacagacuaaaauaugaacuuacuuugccuacauuuuauuccaaaucugccgguuuuagggaaggaaaguuacaaguuuuagacaauacaaggguaaucugagccuggguuugaaagguccugagccuggguuugaaagguccugagccuggguuagaaagacauccaguuucugcaaggcucuccuuaaaucggccacagaugccaggcguucucucuauaaguaaguuuccuucuggaaguuuugugaagcguucuucaucuuggcgagccucuguuucuacuucaaaguauccaucggaagaagaggagaguucauuagaaccugugaucaugcagggaugccaaacggcuaguuaucucucagucuuucauucuuuauuccuucuuuccuuguuauuaugcaaaaagacguuauaauuuugguuaggaaaacuguguugggaugacaagggaggaaagaaacaaaaguuuaguuaggauuaaaauagaaaagucuaagcagggagaaguccuuuaugcccuauuuuuuaucuucauuuacaacucaguggguuauuucuuuaauagcuuuccguagaccauauguacguauagaugcacguguaaugaacaacuuuuauguaauaauagagccauguuuccuucuuucuuuuuuuucaggagcaaggugcuauguaauuauucuuuuuuaaaaauauuuuuuauuauuacguauuuuccucaauuacauuucgaaugcuaucccaaaagucccccauacccucccccacacuuuccuacccacccauucccaauuuuuggcccuggcauuccccugcacuggggcauauacaguuugcguguccaaaggauauaccuucuucucagcaccucacgggaccuucuccaaaauugaccacauaauuggucacaaaacaagccucaacagauacaaaaauauugaaauugucccaugcauccuaucagaccaccauggacuaaggcugaucuucaauaacaacauaaauaauggaaagccaacauucacauggaaacugaacaacacucuucucaaugauaccuuggucuagagccauguuucuuaugcucguuucaaauugcggcauuguagacauagcaaggaagggguuuuaaaauaaaagucaacagaaauugucagccacugaaaacuaaaaaauagucuguguggcacucacaguauuacagguguguagguuuccaucccaggaggccuuaagguaauuaauccuuuuggcuguuguuuuacuauccugcucuauagauacaggaacucaggcagagggagguggguuucuauuucacacagcacauaagagccagaacuugaguguagaagcugaccuucuauacucaggagcauagcuaugagauggaguccaauaagacucuuggaacagaagcccuacauaaaggucuuuuggggaaaaauguauaaagcacuaaaagucauauuucaauauucaauagaguaaaccaggccuuuuaaacuggaauucauacauugaacaaugucaaaauuucauuucuauccucuauggcuggcauuuaaggcugcagaaacuaggugccuaaauuuaaggguuucguguaaaauuaagguucuacaaucucuaguaucaacaaaugucgcaauuugcuuuucuguacucuucugacuuaagacaucacugauauuuuucuuuuuuuuuuaauuagguauuuauuucauuuacauuuccaaugcuaucccaaaagucccacacacgcuccccuauccacucccacuucuuggcucuaguguuccccuguacugagggauauaaaguuugcacgaccaauggaccucucuuuccacugauauuuuucuuuaaaauaacuuucaauuaaaaauauaugauaguuuauuauuaugguuuuuuuuuacucuucuacaacuccucccagauacuacccauuucgcuaucuacccaacuucaugauaucucucuuuuucucucucucucuuuuccuccaaaaacaaaaccaaccagauacuaaaauacauaaauagaaagaaagcagucugacaaacaguaucaaaauaaaacaaaagauagaaaauccaaauaaaacaaaagauaggggaucuguuuugugguggcugccagguacucauggguauagagccugucuggaauauaauuguuauaucuagugacccuccauuggacaaaaaugauuuucccucucuuuugcagguaucaauagcaaauagcuucuuagucagagugggaguuuuucuucacuccauuucucaguaauuuuuuuuuuuuuggggggggggucugguuugaaugugugcaccgcuuguaaguaccaucacagucucuuucaguucauuucuuuaccaguucugcugugucuagaagauucuguuccuuggagucacucaccacguuugacucuugcaauuuuuccuccauuuuaaaacauagaucccugaguauuggggagggcugugguugccaaagacaucccaauuagggcugaaugcuucaaaaucucucuuauggaaggggacuguugcaucaauagcucuuuuaggcaggucuuuguuguaggucauagguuuguaauuggugacaccgaugauugcauucuccuccaacagccugcuagucauuagaggaaaagcauuuauuugggcaccaguacuuuuccuccauguuugaugacauaguaagugguaucuucaggaauagggacuucccauuguggaagcugaccaaugaccuuggcaauacucucugauggauauuugguguguaugcggggaccccuugggucaauuauuccacacaauuccugacacagagucuuacuugguaacauaauuauuuaguuggaacauucucaccgauauuauauggugagcccauuuaaauuauuuucuuacuuguaugcauuuugggaagcuucuacuauguuagauuuccauacagcuguuaaaaaagucuuuuuuauuauugauuuacugcuauauuucuuuacaucccaagugcugaccuccucacaguugccccuuguagagucucuuuucccaucaacauuacccuuagcauauaagaggguagcauccccccaggauaacuccacgcuccccagaaaaucaugucuuuguaggauuaggugcauauucccucacugaagccagacaaggcagcccucuguuacauaugugccuuagccucggaccaguuccugugugaucuuugguuguuggcucagucucugggaggucccauggguccagguuccuugacacuguuggucuuacugugaggucaccaucuccuucagggcccucaguccuuccccuucaucuauaggggucccugcccuccaucuaauauuuggcagugggcuucugcaucugucucagucagcugcuggguagagccucucagagugcagcuaagcuaggcuucucugucuguaagcacaagguagcaucaauaauagugucagggauuagugcuugccugugggauaggucucaaguuggucuggucauuuggucagucauucauucagucucugcugcaucuuugucccuguauuccuuuuagacagacccaguuuggggucaaaauuuuguaggugggcugauguuccuauuccuccauuggggguccuaucuaacuacugucucaucagguuccauauccccacuuuugggcacuuucacauggaguacugggaagguaccacaucccagaucucuaggacuugcuagagguuccucucccccacccccagcaguugcaugcuucauuuauucuccuggcccucuggagaggaaggucuucaccaucucuccugucuccaccauaccugacccuuuccacuuuuccccucccucucccuuucucacacagaacccucccucucucugccucccaugauuauuuucuucccccuucuaagugggauugaggcauccuugcuugugcuuuccuucuuguuuaaauucuuagagccugugguuuguaucauggguauucuguacuuuuuuggcuaauauccacuuaucagugaguacauaccaugcauauccuuuuggguuuggguuaucucucccaggaugauauuuucaaauucucuucauuugccuucaaauuuuaugcuguccucauuuuuaauagauaaauuuuauuccauuguauaaagguaccauauuuucuguauccauucuucaguugaggaauaugugggauggcccguuucuugauauuaugaauaaaacugcuaaaaacauauuggaacacauguccuuuugguaugguggaguauauuuggguauaugcccaggguugguauagcugugucuugagguagcuuuucuguuuuguuuuguuuuuguuuuuguuuuuguuuuuguuuuugcuuuugcuuuuguuuuuguuuuuuucgagauaggguuucucuguauaucccuggcuguccugaaacucacuuuguagaccaggcugaccucaaacucagaaauccgccugccucugcuuccugagugcuggguuuaaaggcgugcgccaccacacccggcuugagguagcuuuuuaucuuagccauucugacagguaugcgauagaaucucagagucauuuugauuugcauuuccuugauaaguaaagacuuugaacauuucuuuaagugguucucagccauucuguuuagcucuguaccccauuuuuauugggguauuuguugucuuggauucuaacauaacaucuguaacaacaacaacaaaaaacccaacccauauaugucuuuugguaucuuuguuaccucagacauggugauuauuucuaguucccucuaauuuacuucccugcaaauaauuuaaucuuuuugaucagcuuaacaauauuccuuugagcaaaugcaccauguuuuccuuaucuguuccuuugauuauuggaagaugaacuugguagcuuggcuuuuucaaauuucuggcuggcuguuauagagcugaaaugaacacaguugagcaaguaucuguguaguaaaauggagaguccuuuggguauaugcuuacaagugauaauaguuggaucuagugguaggucuguugccagcuuuuuugagggaugauagcaacaguuuccauaguggauuuaguaguucacacucacaucaacaaguacuaacuuuuccccuuuccccacaucuuauccaucaugagaucucauauguuuuauuaaucuuggacguucugucuuugaguaaaaugaaaucucaagauuucauuuucauuuuccugaggacuaagaaugcugaacauuucuucagguucuucucaaccauugcauuucagcuuucgagaacucuuucuuuaguucuguuucccauuuuuuguguguuuguuuauuugagacaagauuacucucuguagcucuuucuguacuggaacacacucuguagaccaggcuggccucagagauaugcuuguauuugacucauaagugcuggaauuaaaagcaugcaccaccauggccacuccauaccccauuauaauuggguuacuugcuuucuucauguucaguuuuuuugcuuguuuguuuuuguuuuuguuuuuguuuuuuugagacaggguuucucuguauagcccuggcuguccgggaacucacuuuguagaccaggcuggccucgaacucagaaauccgccugccucugccucccgagugcugggauuaaagacaugcccuacuaugcccggccaguuuuuuuuuuuuuuuuucuuuuuuaauucuuuguaucuccuaauuaaugaugcucugucuauuguauaauugacaaguuuuuuuuccccuuuguagguuuccauuuuccugacaugauagugucuuuuguuguacagagaguguuuaguuucaucagguaccauuauuuucagucuuaaugccuugguaagacugauuagcauccuuuucagaaaguuuuuucuugugucuuguuuucaagccuauucucuaauuauucuccuaucauauucaggguaucugguauuauguuggggccuuugacacauuuugaguugaguuuuaugcaggauuaugaaaauggaacuauucucaugagaagagagaggauugcuuugacucuguagauugcuuuggguaggaggccuauuucacaacaaaaaucuuacuaacccaugagcauaagagaucuucugauaucuucuccaauuucuuucaaauauccuauauauaugauaauuugaaagguauuguuuccaugaauucuuucuuaguauguuugucauuucuacauagagagacuauugaucuuuuuuuuuuuuuugaguuaauguuaaguaaucccugcuauuuuacugaaaguguuuaucagguguagcaguuucuuagugauguuuuuauuguuaaaaacuuaucuucugcucauaaagguccuucccuuucuauuucaacccccuugaucuuacauuuuauuguuauucuagcuaagacuucaaguucuauguuucacagguauggagagaguagauaucuuugucuuguuccucauuguaguggaaaugcuugcauuucuuuugauguaugaagauguugucuaagagcuuauuauaaauugacuuuauugcuuugacuauaggucaauucuaaaaugauuuuuaauuuuuuuacauuguaaguuuaucuagcagaagcaguucguuuuuaugaacacuuaauaaaauauauaguuaucuuuauauuaucuuuccuaaauuuugucaucagaauuuuuuuucucaaccaguuucaauaauuaauaucugaaagcacaagacucaagucauuagagagacaaacuuaaaauuaacguuucaguaagccugucuaggauagucuuggaucaaguuuucuuuuucuuuaaauaaucugaaucacuggacacacacacacacacacacacacacacacacacacacacacacacaauaaucauucaugauuauuggcacacagcuaguuuaaaacaguuaauuaaaacugaaguguccaaaguuuucucuucaagaguccaaagguaagcugguuuugcuccauuauuaucuaagaaauaaucuugaguuuuuagagcauuaguaccaaauucacagaacuauuacauuuucauuauuacagaaaucauuacagaccucugcaccaucgacuuuuuugaaaugguuccacagaacuucaaugucucaaaagagccuggaaccuucuuugucgcauggccaaugucccaaauaguuuaacaguacuccacacuuacucaccacaucuuccaaauuggcaaagccugucucacaagugggaucauuuucugauuauguguucuuuccuuuacuaugcuuaucauucagguuucaaccuguaggucaagaccccucuaggauugaaugaccccuuuccagcggucaugugucaaauauucugcaugucagauauuuacauuacaauucauaacaguaccaaaauuagaguuacuaaguagcaacaaaaaaacuuuuaugguugggggucacuacaacaugacaaacuguguuagaggaucacggcaugagguagguugagaaccacugcucuagaaagucaagaugaauguucucauagaucuaacaagcccuuucuacacagagcacagcaggaaaaaaaaauagaacaaaggaggccaaagcaugaugucuaccugaagccacauauugugggaagacagcagagucucccucucuguacagucgcuaucaccagcuauguuuaaguucucagacuugggcccccuuuugccaaacacugacucugagccuuaggaagacuggaugauggggagaugagaucgcuggcauugaugguaucuaagaaucuggcgucauccgaugauuucuuuagcaucacuuauaguuuuuuaaaacauuugaaauauguuucuuuaauuucuuauuggauauucuauuuauuuacauuucaaauguuacucccuuucuugguuucuccuccagaaacccccaucccaucccccuccucaugcuucuaugagagugcucaccuacacaccgaccuacucccaccuccacacacaccucuaugcuggggcauugagccuucacaggauaacaacagcugagucuccucccauugaugcccuacaaggccauccucugcuucauauguggcuagagacaucagucuuuccauguguacucuuugguuggugguuuagucccugggagcucuggguagucugguugguugauauuguuguguacacacauauccaacacaagagaagcacauuucuauauauuuuccggucuucugauuguuuuucuagaauuuccuaccucuuugacaaaaggaauaaauuggcuacauauaugucaugugcauauguguggaagccuucggauuucagauauuauuuucugccauuuccacagaccuugauccuugucaacaacaagaucagcaaaaucaguccagaggcauucaaaccucucgugaaguuggaaaggcuuuaccugucuaagaaccaacuaaaggaacugccugaaaaaaugcccagaacucuccaggaacuucguguccaugagaaugagaucaccaagcugcggaaauccgacuucaauggacugaacaaugugcuugucauagguacagacuuaauuauuagcuugaggaucgggaccaaggggacaugaugaaauuucaaggaauccuuaacugcaggaaggggaugaauccaagugagugcugugugucagagggcugugugaccaucagucucagggcccaaagaaaagugacaaggugcuugugccagacuuuuucuucuuugaccuugaugaucuagcauggagggaagacugacuauaucugaucagaugagcaggauauaacauagagagugcuucauaaaagagauuugggaaaaccuguuuauagcagaguuuuauuguggucugaacacaacacaucuauagauuauuuccccucuaaaaguaagguuuuggggugugugugugugugugugugugugugugugugugugugugugugugaaagagagagaaagagggagagagacagagagacagagagacagaaagacagagagacagagacagaaauauuauuuaauguaaauucauaauugucuugcaaaaugauagcuuuaaauucucuaucaacauugaaaauugccugaaaaaucucuaccauaaaguaucguuuauuaacaccuucuuagcauuucuggaagaauuauaaauaguuccuugacuguuuauuuuuauuuuuauaaauaaauugauuuuggguuuuuuuuauacuuguuauuauucguuugauuaguuaauuaacuaauccauacaugguuucauugcauagaaagagauucaagcugcccuugaauggugaacuuccugucagaaguucucuaguguuggggugauggccccauugucuaucccauaacaccaggcuguguuucaguagggauaaggcuucauuguauuuugaugcuucucugaaagcaucugguuucucaaucaagaaguaaugaagcuaaaauuuuugucuagaauccucgcugaagcaggcagacaucgaacacucccucuaacagcuuugcaccuuuugccuuuguagaacugggcggcaacccacugaaaaacucugggauugaaaacggagccuuccagggacugaagagucucucauacauucgcaucucagacaccaacauaacugcgaucccucaaggugacaggaaauucuccaaaaaauguuuugaaaaaucaagcuccaaauagcuuugagauaguuuuaaaauaaaugauuguggagguuuaaauugggacacauguggcaaaccuuauccucagugaacucucaauuccgggcauuguguuucuagacgcugguugacucuugggcucugcaggcacacauagacucacuguaaaaucuguucuaagugggaacuuaagauacagucuauuuguauucugccuuuaugauuuucuaaagaaaaaaaaauacuguuagugaaagugcauucauauuauguuuaaaaaaaaaaauaggaaaaaauauuccugguaguauuucugaaauugagccaagugugaccuuaguuuuccaauccauggggaauucuugucacugcaaaacuuuccauucaucagcaucucaauaaggagaucuaacugccuucugaaucuuggugaucagaaagaauguagacaccacaaucuuugauucaaguugucacuugaauuugagaguucaaggacucuuaaauucuuaggguuagggucucaaaaguaaguagcaaagcauguggguuauagauagguagggaacuaauaaugccuccuauuuucauuugaaaauguauugaaauuuuaagcuuaaucaauguacacuagagacaugugaguggguaaggagauacuguuucucugucaaacagagccagaccauuuaagaguggucaaaucugucagcuucaaaccugcuuuuacugcuccauggaagccugucuuggugaaccauaaaagaugaaaaccacauuuuuaaaaacaugccuugaaugucacuuuccuccaaccucaaaguacagucucacaaacgucucuccacauuccucccuaucuccccucccagaccuccuaagcacaggugccuuguuccaaaacugggacuagaugcaaauucuccucugcaggagacauuggugauuuuuuuacuguacuuuuagaaauuaacucuuaaauguaauuagaccauagaaaccuuuuuuaaaacucccaccuguacagucuuuuuauauagaggguguuuuuggugcccaggggauaggcaccaaugauagauuaaugaauaagauagcuagcuagguaaguacauauuuauucauaccuuaaaauguauacuuauucugaauauuuguuauuucccaauucugugucuuaaauaauuauuaaauaauuauaaauaaauuaaauaaaaccucccuucaggcacguacuagauccguagguaugaauucacuguuuucuuguagcuguugcuacucauuaaagcagaacucugcauuauuaacagccauauauagacaugguccuuuggaaggcaagaagaaaugaaaaauuuaaauauugcuuacuacuuacauuacuaaaucuucggaauucacaaccauuaaucaaguauuguugagaguuuagugggcccuuuaaauuuuaaauuauuugcccagguguucuacauaugucagguuauagggcucuggaccuccucucagggggaaacagucuggauuuaauaggucuauguaaguucuagcuauugcuggacagccauggugcagaggcaucaaauacucucacaaaggcauccuguccacaggccaacaccagcacgauacacugaguucucauucugaauuaaucuuauaauaaaauaucuguguauauuuauacacggacuuaacugauacacuggugcauaaucccugcacuagcauuccagugucggcuuccuccuuuucaugauuuuacaucaugaauguguuuauauaauaacagcaaugugagcucacugacacagguggagagagcaaugaaggucaaugucugacuuugguucugcaguugcaagcacaaaaauccaucccaugauacuggcaguucuuaaccuuaucaaugucucucuaagauaaaaacaguaaagugucacaucacuuuaaaguaugcauuguuuuuauaaaaagaaagaaggaaaaagaugaagaccaaaauuauuugaaaugguauuuagaaauucacagcauggguacccauuggaguauauucugcauuuauaauguguguuggccacuucagcaucuuuuucugcuuauuccaggucugccuacuucucucacugaagugcaucuagauggcaacaagaucaccaagguugaugcacccagccugaaaggacugauuaauuugucuaaguaagaaauccaucacuuucuaucaaaggaugccaagggaaggguguuauucaacguuagaaacacaaugcucuaucaauuuuuaaaaacuaucacaccuuauuguugcuuuuaaguaaaacuccagcuuaucagaugaauucuugauaaaagucaacgaacuauuauaauuacuguaggcaacaaaauuugucacauguuuuguauauuuugugaauauuguauggcuuauaguucuuuuauacaggugcucaguuaaaacauguuuuagaugucuauuuaauauauucuaguucaaugugaucaaaaagaaaccuaagaaagacuguaaacaguuugacccaaguuugagaauauauucaaacaggaauuauaugggcacugaaauauuacuuugagacuagcugcaacaaaaauuauuuaacccauauucucuuaauggcuuaaaagaaaaugucagucucacaaaagaaagaaaaaaucuuguggcccuacuuaacuguauguuuacuauguauaucaccaugugucugcuuucuaacuugguuucaaucucucuguguuuaaaacuugauuauuauguaagaaaaaguaggccaauaaggugaucuuguuuaguagucaucaagggauacucuguccuugaugagcauauagcugaauauucuuagaggaaauauuucugcaguagcauuaugcuaagucaacauggccaaugaaugaauacacaaugcacaucucuuuaucuuagagagauaucaguaaccaaguuaauauacaagguaccauucccugagucuguguacaaucccaaugaaacaggagaugaugaagagaaaauauauauauucaguugugauuauagcuacaaauugcuuccccaguaccacaaauaauaagaaagguuccauguaaaaaaauuuaaccagagucucugaaagaaaaaucuucacaguaguauuacaucauacaccaccuaauuuuuguuauuaaauaauccccccccccagcugcauacgagaggaggcagaugaguugcacuacguguuacacacaucugccauuaggaucuuauuuucggguuauuaugaugacgaugauuaauaagaagagaauauuuuaaaguucaaagaauggcaauauucauaauauauauguuucuuuagaaaagaaguuugccucauaugaaaagcaguaaauagauuguggcauuccaaacucucauacugauggcaugugcuuauuaacaggagauuaaaguucuaauaaaauauggaaagggcaauaaaaagucagauucuugaugaauauguuuuaaauuccauauaauugcuguaucuguacggucaaauuauuaaauaguugaguuuaucaaauacauuuuuugauaaucaaaucuaggaaaaaaaaaccuuuucauuaagccaucaaaccauugugucuuauuauucagugguuugaacacaacaaauauauugguguugaaaauuuaaaaaaaauucaaaccugugaaaagaaaacaagaacauuguuuucauggcaaaguuucaguuuauuaucaggaccaugcucagauaccacucauuccuuuucugaaguaaaauaacaaugauuguuauacacagagauccagaaacaaacauguccauauagucauuuauacauacauacauauauaaaugacauucacauacaugugugucaucauguccuuuauuaggugaaguauuuggcaauaguagacaugguuuucaaguuuugucacuguuucuuuuaauccauggagacauauagaaccucaaaaacacugggugauugaauauaugaauaaauacuuuaaaauaacauucaucucggaaaagucauuugggguucuauaguuaaaaaaaaaaaguccaaugcuaaauugaaaaacaggacuuggaaugucacaggguauaggagauauaauucugaaguagaaaagcaagggccauaaauaauagaugggcaucuaagaggaagggaacauguaggguucucagcaaaaugccaaauuaaucaucaauagugaaaauaacuggugauucuaccuuugccccuaaaucugcacauuuuaaucauuauuucaaaauaaaggcagggccacauauaagggaauuuacuuauguaaggccaauaucuaaguucuaaaggacucaagccuggaccuaccugaaggguagggaaacugcucugcaaucuccagauuuuaugugaagaugcuugauagacauucugucucuuuguaccugucugaucucuuucacuauucuguagccuucugcucucuacccuauagauuaacaucucuuugguuugggugauuuuaucccuagaauguuuaauggacaagucuugccuucaagccaauuucuacuggcuuggaaucccauuaauaucacagaauccccauccauuaugcuuuugauuuuaaaaauauaaaccaugagcucaacccaauuaaacuuauguaacagagaaaugagucagauaucugagugggaaagaacaaaacucacaccaugcugauccagagugcaauuaaagggucacuggggaaguucuaucuaauacaacacagaucccacuacuuguucuagaaagcagguuuauuaauauuuuagaauguuauuccuuuaauuuucuaugaauaauguguaugauaaaugggggcaguugcuucaguuccaaaaugacuaaagagaaucuuauuucuuuuuugaccuuuaccaaguaaaucugcauguuuauuacauguagaaaucaauucgugguuauuuuuuaauauguuagauucuauguucagucuaugauaggacuggauaaccuacaagaaaaauugcuauuucaaaggaaagguauccaaguagccaagucauaacacugccuuuuauauuuuccaaggucuucucaggaugcaacaguagagcauuuacugagaguuaagaauaggcuuugggauaugggaugguggagauguuuguguuggcaaaaugauugcugugcaguuaugccugaauucagauucccuauguaaaaaccuaggcauggcagcacuuacucuggaaguaagagaaaagaaaaucccuaaagcuuacugacuggcuaguuuugagaaauuaaugggcucaggguucaggaaagaucaucucaaaaccuaaaguggaaaaucaugaagaaguguauccgguguugacaucaguccccugaacauaugcacacacaauauaucuaccauaccaugcacacucaaacagaccugcacuucaacauguacacacacacacacacacacacacacacacacacacacaccuaugagcacacacacacacgugcucacaugcacacacagggagcaaagguuuugcuuaggcucagaaagguugaaagagaaacacucugacagcaacaguugaugcaaaaccaauaaauguguuauuaguugcucaauuauguacugacuacaagaagggauuccugacuacugugcacaccaauuucuguucuucucuguagacugggauugagcuucaacagcaucaccguuauggagaauggcagucuggccaauguuccucaucugagggaacuccacuuggacaacaacaaacuccucagggugccugcugggcuggcacagcauaaguauauccagguaaagcaaaucaguuccuuuuaggacuaucuggaaaggaauccucccagugugauucugggaggaagggaacucuggacagaaaguuauucacgucauggcucucucuauuguaacaacaucuuaugaguuggggguuuggagagcauucauggccucagaucagaguaacaguaucgcuagguucuggugagagccucacccaaacucugagcuucugauaucaccacuugaugucacaugguagaaagugccuuccuguagggcagcaaucccuuuugugacuguucacuuuccauaggcccauccugcaccccauguuauugaaaguuuuaaaacaugaacuugggaggauacaacagccaagccauugcauaaaaaggaacuuuaaauauugucacauaaacauucuuuugcagaaaacauguuuaauuuuuuaauuuuuaaaauaaacacaccuuggauaauuuauaaaacucacuucuaaaauagauauuucuuauugguuagccugauccaaggucaucgaccaguguaacaaauaaguagcuguuguaaaaggcagugaccagugacgguaugaucagugaugcagaauaaacaagguuuaacuguaagcuaaaaguagauucauggcugaaaaaucaaugcacugaguuaauuuuauuuaaguuaucaaaugacauagcuugauaaagauagaaauacuggaaccaguagucuguuggguugauagcuuuguguccauaaaucuacaaauauaagucauacuuauuaaguagugacaaaaauaauuauguauaacaacagaauccagugcuacuuugagaaacuaaaauuggaaaauuguuuauucagguuacuccuuuaagaaaaaaauaaaaccaaaaugaaaacccaguauuuuaaauggguuuacacaauuauuuucagggauguuuuguguguguuuauguguguaugcguguguguguuaagauuuuuuuuucuauuuugauuuguuuuuguuuugaucauuuguuugagauaaaucucauuuuguaguucuggcuuuccugggacucacuauguagaccaggcuaaccucaaaugcacagagauccuccugcccauacaucccaaguucugggauuuaaaggcaugugacauuacauucuuaagacauucuuuucauuuaaauaacuguuaaguucaaucacugugucuccaaaacaacauuuugauccauuucauaggcaaaauaauauaauauccauguguugcugguagcauaagauaggcugaucuuuuguuuugcugucaguaauguucaaagcaaaaguucucccuuucuuugugguuuaguuauggcaucguuuccaaguucaacugauaacaaauuugacauuaaaugaguuuaauuaguguuugacaugaaagugaucacaacacuccccauguuuucuugcaugcugauucuuuucacugggcgugcuuggcaggguuaguggguggauagaauuuguagcuguugguucucuaaaugaaugacuuagaagacuugacaaaauuaguuauccauuugaaccgucaagguuuccguugaguuuaguuuuguguuuugguuccacuguuaccauuuuuuacucguguuuuuuuuuuuuuucucaucagcuuggcacacacuacagaggucaugggauugcuuuacccccccggcacauuaaagaaggaaacacaguagaaaacaacuguccaauuugaugccacuucauacaauuuuguuucauagauuuuggcucuaagcuccaagugguagcacacuuugucuugucagucacggaggaagacaaugaagugugaagcucugaagucuguugaauuuaaggaaaucauuuccauaguaacacguauuugaaaagaaucacacugcgcucuggcucccuaauuuuuagaacccgcauccucuuuacaucuuuacuucacgauccuaaggauuucauauguauuacuucuuuuucuguuauuuuguaaaacuuauaaauacuuauuuuuaauuuuuauuauauacuuugaacccuauaagaauuuuauucccagcacucgggaggcagaggcaggcagauuucugaguucgaggccagccuggucuacaaagugaguuccaggauagccagggcuacacagagaaacccugucucgaaaaacaaaaaacaaacaaacaaacaaacaaacaaaaacaaaaaacaaaaacaaaaaaauaaaaaaagaauuuuaugcaauuagacaaacuauuuugccuaaauauauuauaauauauuauauuuguauguugucccuccuuacucuaacuuccuuguguccaagucucaacccaacccucaaacccuuaaacaucauaugcucuuugggcucugacucucucugucucucucugucgcugucucucugucucucugucucucucugucugucucucucugucugucucugucugucucucucugucucucugucucucucucucugucucuccuguguguguguguguguguguguguguguguguguauguguguguguguguguauguguguaaaacacagaguccaauuugugcugauaucuacaggaagauuuacugggaaaccauccacuguugguugugugugguuggagugugguuauauauccuuauagaaaacuagaaucuaaaaguuaugggagagacaagaauguaaacaagauauauugccugaaaaaaaaauuuuaagguaaauuuaaaaacagaaaaguaagguuggcuccccauccguuguuaauagcuauguugaagcaugugaggugcucccuccuccaugcugaagacuucccuggcuccauccugagcaggcaaccacagcugcugugacucacuaguaccacaacccugugauguccagaaagcccuguuuuaccucauucugccaagaccucugguucuuauaaucuuuccacacccucuucuguaaugugucuggagccuucuugggaguggguggagugcuauguagauaguguuuaugccagagcacuuuaccuagugugauucucugcacuguggcccuuugugacuuuccguauuucauuauuuauauuucuggauuucuauauucaugccaucuacggcacagagaagcuucucugacggagacugagacaacauaaacuuacauauucauccugaaaggguugucuucccccaaauuucucucugaaucauuuuaguuugucuucuucacaauguacuuuuuggcauggccguuuuuacuguuuuuaucucagacuuccucuggaauggaaaaaggauacaauggguuuuugaaaaccaaaggagaaaguaggaagagcuggcagcgauguaaauaguugaagacgaggccccagaggcuuuggcuggguugagggagcagucaugaagggaucugcauuaugugugcacuuugaagauaaggugguagaacuggaugguguggaagugucaugucuguagccugaacaucuagaaugccugauguucaacauacagagacagggcauauggaggaaggaaaagcaaauuuugaaauaaaggcacaaaaugaaauuuggcuugaggaauuguuaugucuucauacuuaaaugcccaaauuaaaaauaguacuuauaugaagaaccucaacccccaaauggagaauaaucauuccacaauacuucauguugcaggucgucuaccuucacaacaacaacaucuccgcaguugggcaaaaugacuucugccgagcuggacaccccucucgaaaggcuuccuacucggcugugagucuuuacggcaacccuguccgguauugggaaaucuuuccaaacaccuucagaugugucuaugugcguucugccauucaacuuggaaacuacaaguaacccucagacggccuaauucuuauaaucuggaaaaacaccccaauaugucaauaucauugcuaaaaagaaaaaauacuaaaaaagaaagaaagaaugcuagauucuggaaauucaagcacacugugcaugccuuuuccacaugacuuauuaugcaagcugaauauacagauugaauaauugccuacaauaaaaauauuuuacuuguaguauucagaaucacuuuuaaaguugucuguaguugugaacugaguuaucaaagucugauguaaucauaaaugucaaccacuuaguaaagcguuaaaaggaacagaauacaaagucucuguaauucauagagcuaaauuaacucuuuugacauaaagucaaaugccgccgaacucuagcaauguauuaaucuccuuuauuauuggugaagccuuauuugaguauguaaguucaauaugggcuauguaaaauuuucacugucauauugaaaaaaauaaaauuuuaaaaaugcauucaaaagauauuuuguaaauguuuaauucuaaauauuuuugaaauuucuggacaguugacuguaagaguaucuauuuuucaaauccuuagcauuacuucuauuauuuuuauuuauauucgagaaugacaauguacauuaucuacauccacuauuaggcuuauaaacuacaaagcagauuauuucuuauuaauauaaagaauucauauucuauuacuaauuuauaugaagucaacuuuaaaacuacuaugcaugcaaucaaccugcuuaucuagacauuauuucuguauugacugaaguaguaggaauagauguuuccguuaguuagccacuggcuuuuggaaaaaaaaaaugaguugaauuucaaaacaucugucaagucaggcuuaagaaugugucaggauugggcagcagagcuaagaagauuuaugacuugcaauguuugugccauaucuagugagaaaaaaagugugaagaaucuguuucugcugcagugcuggaugcauucugcucagccaucaugagacagaaaauugaaccuuggcuuuaaccaaaaguggugugcccauuguuugggaugagccuucagguucaggucacacagagcucuccccagcuuucucugccugcuccuuuagcacuaacugcagugcauucugcuccuuccuuucgaccccaggcuggcuucucuuauggcugcaaaauauaaacuccugcugcuauuuucccuucucugaacagacaaacaugcuaucucagagugucuagaaggaauugugagcucuuucuaacgcuuacaagucauuuccaaaucucuguagugugaaggcuaggaaaaccagcuuucacagaaggaagcucaggcugaaauguaacagcuuccucauccaaacaaacaaacaaacaaacaaacaaacaacaaaaacaugacgacucucuuuaguucuuucagacaucuugaggguuauuuucugucuuuccuuccuccacuucuguauuccuaucucucccugaugaccaugccccuuccaauuuuucaauuuuuccccucaauucauuuguguccaguuaggcccuuucaagugcuccuccccaugcgugccguggucuccuuugacuuuccuggauuugagggcuuucucuucacucaacugauguuucuguagccguguaacaccguuuaauuuuaugagguccuacuugucaauggcuagccugaauuccuagucaaauggaaugcuauccagauacucuuuccuauucuuacaucuuguaggguccucccuuuuuccucuccuuguuuguguuucaaguuucacacugauguuuuugauucauuuagaauuaguuuuugugugacacauauaaguauacacacacaacuauauauauauauauauauauauguauguauauacauauauauauauauauauauauauauauauauauauauauauauagagagagagagagagagagagagagauaguugauaguugagccucuuggacacugauaugcucuccuccaaagccauaaucuaauauaaaucugaguaccaggcuuaagaaaccccuuaaaguuguuggucaggagagaauaugugagucucccaaaacaauuccuugcccucaguugccucucagacuucaaaaaaagaccccuaguguugaaaaauccauauauucaggcacaagacuuggaggcccagagguguaucagaccucaaugccugcuuccugaauacuaacuuucauaguccuacaagaaaaguuagaagcucccaggggaaggaaauaaguccuacccagcugugcaauccauuaacaacaacaacaacaacaacaauaacaacaaccaggauuccaagauaucccugaaaguacaaugcuuguauucauaucuuagugguaaccaacaucugauugcaguuaaggaacacaucacaggauggaauccagauggacacuagaaaccugaucaaguacacgugaguauaggacuugggacaucacagaucucagagaagaauccaucaucaucauuaauaaaccagcaaaauuccucacuucauucuaaacauuucuucuaauacuuacagagaaacuuagcucccaauccuuacuggaaaaccuucucuucacaacagaaaaagaccaauacagaaagucaggacuagucacaaugcagagaacaacugauuuugagauucacaguaccaguggauauaaaauacaauuccugcuccuaauuuucagagaauauugaagaugagaggccagaaagaauuuuaaggcuagagacacaggggauagucugugggauugugucuaccagaaaucaaaggggauuuuaucauugauacuucaaccuaaacaagaagugcagcaugggagauaaucauggaacaacuggcaguuagcaagaaugauugguagaugacagcaguucaucauggagacugguuggggaggagcuauucagaacugaaaguaaccauaaagaggaaacuugcaucuuaacaauucccccugacagaugauccuaaaggaagauguuaugauuggauauaaaauguccccuacuggcucauguaguaaacacuuaccagcuaguagcuguuugggaagguccaguggggacagauagagaagaaaucuucaaguuucagagucuggcucuguuccuaugcaucuaauucuuaaccuucccugaugugcacagguugaaucaugccccugccucacaacaacguggaauuauuuccuuccacuaugcuaucccagauaaaauggucugaaccuucaaacucugagccagauuaccuuucugugucaggcauuuggucauagcuaugaacauaguaacugauacagaagccauacucaacuucaccaccaucugaaggaacuacgaaaauaugcauuugaguuucuaauagauagcgcgucauggcaacccaacacuuacacuuuccuuuuuucucugaauauauuuucucugggauauauauauauauauauauauauauauauaucccaauauauucaagagaaggggaaagagaagaaguuuccuuuucaaagccauaucugucacaggauuuuaaaauuaauuaauuaauugucaucaaagagcugggccuugaaugacaugcuuucuauucuguuagaauugaaugaucuucuauaugcuauggaaugucucuuauaauggaaaagucuaggguugcuccguugcuuaacugacacauguguugggacagaaaggagggaagaggauguuggauugguaucugcaaucagauucucuaacauaucuugccuauaauuauagcuauuuguaauucuauuacuuaaaagggagagcugacucuuuagaacuuguuauuuaaauacccacacgauuuucuuuucuucagauaaaguuccucaccaucccuuccuaacucaccauuugcauugcuaaggggagcagacguuuuuacauuucauuucccaguuguuuauagugugguauguguuguaacugaguuaaugcaguguuuauacaaguaucagagccccaaacaugaggaaacugagauguuuggaagauugcagcuaucauucuccagacacauaccuugggcuuuauagucucuauggccuugguuggagucuaagauucugcauuccugauaaaaacagaaauguugaugcucuaggccagcaguucuugaccuguggguugcaacccuuuuggguguugaauguuccuuccacagagguccccuaagaccaucagagauaucagauaugaacauuauaaugcauagagauagaaaaauuaguuuugagguagaaagaacaauauuaugguugauguuguugcacauggagaacuguaauaaauggucaaagcauuaggacuguugaaagucacugcuccauuccuaacguuccuagaagauaacaggaagugugugugguucccauuggaccauuccugucuacauucccuguugcaaaaccacaacuguauggaguuucuaaggcuuuugugacaacgcaauguaagcuacauagcuuugaauaauaaauauauucuauuaugauuucagaggacaaaguucaaaauaaaguauucguucggccauggcuauaauugggaucuagaauguccucucccacuuuggaaucuagacucaguuuugccauagugggagacacuggaagauuuaagagcugaggccugguggaaugcuguacagucaguuccuugaaaggaacuauagaaacccacccagcuccuucuugucaccuuccauguuucaauaaggacacaaaugguuuguuuaaccaucaugauuuuucuggauauucccuaccacgccuauaagaauacauuuuucuuucucuguagacugauuauaucaggcauuaaagccccuuggugacccauacuucuuccuuccaguuccaggacuuuuguggcaccucgguuguaaucccugcccaccccuaccugucuucauauggguuucacugggugacuuugucucuggcucacaaagacccaugaguaguauuguacuccagaucacucugauccauucauucauucacucugagcucauaguagcuucauuacaucugcagacacuaccuucuagugaugucauauuuacaggcacugcugcuuacuuuuaaauaucuucagcaggauggacaaacccacuguuagcaaagauuuuagauuuuuauaauaauuauuuuuguuuuauuuuuagcaacaauggaauuuguuuuauacaugguuuauauaaaaugcugaagaugauuugacucuggucuucuauggauucuacacauguucuaugcuauucugaaccagcuccugucauugucaaagaauccagacuuuccagaacacagcucccauagucuuugaauacauuuuuuaaaagauuuauuuauuuauuauauguaaguacacuguagcuaucuucagacacuccagaagggggcaucagaucuuguuacggauguuugugagccaccaugugguugcugggauuugaacucaggaccuuuggaagagcaaucggugcucuuaacugcugagccaucucucuagcuccugaauacauuucuuaucuaugaccugaccuggcaauggauguugcuaugccaucuucauuacauaagucaguauaacccaggucuccguguucuaccuagaaauguucuuuucucugagucuucauuaccaucuuucauuuuucuuccuuauuuucuccauauaacugugccaagaaacuccuucccucaguaaaguuuuacagcugcugcagacacaggacauaacuaucuuaucuucguguaaacugggaaacaccuaaucccucaagaaaacuggaagcauucuauccagauguuucucauccaucccaaacugaagguaugccugcuccuaggcugccacgcuggccaguuggaagaccucuguauccuucagaugccauucuccacaguaccuggauuaugggaugcugggugggcaccgcagucauuucaagauucccacacuuauuuacuaaaacacuuuuagugcaucuguucacauauacaaucccaccaucugccacaaauacauuauaugcugaugagaauuaguuucaagcuaccauacauaacaguggaaaacaaaguguaaccaagggaaagaagauauauuguucuuagaaaauucacauccagucaucaauacuuuguaaaguuaaauagccuucagugacauaaaaugcucucaaggaaaaggaaaagcuaaaagcuauauaugcaugacccaaauaauaaauaaccagaauaugaguggguaagaagucaucugaguaugaauucucaaauaaugccaccagaugaucuccucaaacccuucaauaagggaugugggagcuuagguauuguucccagaucaguagcaacaaucccaggggaacaaauccauuuuaaacauacaugaagcauuauaacuauucuaucagacaagaacaauuaugggucagcguuuugacugugggaugacaaccacaucucucacuugggcccuucagcauguugaccauuuugaauuugguggacuguaucuuggguauucuguacuuuuuugguuuugacuaauauccacuuagugaguacauacccuuuugggucugugcuaccucacucaggaugacauuuucugguucuguuuauuugccugcaaaacucaggauguucucauuccuaauagcugagaaguauuccauuguguaaaugaaccacauuagaacugcagggauguaacucccuccauggguauuuuguucccccuucuaagaaggaacaaaguauccauacuuuggucuuccuucuucuugaguuucauguguuuugcaaauuguaucuuagguagucuaaguuucuggauuaauauucacuuaucagugagugcauaucaugugaguuauuuugugauugggucaccucacucaggaugauauccuccagauccauccauuugccuaagaauuucauaaauucauuguuuuuaauugcuagguauacuccauuguguaaauguaaccaaggagcuaaaggggucuguaacccuauaggaagaacaacaauacgaacuaaucaauaccaccagaacugugucucuaauugcauauguagcagaggauggccuagucagccaucaaugggaggagaggcccuuggucuugugaagaucguaugccccaguagaagggaaugccaaggccaggaagcaggaguggguggguuggggagcaaggcgagggagaguauaguggacuuucgggauagcauuugaaauguaaaugaagaaaauaucuaauaauauauauacauacacacacacacacauauacacaugcacacaugcauacacacgcacacauagugugcauguguguguauacuacaggaauggaaauguagaggagucugaggaaaagaaaguccagcagcuggcccaaagugggauccagcucaagaggcggccccaaggccugacacuauuacuguagcuauggagcacucacaaaaagggacuuaguauaacugcccucugaaagacccaacaagcaacugaaagaggcagauauuugcgcccaaccaauggacagaagcugcugaccccugugguugaauuagguaaggcugaaaggagcugaggagaaggacaauccuguaggagaaccagcagucucaauugaucuggaccccugagaucucucaagcacugagccaccaaacacacagcauacaccagcugauauggggcccccaacacacuuacaauagaggacugcugggucuguguucauucagagaugaugcaccuaacccucaagagaauggggccccagggaauuuagagaucuggugggguggauucuugcgcgcgcucgacuggccaggaagaacgacgcugcaacaggauccuucugcacacguuuauugggagagcuugauuguagaggcgaaaagacuuuuugcccagagcuggugcugcuuuuauaggccuaggagaggcgugucucauacccugauugguuaugcaccaagccucauuugcauguuccucaucugauuggcuacucucucucaguaccucacugagccucauuaucauaccucauuugcaugucucacaucugauugguuauacucucaguaccuuacagaaccucauuaucaugccugggccaggcaguguuuuugcaaaaaacuuuacugcauauguacacauugguuguuuauccaaucuuaugcgugguggcuagcaguagucagugccacucagcaacggcacauguggcuucccacaucucccccuguuuguuuuaauaaaaugaggcuggacuaggccugugcaauuaugcccauccgccguggcuccuguuuuaggucguuccucuaaugucacagccuuacccgucauaggguaacccuaucgccaccgggccccaugucuuagguuggacugugcacgaggaaaguugcccgucucuggauaccgcagugcugugugacaauaacugcuaaaugaccuagggcgaacucugcaaaagaggccagccaaauauugaauuaguggggaaaucaugaucacccuauugaugagcaagggcugaucaaugaucguugagucucucucaucuaaucucaugcugacuaauucuugagcauagauaaccaaauuucaggggaggagccguuuucaauagcuaaaagugccugaguuacaaucaccuugucacguuuuuguuggguucugaauuugcauaccaaccagagcaugaacgccaguccacagcauauggcagcaccaaacaaaaucacucccacccauuccuuaaaguaagaaaaagcagagguaaaccaagagguaaagucuccgagggucacugguuccacucuggucccauuaagguucaggaucugcaucugcagucucgccugcaaccucuccagcuccugcgaccaguuccccuucagguaauucgauaggucuguacuuuuaauaaaagaauuauuaauauacuuauugggaguaaugcacacaugcgauguggaugccacacaacucauuuguaugacauccaucauccguuccauauuauguuguaaaauauccacucucugauucacuagcauuaacccugaggcgauaugagaauccaccuuuugcaggguaagcaaugcuucagaggauuuuucugcuaucugacuuauggugucagcaguauuaacuugaugggccauagcaguuccugcgguaacugcugaugccgcggacaucacaauggcuguaauaauggcagcugugauuccaaaaccucucuuuugccgaauaagacucguuauugggaacuucucuggaucugccucaacaggcacagggacaaagauugguagaugaaccacuaaggcuaagaauuugguuccauuccagcauugcgucaaaaaacaagugacauuuguacaaucuaaccauucuguauuauuuugaaauucagccaauauaaagaaaaauggaggauugacacaaacuucuacuggagaaguagucauauuucugauaauucuauuaguugucacauuaucuaaaugaguagagguauuggaaagaguggcagaaacauucaauaucucaugaaagguuccagucagcaaugcaaaggcugacagacugguacuagcaccugccucauugcuuaaaauccauugguaauauggccaaauauucuuucccuguagcaucuccuuuaucguucauuauagcaaaaucuagugggggugacaaaacgaaacccuuugcuauuucuuuccgagggaaaauuuuugauugacaaggugaaaaaacuauaggaaaugcgagguccggaugacaccaaggcaugcugcguauagcaguagcauugccaacaggccaucgugaucuuuugggaauggucaccuuucccuuuaucauaauaguggugauguuuauaggugaaguuauauuauuuucaacaucaccugagccugauugcgcuccuugagcaacuugcauuaaagcauuaaacaacacuccagagcuccccuuauuuuggcuaaugggaucugcccaauuagagauaaucuuuuucuuuaaaaauauacaggguguaaaagguuuauccacauuaugcacaaagcauaguguauaauucaaaugaaaacuaguacuauuauacacccguggcucuugaggaguuugucgugcacaaggcgcauccaaauaacauuccguugcaaaaaauaaagguaagguagaagaauuggaauguaccgguaaagguacuggccaugaucuuacuauggcccacaaagguauacuuaucccggucucaaucaucaggagcaggagaaucaucuugggguucaucuugcucuuucacgguccuugucagucgcgucg

(The sequence listing continues in the following parts.)

What is claimed is:

1. A method of inducing expression of a non-imprinted target gene in a cell, wherein expression of the target gene is inhibited by a PRC2-binding RNA, the method comprising delivering to the cell a composition comprising an isolated single stranded oligonucleotide of 5 to 40 nucleotides in length having a region of complementarity that is complementary with at least 5 contiguous nucleotides of the PRC2-binding RNA that inhibits expression of the target gene, wherein the oligonucleotide is complementary to and binds specifically within a PRC2-binding region of the PRC2-binding RNA and interferes with binding of PRC2 to the PRC2-binding region without inducing degradation of the PRC2-binding RNA, wherein the PRC2-binding region has a nucleotide sequence protected from nucleases during an RNA immunoprecipitation procedure using an antibody directed against PRC2, wherein the PRC2-binding RNA is not ANRIL lncRNA and is transcribed from a sequence of the chromosomal locus of the target gene, and wherein a decrease in recruitment of PRC2 to the target gene in the cell following delivery of the single stranded oligonucleotide to the cell, compared with an appropriate control cell to which the single stranded oligonucleotide has not been delivered, indicates effectiveness of the single stranded oligonucleotide.

2. The method of claim 1, wherein the RNA is a lncRNA.

3. The method of claim 1 further comprising detecting expression of the PRC2-binding RNA in the cell, wherein expression of the PRC2-binding RNA in the cell indicates that the single stranded oligonucleotide is suitable for increasing expression of the target gene in the cell.

4. The method of claim 1 further comprising detecting a change in expression of the target gene following delivery of the single stranded oligonucleotide to the cell, wherein an increase in expression of the target gene compared with an appropriate control cell indicates effectiveness of the single stranded oligonucleotide.

5. The method of claim 1, wherein the cell is in vitro.

6. The method of claim 1, wherein the cell is in vivo.

7. The method of claim 1, wherein at least one nucleotide of the oligonucleotide is a modified nucleotide.

8. The method of claim 1, wherein the PRC2-binding RNA is transcribed from the same strand as the target gene in a genomic region containing the target gene.

9. The method of claim 1, wherein the oligonucleotide has complementarity to a region of the PRC2-binding RNA transcribed from a portion of the target gene corresponding to an exon.

10. The method of 1, wherein the oligonucleotide has complementarity to a region of the PRC2-binding RNA transcribed from the same strand as the target gene within a chromosomal region within −2.0 kb to +0.001 kb of the transcription start site of the target gene.

11. The method of claim 1, wherein the oligonucleotide has complementarity to a region of the PRC2-binding RNA transcribed from the opposite strand of the target gene within a chromosomal region within −0.5 to +0.1 kb of the transcription start site of the target gene.

12. The method of claim 1, wherein the oligonucleotide has complementarity to the PRC2-binding RNA in a region of the PRC2-binding RNA that forms a stem-loop structure.

13. The method of claim 1, wherein at least one nucleotide of the oligonucleotide is an RNA or DNA nucleotide.

14. The method of claim 1, wherein at least one nucleotide of the oligonucleotide is a ribonucleic acid analogue comprising a ribose ring having a bridge between its 2'-oxygen and 4'-carbon.

15. The method of claim 14, wherein the ribonucleic acid analogue comprises a methylene bridge between the 2'-oxygen and the 4'-carbon.

16. The method of claim 1, wherein at least one nucleotide of the oligonucleotide comprises a modified sugar moiety.

17. The method of claim 16, wherein the modified sugar moiety comprises a 2'-O-methoxyethyl modified sugar moiety, a 2'-methoxy modified sugar moiety, a 2'-O-alkyl modified sugar moiety, or a bicyclic sugar moiety.

18. The method of claim 1, wherein the oligonucleotide comprises at least one modified internucleoside linkage.

19. The method of claim 18, wherein the at least one modified internucleoside linkage is selected from phosphorothioate, phosphorodithioate, alkylphosphonothioate, phosphoramidate, carbamate, carbonate, phosphate triester, acetamidate, carboxymethyl ester, and combinations thereof.

20. The method of claim 1, wherein the target gene is a protein-coding gene.

21. The method of claim 1, wherein the chromosomal locus of the target gene is an endogenous gene of an autosomal chromosome.

22. The method of claim 1, wherein the cell is a cell of a male subject.

23. The method of claim 1, wherein the oligonucleotide has complementarity to a region of the PRC2-binding RNA transcribed from a portion of the target gene corresponding to an intron-exon junction or an intron.

24. The method of claim 1, wherein the oligonucleotide has complementarity to a region of the PRC2-binding RNA transcribed from a portion of the target gene corresponding to a translation initiation region or a translation termination region.

25. The method of claim 1, wherein the oligonucleotide has complementarity to a region of the PRC2-binding RNA transcribed from a portion of the target gene corresponding to a promoter.

26. The method of claim 1, wherein the oligonucleotide has complementarity to a region of the PRC2-binding RNA transcribed from a portion of the target gene corresponding to a 5'-UTR.

27. The method of claim 1, wherein the oligonucleotide has complementarity to a region of the PRC2-binding RNA transcribed from a portion of the target gene corresponding to a 3'-UTR.

* * * * *

UNITED STATES PATENT AND TRADEMARK OFFICE
CERTIFICATE OF CORRECTION

| | |
|---|---|
| PATENT NO. | : 9,328,346 B2 |
| APPLICATION NO. | : 13/884670 |
| DATED | : May 3, 2016 |
| INVENTOR(S) | : Jeannie T. Lee et al. |

Page 1 of 1

It is certified that error appears in the above-identified patent and that said Letters Patent is hereby corrected as shown below:

In the Claims

In column 115, line 44, Claim 10, delete "1," and insert -- claim 1, --.

Signed and Sealed this
Twelfth Day of July, 2016

Michelle K. Lee
*Director of the United States Patent and Trademark Office*